United States Patent 11,931,406 (FLAVIVIRUS VACCINE) - sequence listing, part 10

SEQ ID NO: 6177 - RNA, 9879 nt, Artificial Sequence
  derived and/or modified CDS sequence (wt) from DENV-1__KT187561__SS-prME
uccgugaccaugcuccucaugcugcugcccacagcccuggcguuccauuugaccacacgagggggagagccacacaugauaguuagcaagcaggaaagaggaaagucacucuuguuuaagaccucugcaggugucaacaugugcacccucauugcaauggauuugggagaguuaugugaggauacaaugaccuacaaaugcccccggaucacugaagcggaaccagaugauguugauugcuggugcaaugccacagacacaugggugaccuaugggacguguucucagacuggcgaacaccgacgggauaaacguucugucgcauuggccccacacguggggcuuggucucgaaacaagaaccgaaacguggauguccucugaaggcgccuggaggcagauacaaaaaguggagacuugggccuugagacacccaggauucacggugauagccuuuuuuuuagcacaugccauaggaacauccauuacccagaaagggaucaucuucauuuugcugaugcuggugacaccaucaauggccaugcgaugcgugggaauaggcaacagagacuucguugaaggacugucaggagcaacauggguggaugugguacuggagcauggaagcugugucaccaccauggcaaagaauaaaccaacauuggacauugaacucuugaagacggaggucacgaacccugccgucuugcgcaaacugugcauugaagcuaaaauaucaaacaccaccaccgauucaagauguccaacacaaggagaagcuacacugguggaagaacaagacgcgaacuuugugugucgacgaacauucguggacagaggcugggguaaugguuguggacuauucgggaagggaagcuuacuaacgugugcuaaguuuaagugugugacaaaacuugaaggaaagauaguucaauaugaaaacuuaaaauauucggugauagucacuguccacacuggggaccagcaccagguaggaaaugagacuacagaacauggaacaauugcaaccauaacaccucaagcucccacgucggaaauacagcugacugacuacggagcccuuacauuggacugcucaccuagaacagggcuggacuuuaaugagauggugcuguugacaaugaaagaaaaaucauggcuuguccacaaacaaugguuucuagacuuaccauuaccuuggaccucgggggcuucaacaucucaagagacuuggaacagacaagaucugcuggucacauuuaagacagcucaugcaaagaagcaggaaguagucguacuggggucacaagaaggagcaaugcacacugcguugacuggggcgacagaaauccagacgucaggaacgacgacaaucuucgcaggacaccugaaauguagacuaaaaauggauaaacugacuuuaaaaggggugucauaugugaugugcacaggcucauuuaagcuagagaaggaaguggcugagacccagcauggaacuguccuagugcagguuaaauaugaaggaacagaugcaccaugcaagauuccaauuucaacccaagaugagaaaggagugacccagaaugggagauugauaacagccaaucccauaguuacugacaaagaaaaaccagucaacauugaaacagaaccacccuuuggugagagcuacaucgugauaggggcgggugaaaaagcuuugaaacuaagcugguuuaagaaaggaagcagcauagggaaaauguucgaagccaccgcccgaggagcacgaaggauggcuauccugggagacacagcaugggacuucgguuccauaggagggguguucacaucugugggaaaauugguacaccagguuuuuggaaccgcauaugggguccuguucagcgguguuucuuggaccaugaaaauaggaauagggauucugcugacauggcuaggauugaauucaaggagcacgucacucucgaugacgugcauugcaguuggcauggucacacuguaccuaggagucaugguucaagcggacucggggugugugaucaacuggaagggcagagaacucaaguguggaaguggcaucuuugucacuaaugaaguccacacuuggacagagcaauacaaauuccaggcugacuccccaaaaagacuaucagcagccauugggaaggcaugggaggaaggcguguguggaauucgaucagccacacgucuugagaacaucauguggaagcaaauaucaaaugaauugaaccacauucuacuugaaaaugacaugaaauucacagugguuguaggagacgccaauggaaucuugacccaaggaaaaaagaugauuaggccacaacccauggaacacaaauacucauggaaaagcuggggaaaagccaaaaucauaggagcagauacacagaauacuaccuucaucaucgauggcccagacacuccagaaugccccgaugaccagagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaacgagaccuggaagcuagcgagagccuccuucauagaagugaagacaugcaucuggccaagaucccacacucuauggagcaauggagucuuggaaagugaaaugauaaucccaaagauauauggaggaccaauaucucagcacaacuacagaccaggguauuucacacaaacagcagggccauggcaccuaggcaaguuggaacuagacuuuaauuugugugaaggcaccacaguuguuguggaugaacauuguggaaaucgagguccaucucuuagaacuacaacagucacaggaaagauaauccaugaauggugcugcagauccugcacgcuaccccccuuacgcuucagaggagaagacggauguugguauggcauggaaaucagaccagucaaggagaaggaagagaaucuagucaggucaauggucucugcagggucaggagaaguggacaguuuuucauugggacuacuaugcguaucaauaaugauugaagaagugaugagauccagauggaguagaaagaugcugaugacuggaacacuggcuguuuucuuccuucuuauaaugggacaacugacauggaaugaucugaucagguuaugcaucaugguuggagccaaugucucagacagaauggggaugggaacaacguaccuagcuuuaauggccacuuuuaaaaugagaccgauguucgcuguugggcuauuauuucgcagacuaacauccagagaggugcuccuucucacaauuggacuaagccugguggcauccguggagcuaccaaauucuuuagaggagcuaggggacggacuugcgaugggcaucaugauguuaaaauuguugacugauuuucagucacaccaguuguggacuaccuuacugucucugacauucaucaaaacaacucuuucacuagauuaugcauggaagacaauggcuaugguauugucaaucguaucucucuuuccucuaugucuauccacgaccucucaaaaaacaacauggcuuccgguguuguuaggauccuuuggauguaaaccacuaaccauguuucuuauaacagaaaacaaaauuuggggaaggaaaaguuggccccucaaugaaggaauuauggcuguuggaauagucagcauuuuacuaaguucacuccucaaaaaugacgugccacuagccggcccacuaauagcuggaggcaugcugauagcauguuacgucauuuccggaagcucagccgauuuaucauuggagagagcggcugaggucuccugggaagaagaagcagaacacucuggugccucacacaacauacuaguggagguccaagaugauggaaccaugaaaauaaaagaugaagagagagaugacacgcucacuauacuccucaaagcaacuuuguuggcaguuucagggguguacccaaugucaauaccagcaacccuuuuugugugguauuuuuggcagaaaaagaaacagagaucaggagucuugugggacacacccagcccuccagaaguagaaagagcaguucuugaugaugguaucuauagaaucuugcaaagaggacuguuggguaggucccagguaggagugggaguuuuucaagacggcguguuccacacaauguggcaugucaccaggggggcuguccucauguaccaagggaagaggcuggaaccaaguugggccagugucaaaaaagacuugaucucauauggaggagguuggagguuucaaggaucauggaacacgggagaagaaguacaggugauagcuguugaaccagggaaaaacccaaagaauguacagacaacgccgggcaccuucaagaccccugaaggcgaaguuggagccauagcccuagauuucaaaccuggcacaucuggaucucccaucguaaacagagaggggaaaauaguaggucuuuauggaaauggaguggugacaacaaguggaaccuacgucagugccauugcccaagcuaaagcgucacaagaagggccucuaccagagauugaggacgagguguuuaagaaaagaaaccuaacaauaauggaccuacauccaggaucaggaaaaacaagaagauaucuuccagccauaguccgugaggccauaaaaaggaaacugcgcacgcuaaucuuggcucccacaagaguugucgccucugaaauggcagaggcgcuuaaaggaaugccaauaagauaucagacaacagcaguaaagagugaacacacaggaaaggagauagucgaucucaugugccacgccacuuucaccaugcgucuccuaucuccagugagaguucccaauuacaacaugauuaucauggaugaagcacacuuuaccgauccagccagcauagcggccagaggguacaucucaacccgaguggguaugggugaagcagcugcgaucuucaugacagccacucccccaggaucgguagaggccuuuccacagagcaaugcaguuauccaagaugaggaaagagacauuccugagagaucauggaacucaggcuacgacuggaucacugacuucccaggaaaaacagucugguuuguuccaagcaucaaaucaggaaaugacauugccaacugcuuaagaaaaaacgggaaacgggugauccaauugagcagaaaaaccuuugacacugaauaccagaaaacgaaaaacaaugauugggacuauguugucacaacagacauuuccgaaaugggagcaaauuuccgggccgauaggguaauagacccaaggcggugcuugaagccgguaauacuaaaagauggcccagagcgcgucauucuggccggaccaaugccagugaccgcggccagugcugcccagaggagaggaagaauuggaaggaaccaaaacaaggaaggugaccaguauauuuacaugggacagccuuuaaauaaugaugaggaccacgcucauuggacagaagcaaaaaugcuccuugacaauauaaauacgccagaagggauuaucccagcccucuuugagccagagagagaaaagagugcagcaauagacggggaguauagacugcggggagaagcaaggaaaacguucguggagcuaaugagaagaggggaucuaccaguuuggcuaucuuacaaaguugccucagaaggcuuccaguacuccgacagaagauggugcuuugacggggaaaggaacaaccagguguuggaggagaacauggacguggagaucuggacaaaagaaggagaaagaaagaaauugcgaccucgcugguuagaugccagaaccuacucugauccacuggcucugcgcgaguuuaaggaguucgcagcuggaagaagaagugucucaggugaccuaauauuagaaauagggaaacucccacagcauuugacgcuaagggcccagaaugcuuuggacaacuuggucauguugcacaauuccgaacaagggggaaaagccuauagacaugcuauggaagaacuaccagacaccauagaaacauugaugcuacuagccuugauagcugugcugacugguggaguuacguuguuuuuccuaucaggaaaaggucuagggaaaacauccauuggccuacuuuguguaauggccucaaguguacuguuauggauggccaguguggagccccauuggauagcggccuccaucauacuagaguuuuuucugauggugcugcuuauuccagagccagacagacagcguacuccacaggacaaucaacuagcauauguggugauagguuuguuauuccugauauugacaguggcagccaaugagaugggauuacuggaaaccacaaagaaagaccuggggauuggccauguagucgccgaaaaccaccaccaugccacaaugcuagacauagacuuacauccagcuucagccuggacccucuaugcaguagccacaacaauuaucacucccaugaugagacacacaauugaaaacacaacggcaaacauuucccugacagcuauugcaaaucaggcggcuauauuaaugggacuugacaagggauggccaauaucgaagauggacauaggagugccacuucucgccuuagggugcuauucccaggugaacccauugacacugacagcggcgguguuaauguuaguggcucauuaugccauaauuggaccuggacugcaagcaaaagcuaccagagaagcccaaaaaaggacugcggccggaauaaugaaaaauccaacuguagacgggauuguugcaauagauuuggauccugugguuuaugaugcaaaauuugaaaaacagcuaggccaaauaauguuacuaauacucugcacaucacagauucucuugaugcggacuacaugggccuuaugugaaucuaucacacuggcuacuggacccuugaccacucucugggagggaucuccuggaaaauucuggaauaccacgauagcaguguccauggcaaacaucuucaggggaaguuauuuagcaggggcaggucuggccuucucauuaaugaaaucuuuaggaggagguaggagagguacgggagcucaaggggaaacauugggagaaaaauggaaaagacaacuaaaccaacugagcaagucagaauuuaacacuuacaaaaggaguggaauuauggagguggacagauccgaagccaaggagggacugaaaagaggagaaacaaccaaacaugcagugucgagaggaacagccaaacuuaggugguuuguggagaggaaccuugugaaaccggaagggaaagugauagaccucgguuguggaagagguggcuggucauauuacugcgcugggcugaagaaggucacagaaguaaagggauacacaaaaggaggacccggucaugaggaaccuaucccaauggcgacuuauggauggaacauagugaagcuacacucuggaagggauguauucuuuacaccaccugagaaaugugacacccuuuugugugauauuggugaguccucuccgaauccaacuauagaagaaggaagaacguuacguguucuaaagaugguggaaccauggcucagaggaaaucaguuuugcauaaaaauccuaaauccuuauaugccaagugugguagaaacucuggagcaaaugcaaagaaaacauggagggaugcuagugcgaaacccacucucaagaaauuccacccaugaaauguacugggucucauguggaacaggaaacauugugucggcagugaacaugacauccagaaugcugcugaaucgguucacaauggcucacaggaagccaacguaugaaagagacguggacuugggcgcuggaacaagacauguggcaguggaaccagagauagccaaccuagacauuauuggccagaggauagagaacauaaaaaaugaacauaagucaacauggcauuaugaugaggacaauccauacaaaacaugggccuaucauggaucauaugaggucaagccaucagggucagccucauccauggugaauggcguggugagauugcucaccaagccaugggauguuauccccauggucacacaaauagcuaugacugauaccacacccuucggacaacagaggguuuucaaagagaaaguugacacacgcacaccaagaccaaaacgaggcacagcacaaauuauggaggugacagccaagugguuguggggauuccucucuagaaauaaaaaacccagaaucugcacaagagaggaguucacaagaaaaguuaggucaaacgcagcaauuggagcaguguuuguugaugaaaaccaauggaacucagcaaaagaagcaguggaagacgaaagguuuugggaccucgugcacagagagagggagcuucauaaacagggaaaaugugccacgugugucuacaauaugauggguaaaagagagaaaaaacuaggagaguuuggaaaggcaaaaggaagucgugcaauaugguacaugugguugggagcacgcuuucuagaauuugaagcccuuggcuucaugaaugaagaccacugguucaguagggagaauucacucaguggaguggaaggagaaggacuacauaaacuuggauacauacucagagacauaucaaagauuccagggggaaauauguaugcagacgacacagcuggaugggacacaagaauaacagaggaugaucuccagaaugaggcuaaaaucaccgacaucauggagccugaacaugcucuacuggcuacgucaaucuucaagcugaccuaucaaaauaaggugguaagggugcaaagaccagcaaaaaguggaaccgugauggacgucauauccagacgugaccagagaggaaguggacaggucggaacuuauggccuaaacacuuucaccaacauggagguccaacuaauaagacaaauggaaucugaaggaaucuuuucacccagcgaauuggaaaauucaaaucuagcugagagaguucucgacugguuggaaaaacauggcgucgaaagguugaaaagaauggcaaucagcggagaugacuguguggugaaaccaacugaugacagguucgcaacagcuuuaacagcccugaaugacaugggaaaggugagaaaagacauaccgcaaugggaaccuucaaaaggauggaaugacuggcagcaagugccuuucuguucacaccacuuccaccaacugauuaugaaggaugggagggagauaguggugccaugccgcaaccaagaugaacuugugggcagggccagaguaucacaaggcgccggguggagccugagagaaacugcuugccuaggcaagucauaugcacaaauguggcagcugauguacuuccacaggagagaccugagacuggcggcuaaugcuaucuguucagccguuccaguuaauugggucccaaccagccgcaccaccuggucgauccaugcccaccaucaauggaugacaacagaagacauguugucaguauggaauaggguuuggauagaggaaaacccauggauggaggacaaaacucauguauccagcugggaagauguuccauacuuaggaaaaagggaagaucaaugguguggaucucugauaggcuuaacagcaagagccaccugggccaccaacauacaaguggccauaaaccaagugagaaggcuuauugggaacgagaauuauuuagacuacaugacaucaaugaagagauucaagaaugagagugaucccgaaggagcccucugguaa

SEQ ID NO: 6178 - RNA, 9879 nt, Artificial Sequence
  derived and/or modified CDS sequence (wt) from DENV-1__KT187562__SS-prME
uccgugaccaugcuccucaugcugcugcccacagcccuggcguuccauuugaccacacgagggggagagccacacaugauaguuagcaagcaggaaagaggaaagucacucuuguuuaagaccucugcaggugucaacaugugcacccucauugcaauggauuugggagaguuaugugaggauacaaugaccuacaaaugcccccggaucacugaagcggaaccagaugauguugauugcuggugcaaugccacagacacaugggugaccuaugggacguguucucagacuggcgaacaccgacgggauaaacguucugucgcauuggccccacacguggggcuuggucucgaaacaagaaccgaaacguggauguccucugaaggcgccuggaggcagauacaaaaaguggagacuugggccuugagacacccaggauucacggugauagcccuuuuuuuagcacaugccauaggaacauccauuacccagaaagggaucaucuucauuuugcugaugcuggugacaccaucaauggccaugcgaugcgugggaauaggcaacagagacuucguugaaggacugucaggagcaacauggguggaugugguacuggagcauggaagcugugucaccaccauggcaaagaauaaaccaacauuggacauugaacucuugaagacggaggucacgaacccugccgucuugcgcaaacugugcauugaagcuaaaauaucaaacaccaccaccgauucaagauguccaacacaaggagaagcuacacugguggaagaacaagacgcgaacuuugugugucgacgaacauucguggacagaggcugggguaaugguuguggacuauucgggaagggaagcuuacuaacgugugcuaaguuuaagugugugacaaaacuugaaggaaagauaguucaauaugaaaacuuaaaauauucggugauagucacuguccacacuggggaccagcaccagguaggaaaugagacuacagaacauggaacaauugcaaccauaacaccucaagcucccacgucggaaauacagcugacugacuacggagcccuuacauuggacugcucaccuagaacagggcuggacuuuaaugagauggugcuguugacaaugaaagaaaaaucauggcuuguccacaaacaaugguuucuagacuuaccauuaccuuggaccucgggggcuucaacaucucaagagacuuggaacagacaagaucugcuggucacauuuaagacagcucaugcaaagaagcaggaaguagucguacuggggucacaagaaggagcaaugcacacugcguugacuggggcgacagaaauccagacgucaggaacgacgacaaucuucgcaggacaccugaaauguagacugaaaauggauaaacugacuuuaaaaggggugucauaugugaugugcacaggcucauuuaagcuagagaaggaaguggcugagacccagcauggaacuguccuagugcagguuaaauaugaaggaacagaugcaccaugcaagauuccaauuucaacccaagaugagaaaggagugacccagaaugggagauugauaacagccaaucccauaguuacugacaaagaaaaaccagucaacauugaaacagaaccacccuuuggugagagcuacaucgugauaggggcgggugaaaaaacuuugaaacuaagcugguuuaagaaaggaagcagcauagggaaaauguucgaagccaccgcccgaggagcacgaaggauggcuauccugggagacacagcaugggacuucgguuccauaggagggguguucacaucugugggaaaauugguacaccagguuuuuggaaccgcauaugggguccuguucagcgguguuucuuggaccaugaaaauaggaauagggauucugcugacauggcuaggauugaauucaaggagcacgucacucucgaugacgugcauugcaguuggcauggucacacuguaccuaggagucaugguucaagcggacucggggugugugaucaacuggaagggcagagaacucaaguguggaaguggcaucuuugucacuaaugaaguccacacuuggacagagcaauacaaauuccaggcugacuccccaaaaagacuaucagcagccauugggaaggcaugggaggaaggcguguguggaauucgaucagccacacgucuugagaacaucauguggaagcaaauaucaaaugaauugaaccacauucuacuugaaaaugacaugaaauucacagugguuguaggagacgccaauggaaucuugacccaaggaaaaaagaugauuaggccacaacccauggaacacaaauacucauggaaaagcuggggaaaagccaaaaucauaggagcagauacacagaauacuaccuucaucaucgauggcccagacacuccagaaugccccgaugaccagagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaacgagaccuggaagcuagcgagagccuccuucauagaagugaagacaugcaucuggccaagaucccacacucuauggagcaauggagucuuggaaagugaaaugauaaucccaaagauauauggaggaccaauaucucagcacaacuacagaccaggguauuucacacaaacagcagggccauggcaccuaggcaaguuggaacuagacuuuaauuugugugaaggcaccacaguuguuguggaugaacauuguggaaaucgagguccaucucuuagaacuacaacagucacaggaaagauaauccaugaauggugcugcagauccugcacgcuaccccccuuacgcuucagaggagaagacggauguugguauggcauggaaaucagaccagucaaggagaaggaagagaaucuagucaggucaauggucucugcagggucaggagaaguggacaguuuuucauugggacuacuaugcguaucaauaaugauugaagaagugaugagauccagauggaguagaaagaugcugaugacuggaacacuggcuguuuucuuccuucuuauaaugggacaacugacauggaaugaucugaucagguuaugcaucaugguuggagccaaugucucagacagaauggggaugggaacaacguaccuagcuuuaauggccacuuuuaaaaugagaccgauguucgcuguugggcuauuauuucgcagacuaacauccagagaggugcuccuucucacaauuggacuaagccugguggcauccguggagcuaccaaauucuuuagaggagcuaggggacggacuugcgaugggcaucaugauguuaaaauuguugacugauuuucagucacaccaguuguggacuaccuuacugucucugacauucaucaaaacaacucuuucacuagauuaugcauggaagacaauggcuaugguauugucaaucguaucucucuuuccucuaugucuauccacgaccucucaaaaaacaacauggcuuccgguguuguuaggauccuuuggauguaaaccacuaaccauguuucuuauaacagaaaacaaaauuuggggaaggaaaaguuggccccucaaugaaggaauuauggcuguuggaauagucagcauuuuacuaaguucacuccucaaaaaugacgugccacuagccggcccacuaauagcuggaggcaugcugauagcauguuacgucauuuccggaagcucagccgauuuaucauuggagagagcggcugaggucuccugggaagaagaagcagaacacucuggugccucacacaacauacuaguggagguccaagaugauggaaccaugaaaauaaaagaugaagagagagaugacacgcucacuauacuccucaaagcaacuuuguuggcaguuucagggguguacccaaugucaauaccagcaacccuuuuugugugguauuuuuggcagaaaaagaaacagagaucaggagucuugugggacacacccagcccuccagaaguagaaagagcaguucuugaugaugguaucuauagaaucuugcaaagaggacuguuggguaggucccagguaggagugggaguuuuucaagacggcguguuccacacaauguggcaugucaccaggggggcuguccucauguaccaagggaagaggcuggaaccaaguugggccagugucaaaaaagacuugaucucauauggaggagguuggagguuucaaggaucauggaacacgggagaagaaguacaggugauagcuguugaaccagggaaaaacccaaagaauguacagacaacgccgggcaccuucaagaccccugaaggcgaaguuggagccauagcccuagacuucaaaccuggcacaucuggaucucccaucgugaacagagaggggaaaauaguaggucuuuauggaaauggaguggugacaacaaguggaaccuacgucagugccauugcccaagcuaaagcgucacaagaagggccucuaccagagauugaggacgagguguuuaagaaaagaaaccuaacaauaauggaccuacauccaggaucaggaaaaacaagaagauaucuuccagccauaguccgugaggccauaaaaaggaaacugcgcacgcuaaucuuggcucccacaagaguugucgccucugaaauggcagaggcgcuuaaaggaaugccaauaagauaucagacaacagcaguaaagagugaacacacaggaaaggagauagucgaucucaugugccacgccacuuucaccaugcgucuccuaucuccagugagaguucccaauuacaacaugauuaucauggaugaagcacacuuuaccgauccagccagcauagcggccagaggguacaucucaacccgaguggguaugggugaagcagcugcgaucuucaugacagccacucccccaggaucgguagaggccuuuccacagagcaaugcaguuauccaagaugaggaaagagacauuccugagagaucauggaacucaggcuacgacuggaucacugacuucccaggaaaaacagucugguuuguuccaagcaucaaaucaggaaaugacauugccaacugcuuaagaaaaaacgggaaacgggugauccaauugagcagaaaaaccuuugacacugaauaccagaaaacgaaaaacaaugauugggacuauguugucacaacagacauuuccgaaaugggagcaaauuuccgggccgauaggguaauagacccaaggcggugcuugaagccgguaauacuaaaagauggcccagagcgcgucauucuggccggaccaaugccagugaccgcggccagugcugcccagaggagaggaagaauuggaaggaaccaaaacaaggaaggugaccaguauauuuacaugggacagccuuuaaauaaugaugaggaccacgcucauuggacagaagcaaaaaugcuccuugacaauauaaauacgccagaagggauuaucccagcccucuuugagccagagagagaaaagagugcagcaauagacggggaguauagacugcggggagaagcaaggaaaacguucguggagcuaaugagaagaggggaucuaccaguuuggcuaucuuacaaaguugccucagaaggcuuccaguacuccgacagaagauggugcuuugacggggaaaggaacaaccagguguuggaggagaacauggacguggagaucuggacaaaagaaggagaaagaaagaaauugcgaccucgcugguuagaugccagaaccuacucugauccacuggcccugcgcgaguuuaaggaguucgcagcaggaagaagaagugucucaggugaccuaauauuagaaauagggaaacucccacagcauuugacgcuaagggcccagaaugcuuuggacaacuuggucauguugcacaauuccgaacaagggggaaaagccuauagacaugcuauggaagaacuaccagacaccauagaaacauugaugcuacuagccuugauagcugugcugacugguggaguuacguuguuuuuccuaucaggaaaaggucuagggaaaacauccauuggccuacuuuguguaauggccucaaguguacuguuauggauggccaguguggagccccauuggauagcggccuccaucauacuagaguuuuuucugauggugcugcuuauuccagagccagacagacagcguacuccacaggacaaucaacuagcauauguggugauagguuuguuauucaugauauugacaguggcagccaaugagaugggauuacuggaaaccacaaagaaagaccuggggauuggccauguagucgccgaaaaccaccaccaugccacaaugcuagacauagacuuacauccagcuucagccuggacccucuaugcaguagccacaacaauuaucacucccaugaugagacacacaauugaaaacacaacggcaaacauuucccugacagcuauugcaaaucaggcggcuauauuaaugggacuugacaagggauggccaauaucgaagauggacauaggagugccacuucucgccuuagggugcuauucccaggugaacccauugacacugacagcggcgguguuaauguuaguggcucauuaugccauaauuggaccuggacugcaagcaaaagcuaccagagaagcccaaaaaaggacugcggccggaauaaugaaaaauccaacuguagacgggauuguugcaauagauuuggauccugugguuuaugaugcaaaauuugaaaaacagcuaggccaaauaauguuacuaauacucugcacaucacagauucucuugaugcggacuacaugggccuuaugugaaucuaucacacuggcuacuggacccuugaccacucucugggagggaucuccuggaaaauucuggaauaccacgauagcaguguccauggcaaacaucuucaggggaaguuauuuagcaggggcaggucuggccuucucauuaaugaaaucuuuaggaggagguaggagagguacgggagcucaaggggaaacauugggagaaaaauggaaaagacaacuaaaccaacugagcaagucagaauuuaacacuuacaaaaggaguggaauuauggagguggacagauccgaagccaaggagggacugaaaagaggagaaacaaccaaacaugcagugucgagaggaacagccaaacuuaggugguuuguggagaggaaccuugugaaaccggaagggaaagugauagaccucgguuguggaagagguggcuggucauauuacugcgcugggcugaagaaggucacagaaguaaagggauacacaaaaggaggacccggucaugaggaaccuaucccaauggcgacuuauggauggaacauagugaagcuacacucuggaagggauguauucuuuacaccaccugagaaaugugacacccuuuugugugauauuggugaguccucuccgaauccaacuauagaagaaggaagaacguuacguguucuaaagaugguggaaccauggcucagaggaaaucaguuuugcauaaaaauccuaaauccuuauaugccaagugugguagaaacucuggagcaaaugcaaagaaaacauggagggaugcuagugcgaaacccacucucaagaaauuccacccaugaaauguacugggucucauguggaacaggaaacauugugucggcagugaacaugacauccagaaugcugcugaaucgguucacaauggcucacaggaagccaacguaugaaagagacguggacuugggcgcuggaacaagacauguggcaguggaaccagagauagccaaccuagacauuauuggccagaggauagagaacauaaaaaaugaacauaagucaacauggcauuaugaugaggacaauccauacaaaacaugggccuaucauggaucauaugaggucaagccaucagggucagccucauccauggugaauggcguggugagauugcucaccaagccaugggauguuauccccauggucacacaaauagcuaugacugauaccacacccuucggacaacagaggguuuucaaagagaaaguugacacacgcacaccaagaccaaaacgaggcacagcacaaauuauggaggugacagccaagugguuguggggauuccucucuagaaauaaaaaacccagaaucugcacaagagaggaguucacaagaaaaguuaggucaaacgcagcaauuggagcaguguuuguugaugaaaaccaauggaacucagcaaaagaagcaguggaagacgaaagguuuugggaccucgugcacagagagagggagcuucauaaacagggaaaaugugccacgugugucuacaauaugauggguaaaagagagaaaaaacuaggagaguuuggaaaggcaaaaggaagucgugcaauaugguacaugugguugggagcacgcuuucuagaauuugaagcccuuggcuucaugaaugaagaccacugguucaguagggagaauucacucaguggaguggaaggagaaggacuacauaaacuuggauacauacucagagacauaucaaagauuccagggggaaauauguaugcagacgacacagcuggaugggacacaagaauaacagaggaugaucuccagaaugaggcuaaaaucaccgacaucauggagccugaacaugcucuacuggcuacgucaaucuucaagcugaccuaucaaaauaaggugguaagggugcaaagaccagcaaaaaguggaaccgugauggacgucauauccagacgugaccagagaggaaguggacaggucggaacuuauggccuaaacacuuucaccaacauggagguccaacuaauaagacaaauggaaucugaaggaaucuuuucacccagcgaauuggaaaauucaaaucuagcugagagaguucucgacugguuggaaaaacauggcgucgaaagguugaaaagaauggcaaucagcggagaugacuguguggugaaaccaacugaugacagguucgcaacagcuuuaacagcccugaaugacaugggaaaggugagaaaagacauaccgcaaugggaaccuucaaaaggauggaaugacuggcagcaagugccuuucuguucacaccacuuccaccaacugauuaugaaggaugggagggagauaguggugccaugccgcaaccaagaugaacuugugggcagggccagaguaucacaaggcgccggguggagccugagagaaacugcuugccuaggcaagucauaugcacaaauguggcagcugauguacuuccacaggagagaccugagacuggcggcuaaugcuaucuguucagccguuccaguuaauugggucccaaccagccgcaccaccuggucgauccaugcccaccaucaauggaugacaacagaagacauguugucaguauggaauaggguuuggauagaggaaaacccauggauggaggacaaaacucauguauccagcugggaagauguuccauacuuaggaaaaagggaagaucaaugguguggaucucugauaggcuuaacagcaagagccaccugggccaccaacauacaaguggccauaaaccaagugagaaggcuuauugggaacgagaauuauuuagacuacaugacaucaaugaagagauucaagaaugagagugaucccgaaggagcccucugguaa

SEQ ID NO: 6179 - RNA, 9879 nt, Artificial Sequence
  derived and/or modified CDS sequence (wt) from DENV-1__JQ045628__SS-prME
ucugugaccaugcuccuuaugcugaugcccacagccuuggcguuccauuugacuacacgagggggagagccacacaugauagucagcaagcaggaaagaggaaaaucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagccuuuuuucuagcacaugccauaggaacauccaucacucagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccauccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguucacaccggagaccagcaccaggugggaaaugaaagcacagaacaugggacaacugcaacuauaacaccucaagcucccacgacggaaauacagcugacugacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagaucugcuggugacauuuaagacagcccaugcaaagaagcaggaaguagucguacuaggaucacaagaaggagcaaugcacacugcguugaccggagcaacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagauugauaacagcuaacccuauaguuacugacaaagaaaaaccagucaacauugaggcagaaccgccuuuuggugagaguuacaucguaauaggagcaggugaaaaagcuuugaaacuaagcugguuuaagaaaggaagcagcauagggaaaauguuugaggcaacugccagaggagcacgaaggauggccauacugggagacaccgcaugggacuuugguuccauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcaguuggccuaguaacacuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuuuaucaucgacggcccaaacaccccagaaugcccugaugaccaaagagcauggaacauuugggaaguugaggacuauggauuuggaauuuucacgacaaacauauggcugaaauugcgugauuccuauacccaagugugugaccaccggcuaaugucagcugccaucaaggacagcaaggcaguucacgcugacaugggguacuggauagaaagugaaaagaacgagaccuggaagcuggcaagagcuucuuucauagaaguuaaaacauguaucuggccaaaaucccacacucuauggagcaauggaguucuggaaagugaaaugauaauuccgaagaucuauggaggaccaauaucucagcacaacuacagaccaggauauuucacacaaacagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugauugaagaggugaugagauccagauggaguagaaaaaugcugaugacuggaacacuggcuguguuccuccuucucauaaugggacaauugacauggaaugaucugaucagauuaugcaucaugguuggagccaacgcuuccgacaggauggggaugggaacgacguaccuagcucugauggccacuuuuaaaaugagaccgauguuugcuguagggcuauuauuucgcagacuaacauccagagaaguucuccuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuaugcauggaagacaauggcuaugguacugucaauuguaucucucuuccccuuaugccuguccacgaccucccaaaaaacaacauggcuuccggugcuauugggaucccuuggaugcaaaccacuaaccauguuucucauagcagaaaacaaaaucuggggaaggagaaguuggccccucaaugaaggaaucauggcuguuggaauagucagcauccuacuaaguucacuucucaaaaaugaugugccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccagugucaaaaaagaccugauuucauauggaggagguuggaggcuucaaggauccuggaacacaggagaagaagugcaggugauugcuguugaaccagggaaaaaccccaaaaauguacaaacaacgccgggcacuuuuaagacccuugaaggugaaguuggagccauugcccuagauuuuaaacccggcacaucugguucucccaucgugaacagagaaggaaaaauagugggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcguacacugauucuggcccccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauagccaacugcuuaagaaagaaugggaaacgggugauucaauugagcagaaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccggagagagaaaagagugcagcaauagacggggaauacagacugcggggugaggcaaggaaaacguuuguggagcucaugagaagaggagaucuaccugucuggcuaucuuacaaaguugccucagaaggcuuccaguacucugacagaagauggugcuuugacggggaaaggaacaaccagguguuggaggagaacauggacguggagaucuggacgaaagagggagaaagaaagaaacuacgaccccgcuggcuggaugccagaacauacucagacccacuagcccugcgcgaguuuaaagaguuugcagcagggagaagaagcgucucaggugaucuaauauuggaaauagggaaacuuccacaacauuugacgcaaagggcccagaaugccuuggacaaccugguuauguugcacaacuccgaacaaggaggaagagccuacagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauagcuucaagcguacugcuauggauggccaguguggagccccauuggauagcggccuccaucauacuggaguuuuuccugauggugcugcuuauuccagagccagacagacaacgcacuccgcaggacaaucagcuggcauauguggugauagguuuguuauucaugauacugacaguagcagccaaugagaugggacugcuggaaaccacaaagaaagacuuggggauuggccauguggcuguuggaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucaaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugaugggauuguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagaucagaagccaaagagggauugaaaagaggagaaacaaccaaacaugcagugucgagaggaaccgcuaaacugagaugguuuguggagcggaaccuugugaaaccagaagggaaagucauagaccucgguuguggaagagguggcuggucauacuauugcgcugggcugaagaaaguuacagaagugaagggauacacaaaagggggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguacuggguuucauguggaacaggaaacauugugucagcaguaaacaugacaucuagaauguugcuaaaucgauucacaauggcucacaggaaaccaacauaugaaagagauguggaccuaggcgccggaacaagacauguggcaguggaaccagagguagcuaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaagccaugggaugucauccccauggucacacaaauagccaugacugacaccacacccuuuggacaacagaggguguuuaaagagaaaguugacacacgcacaccaaaagcaaaaagaggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugccacguguguuuauaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacugaggaugaccuucagaaugaggccagaauuacugacaucauggaacccgaacaugcccuacuggcuaagucaaucuucaagcugaccuaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugauugcguggugaaaccaauugaugauagguuugcaacagccuuaacagcucugaaugacaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacagauguggcagcugauguacuuccacaggagagaccugagacuagccgcuaaugcuaucuguucagccguuccaguugauuggaucccaaccagccgcaccaccuggucgauccaugcccaucaccaauggaugacaacagaagacaugcugucaguguggaauaggguuuggauagaagaaaacccauggauggaggacaaaacccauauauccaguuggggagauguuccauauuuagggaaaagggaagaucaaugguguggaucccugauaggcuuaacagcaagggccaccugggccaccaacauacaaguggccauaaaccaagugagaagacuaauugggaaugagaauuaccuagauuacaugacaucaaugaagagauucaagaacgagagugaucccgaaggggcacucugguga

SEQ ID NO: 6180 - RNA, 9879 nt, Artificial Sequence
  derived and/or modified CDS sequence (wt) from DENV-1__JQ045629__SS-prME
ucugugaccaugcuccuuaugcugaugccuacagccuuggcguuccauuugacuacacgagggggagagccgcacaugauggucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggaucauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagagguuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcucccacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaauuggcugagacccagcauggaaccguucuagugcagauuaaauacgaaggaacagaugcaccaugcaagaucccuuuuucgacccaagaugaaaaaggagugacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucgggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacauccuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccacuuucaucaucgauggcccaaacaccccagaaugcccugaugaccaaagagcauggaacauuugggaaguugaggacuauggauuuggaauuuucacgacaaacauauggcugaaauugcgcgauucccacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugaguuuaguggcaucuguggaguuaccaaauucccuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcugaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauaggucuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuacucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaauaccacgauagcgguuuccauggcaaacauuuucagaggaagcuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaaguugcacucugggaaagacguguucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaacuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaucaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6181 - RNA, 9879 nt, Artificial Sequence
  derived and/or modified CDS sequence (wt) from DENV-1__JQ045630__SS-prME
ucugugaccaugcuccuuaugcugaugcccacagccuuggcguuccauuugacuacacgagggggagagccacacaugauagucagcaagcaggaaagaggaaaaucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacucagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccauccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguucacaccggagaccagcaccaggugggaaaugaaagcacagaacaugggacaacugcaacuauaacaccucaagcuccuacgacggaaauacagcugacugacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagaucugcuggugacauuuaagacagcccaugcaaagaagcaggaaguagucguacuaggaucacaagaaggagcaaugcacacugcguugaccggagcaacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagauugauaacagcuaacccuauaguuacugacaaagaaaaaccagucaacauugaggcagaaccgccuuuuggugagaguuacaucguaauaggagcaggugaaaaagcuuugaaacuaagcugguuuaagaaaggaagcagcauagggaaaauguuugaggcaacugccagaggagcacgaaggauggccauacugggagacaccgcaugggacuuugguuccauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcaguuggccuaguaacacuauaccuaggagucaugguucaggcggauucaggauguguaaucaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuuuaucaucgacggcccaaacaccccagaaugcccugaugaccaaagagcauggaacauuugggaaguugaggacuauggauuuggaauuuucacgacaaacauauggcugaaauugcgugauuccuauacccaagugugugaccaccggcuaaugucagcugccaucaaggacagcaaggcaguucacgcugacaugggguacuggauagaaagugaaaagaacgagaccuggaagcuggcaagagcuucuuucauagaaguuaaaacauguaucuggccaaaaucccacacucuauggagcaauggaguucuggaaagugaaaugauaauuccgaagaucuauggaggaccaauaucucagcacaacuacagaccaggauauuucacacaaacagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugauugaagaggugaugagauccagauggaguagaaaaaugcugaugacuggaacacuggcuguguuccuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuaugcauggaagacaauggcuaugguacugucaauuguaucucucuuccccuuaugccuguccacgaccucccaaaaaacaacauggcuuccggugcuauuaggaucccuuggaugcaaaccacuaaccauguuucucauagcagaaaacaaaaucuggggaaggagaaguuggccccucaaugaaggaaucauggcuguuggaauagucagcauccuacuaaguucacuucucaaaaaugaugugccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccagugucaaaaaagaccugauuucauauggaggagguuggaggcuucaaggauccuggaacacaggagaagaagugcaggugauugcuguugaaccagggaaaaaccccaaaaauguacaaacaacgccgggcacuuuuaagaccccugaaggugaaguuggagccauugcccuagauuuuaaacccggcacaucuggaucucccaucgugaacagagaaggaaaaauagugggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcguacacuaauucuggcccccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauagccaacugcuuaagaaagaaugggaaacgggugauucaauugagcagaaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccggagagagaaaagagugcagcaauagacggggaauacagacugcggggugaggcaaggaaaacguuuguggagcucaugagaagaggagaucuaccugucuggcuaucuuacaaaguugccucagaaggcuuccaguacucugacagaagauggugcuuugacggggaaaggaacaaccagguguuggaggagaacauggacguggagaucuggacgaaagagggagaaagaaagaaacuacgaccccgcuggcuggaugccagaacauacucagacccacuagcccugcgcgaguuuaaagaguuugcagcagggagaagaagcgucucaggugaucuaauauuggaaauagggaaacuuccacaacauuugacgcaaagggcccagaaugccuuggacaaccugguuauguugcacaacuccgaacaaggaggaagagccuacagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauagcuucaagcguacugcuauggauggccaguguggagccccauuggauagcggccuccaucauacuggaguuuuuccugauggugcugcuuauuccagagccagacagacaacgcacuccgcaggacaaucagcuggcauauguggugauagguuuguuauucaugauacugacaguagcagccaaugagaugggacugcuggaaaccacaaagaaagacuuggggauuggccauguggcuguuggaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucaaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugaugggauuguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuacaaaaggagugggauuauggaaguggacagaucagaagccaaagagggauugaaaagaggagaaacaaccaaacaugcagugucgagaggaaccgcuaaacugagaugguuuguggagcggaaccuugugaaaccagaagggaaagucauugaccucgguuguggaagagguggcuggucauacuauugcgcugggcugaagaaaguuacagaagugaagggauacacaaaagggggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguacuggguuucauguggaacaggaaacauugugucagcaguaaacaugacaucuagaauguugcuaaaucgauucacaauggcucacaggaaaccaacauaugaaagagauguggaccuaggcgccggaacaagacauguggcaguggaaccagagguagcuaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaagccaugggaugucauccccauggucacacaaauagccaugacugacacuacacccuuuggacaacagaggguguuuaaagagaaaguugacacacgcacaccaaaagcaaaaagaggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugccacguguguuuauaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacugaggaugaccuucagaaugaggccagaauuacugacaucauggaacccgaacaugcccuacuggcuaagucaaucuucaagcugaccuaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugauugcguggugaaaccaauugaugauagauuugcaacagccuuaacagcucugaaugacaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacagauguggcagcugauguacuuccacaggagagaccugagacuagccgcuaaugcuaucuguucagccguuccaguugauuggaucccaaccagccgcaccaccuggucgauccaugcccaucaccaauggaugacaacagaagacaugcugucaguguggaauaggguuuggauagaagaaaacccauggauggaggacaaaacccauauauccaguuggggagauguuccauauuuagggaaaagggaagaucaaugguguggaucccugauaggcuuaacagcaagggccaccugggccaccaacauacaaguggccauaaaccaagugagaagacuaauugggaaugagaauuaccuagauuacaugacaucaaugaagagauucaagaacgagagugaucccgaaggggcacucugguga

SEQ ID NO: 6182 - RNA, 9879 nt, Artificial Sequence
  derived and/or modified CDS sequence (wt) from DENV-1__JQ045632__SS-prME
ucuguaaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggaucauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacauuuguggacagagguuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcucccacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaucuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaauuggcugagacccagcauggaaccguucuagugcagauuaaauacgaaggaacagaugcaccaugcaagaucccuuuuuugacccaagaugaaaaaggagugacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuauuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucgggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacauccuacuugaaaaugauaugaaauucacagugguuguaggagauguugcugggaucuuggcucaaggaaagaaaaugauuaggccacaacccauggaacacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgcgauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaggaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauucccuggaggagcugggggauggacuugcaaugggcaucaugauuuuaaaauuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagagaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaucccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaaaaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacauuuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagagcccagaaugccuuggacaaccugguuauguugcacaacuccgaacaaggaggaagagccuauagacaugcaauggaagaacugccagacaccauagaaacguugauccuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauaggucuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaagugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaagcuauuuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaguucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucauccccauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacaaauggagucugagggaaucuuuucacccagcgaauuagagaccccaaacuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccgcaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6183 - RNA, 9879 nt, Artificial Sequence
  derived and/or modified CDS sequence (wt) from DENV-1__JQ045633__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcuggccgacuacggagcucuuacauuggauuguucaccuagaacaggacuagacuucaaugaaaugguguuguugacaaugaaagaaaaaucauggcuaguccacaaacaaugguuuuuagacuuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucuggaacgacaacaaucuuugcaggacacuugaaaugcagacuaaagauggacaaacugacucuaaaagggaugucauaugugaugugcacaggcucauucaagcuagagaaagaauuggcugagacccagcauggaaccguucuagugcagauuaaauacgaaggaacagaugcaccaugcaagaucccuuuuucgacccaagaugaaaagggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggagcugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuucgucaccaaugaaguucacacuuggacagagcaauacaaauuucaagcugacuccccaaagagacuaucagcagccaucgggaaggcaugggaggaggguguguguggaauccgaucagcaacucgucucgagaacaucauguggaagcaaauaucaaaugaacugaaucacauccuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggccaaaacaccccagaaugcccugaugaccaaagagcauggaacauuugggaaguugaggacuauggauuuggaauuuucacgacaaacauauggcugaaauugcgugauuccuauacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacaggccaggauauuuuacacaaacagcagggccguggcaccuaggcaaguuggaacuggauuuugauuugugugaggguaccacagucguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguuccuccuucucauaaugggacaauugacauggaacgaucugaucagauuaugcaucaugguuggggccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccuaaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaacuauucuccuuaaagcaacucuguuagcaguuucagggguguacccacuaucaauaccagcaacucuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagauuggaaccgagcugggccaguguuaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaaguaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccuuuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuuccuugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucuaaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaauaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuguaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaaugcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaaucacugacaucauggaacccgaacaugcccuacuggcuaagucaaucuucaaguuaaccuaucaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagacauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaaaucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccagugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6184 - RNA, 9879 nt, Artificial Sequence
  derived and/or modified CDS sequence (wt) from DENV-1__JQ045634__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcuggccgacuacggagcucuuacauuggauuguucaccuagaacaggacuagacuucaaugaaaugguguuguugacaaugaaagaaaaaucauggcuaguccacaaacaaugguuuuuagacuuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucuggaacgacaacaaucuuugcaggacacuugaaaugcagacuaaagauggacaaacugacucuaaaagggaugucauaugugaugugcacaggcucauucaagcuagagaaagaauuggcugagacccagcauggaaccguucuagugcagauuaaauacgaaggaacagaugcaccaugcaagaucccuuuuucgacccaagaugaaaagggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggagcugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuucgucaccaaugaaguucacacuuggacagagcaauacaaauuucaagcugacuccccaaagagacuaucagcagccaucgggaaggcaugggaggaggguguguguggaauccgaucagcaacucgucucgagaacaucauguggaagcaaauaucaaaugaacugaaucacauccuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggccaaaacaccccagaaugcccugaugaccaaagagcauggaacauuugggaaguugaggacuauggauuuggaauuuucacgacaaacauauggcugaaauugcgugauuccuauacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacaggccaggauauuuuacacaaacagcagggccguggcaccuaggcaaguuggaacuggauuuugauuugugugaggguaccacagucguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguuccuccuucucauaaugggacaauugacauggaacgaucugaucagauuaugcaucaugguuggggccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccuaaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaacuauucuccuuaaagcaacucuguuagcaguuucagggguguacccacuaucaauaccagcaacucuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagauuggaaccgagcugggccaguguuaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaaguaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccuuuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuuccuugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucuaaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaauaugcagugucgagaggaaccgcuaaacugaggugguuuguggagaggaaccuugugaaaccagaagggaaagucauagaccucgguuguggaagagguggcugggcauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuguaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucauaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaaugcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggggaaggacuccacaaacuuggauauauacucagagacauaucaaagauuccagggggaaacauguaugcagaugacacagccggaugggauacaaggauaacagaggaugaccuucagaaugaggccagaaucacugacaucauggaacccgaacaugcccuacuggcuaagucaaucuucaaguuaaccuaucaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagacauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaaaucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccagugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6185 - RNA, 9879 nt, Artificial Sequence
  derived and/or modified CDS sequence (wt) from DENV-1__JQ045636__SS-prME
ucugugaccaugcuccuuaugcugaugccuacagcccuggcguuccauuugacuacacgagggggagagccgcacaugauagucagcaagcaggaaagaggaaagucacuuuuguuuaagaccucagcaggugucaacaugugcacccucauagcgauggaucugggagaguuuugugaggacacaaugacuuacaagugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaagugugugacuaaacuggaaggaaagauaguucaauaugaaaacuugaaauauucaguaauagucaccguccacacaggagaccagcaccaggugggaaaugaaagcacagaacaugggacaauugcaacuauaacaccucaagcuccuucgacggaaauacaacugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggagcgacccagaaugggagacuaauaacagcuaaccccauagucacugacaaagaaaaaccagucaacauugaagcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcggcguuuccuggaccaugaaaauaggaauaggaguucugcugacauggcuaggauuaaacucaaggagcacgucccuuucgaugacgugcauugcaguuggccuaguaacuuuauaccuaggagucaugguucaggcggauucaggauguguaauuaauuggaaagguagagaacucaaauguggaaguggcauuuuugucacuaaugaaguucacacuuggacagagcaauacaaauuucaagcugacuccccaaagagauuaucagcagccaucgggaaggcaugggaggaagguguguguggaauacgaucagcaacucgucucgagaacaucauguggaagcaaauaucaaaugaacugaaccacaucuuacuugaaaaugacaugaaacucacagugguuguaggagauguugcuggaaucuuggcucaagggaagaaaaugauuaggccacaacccauggaguacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacagcagggccguggcacuuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacgcuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccgacgcuuccgacaggauggggaugggaacgacguaccuagcucugauggccacuuuuaaaaugagaccaauguuugcuguaggacuauuauuccgcagacuaacauccagagaaguucuucuucuaacaauuggauugagucuaguggcaucuguggaguuaccaaauuccuuggaggagcugggggauggacuugcaaugggcauuaugauuuugaaauuguugacugauuuucaaucacaucaguugugggcuaccuugcuguccuugacauuuaucagaacaacguuuuccuugcacuaugcauggaagacaauggccaugguacugucaauuguaucucucuuccccuuaugccuguccacgaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcuguggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcaacccuuuuugugugguacuuuuggcagaaaaagaaacagagaucuggaguguuaugggacacaccuagcccuccagaaguggaaagagcaguucuagaugaugguaucuauagaauuaugcagagaggacuguugggcaggucccaaguagggguaggaguuuuccaagaaaacguguuccacacaauguggcaugucaccaggggagcuguucucauguaucaagggaagagacuggaaccgagcugggccagugucaaaaaagaccugaucucauauggaggagguuggaggcuucaaggauccuggaacacgggagaagaagugcaggugauugcuguugaaccaggaaaaaacccaaaaaauguacaaacagcgccgggcaccuucaagaccucugaaggugaaguuggagccauugcccuagauuuuaaacccgguacaucuggaucucccaucgugaacagagaaggaaaaauaguaggccuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcugaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguauaucucaacccgagugggcaugggugaggcagcugcgaucuucaugacagccacuccuccaggaucaguggaggccuuuccacagagcaacgcaguuauccaagaugaggaaagagacauuccugagagaucauggaacucaggcuaugaguggaucacugacuucccagguaaaacaguuugguuuguuccaagcaucaaaucaggaaacgacauugccaacugcuuaagaaagaaugggaaacgggugauucaguugagcaggaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaccaguacaucuacaugggacagccuuuaaacaacgaugaagaucaugcucacuggacagaagcaaaaaugcuccuugauaauauaaacacaccagaagggauuaucccagcccucuucgacccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagagcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagaaccagacagacaacgcacuccgcaggacaaccagcuggcauauguggugauagguuuguuauucaugauacugacaguagcagccaaugagaugggacugcuggaaaccacaaagaaagacuuagggaucggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcuaaagcuacuagagaagcucaaaaaaggacagcggccggaauaaugaaaaauccaaccguugauggaauuguugcaauagauuuggauccugugguuuacgaugcaaaauuugagaaacaacuaggccaaauaauguuguugauacuaugcacaucacagauccucuugaugcggacuacaugggccuugugcgaauccaucacacuagcuacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugaguaagucagaauucaacacuuauaaaaggagugggaucauggaaguggacagauccgaagccaaagagggacugaaaagaggagaaacaaccaaacaugcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacaaaaggaggaccuggacaugaggagccaauuccaauggcgaccuauggauggaaccuaguaaaacugcacuccgggaaagacguauucuucauaccacccgagaaaugugacacccuuuugugugauauuggugagucuucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacauacgaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaccauggaucauaugaggucaagccgucaggaucagccucauccauggucaauggcguggugaaacuacucaccaaaccaugggaugucaucccuauggucacacaaauagccaugacugacacuacacccuuuggacaacagaggguguucaaagagaaaguugacacacgcacaccaaaagcaaaacgaggcacagcacaaaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggacacaaggauaacagaggaugaccuucagaacgaggccaaaauuacugacaucauggaacccgaacaugcccuacuggcuaagucaaucuucaagcuaacauaccaaaauaaagugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugaaggaaucuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugacaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauacuuaggaaaaagggaagaucaaugguguggaucccugauaggcuuaacagcaagggccaccugggccaccaacauacaaguggccauaaaccaagugagaagacuucuugggaaugagaauuaucuagauuacaugacaucaaugaagagauucaagaaugagagugauccugaaggggcacucugguga

SEQ ID NO: 6186 - RNA, 9879 nt, Artificial Sequence
  derived and/or modified CDS sequence (wt) from DENV-1__JQ045635__SS-prME
ucugugaccaugcuccuuaugcugaugccuacagcccuggcguuccauuugacuacacgagggggagagccgcacaugauagucagcaagcaggaaagaggaaagucacuuuuguuuaagaccucagcaggugucaacaugugcacccucauagcgauggaucugggagaguuuugugaggacacaaugacuuacaagugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaagugugugacuaaacuggaaggaaagauaguucaauaugaaaacuugaaauauucaguaauagucaccguccacacaggagaccagcaccaggugggaaaugaaagcacagaacaugggacaauugcaacuauaacaccucaagcuccuucgacggaaauacaacugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggagcgacccagaaugggagacuaauaacagcuaaccccauagucacugacaaagaaaaaccagucaacauugaagcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcggcguuuccuggaccaugaaaauaggaauaggaguucugcugacauggcuaggauuaaacucaaggagcacgucccuuucgaugacgugcauugcaguuggccuaguaacuuuauaccuaggagucaugguucaggcggauucaggauguguaauuaauuggaaagguagagaacucaaauguggaaguggcauuuuugucacuaaugaaguucacacuuggacagagcaauacaaauuucaagcugacuccccaaagagauuaucagcagccaucgggaaggcaugggaggaagguguguguggaauacgaucagcaacucgucucgagaacaucauguggaagcaaauaucaaaugaacugaaccacaucuuacuugaaaaugacaugaaacucacagugguuguaggagauguugcuggaaucuuggcucaagggaagaaaaugauuaggccacaacccauggaguacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacagcagggccguggcacuuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacgcuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccgacgcuuccgacaggauggggaugggaacgacguaccuagcucugauggccacuuuuaaaaugagaccaauguuugcuguaggacuauuauuccgcagacuaacauccagagaaguucuucuucuaacaauuggauugagucuaguggcaucuguggaguuaccaaauuccuuggaggagcugggggauggacuugcaaugggcauuaugauuuugaaauuguugacugauuuucaaucacaucaguugugggcuaccuugcuguccuugacauuuaucagaacaacguuuuccuugcacuaugcauggaagacaauggccaugguacugucaauuguaucucucuuccccuuaugccuguccacgaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcuguggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcaacccuuuuugugugguacuuuuggcagaaaaagaaacagagaucuggaguguuaugggacacaccuagcccuccagaaguggaaagagcaguucuagaugaugguaucuauagaauuaugcagagaggacuguugggcaggucccaaguagggguaggaguuuuccaagaaaacguguuccacacaauguggcaugucaccaggggagcuguucucauguaucaagggaagagacuggaaccgagcugggccagugucaaaaaagaccugaucucauauggaggagguuggaggcuucaaggauccuggaacacgggagaagaagugcaggugauugcuguugaaccaggaaaaaacccaaaaaauguacaaacagcgccgggcaccuucaagaccucugaaggugaaguuggagccauugcccuagauuuuaaacccgguacaucuggaucucccaucgugaacagagaaggaaaaauaguaggccuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcugaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguauaucucaacccgagugggcaugggugaggcagcugcgaucuucaugacagccacuccuccaggaucaguggaggccuuuccacagagcaacgcagucauccaagaugaggaaagagacauuccugagagaucauggaacucaggcuaugaguggaucacugacuucccagguaaaacaguuugguuuguuccaagcaucaaaucaggaaacgacauugccaacugcuuaagaaagaaugggaaacgggugauucaguugagcaggaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaccaguacaucuacaugggacagccuuuaaacaacgaugaagaucaugcucacuggacagaagcaaaaaugcuccuugauaauauaaacacaccagaagggauuaucccagcccucuucgacccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagagcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagaaccagacagacaacgcacuccgcaggacaaccagcuggcauauguggugauagguuuguuauucaugauacugacaguagcagccaaugagaugggacugcuggaaaccacaaagaaagacuuagggaucggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcuaaagcuacuagagaagcucaaaaaaggacagcggccggaauaaugaaaaauccaaccguugauggaauuguugcaauagauuuggauccugugguuuacgaugcaaaauuugagaaacaacuaggccaaauaauguuguugauacuaugcacaucacaaauccucuugaugcggacuacaugggccuugugcgaauccaucacacuagcuacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugaguaagucagaauucaacacuuauaaaaggagugggaucauggaaguggacagauccgaagccaaagagggacugaaaagaggagaaacaaccaaacaugcagugucgagaggaacagcuaaacugaggugguuuguggagaggaaucuugugaaaccagaagggaaagucauagaccucgguuguggaagagguggcugggcauacuauugcgccgggcugaagaaagucacagaagugaagggauauacaaaaggaggaccuggacaugaggagccaauuccaauggcgaccuauggauggaaccuaguaaaacugcacuccgggaaagacguauucuucauaccacccgagaaaugugacacccuuuugugugauauuggugagucuucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacauacgaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaccauggaucauaugaggucaagccgucaggaucagccucauccauggucaauggcguggugaaacuacucaccaaaccaugggaugucaucccuauggucacacaaauagccaugacugacacuacacccuuuggacaacagaggguguucaaagagaaaguugacacacgcacaccaaaagcaaaacgaggcacagcacaaaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggacacaaggauaacagaggaugaccuucagaacgaggccaaaauuacugacaucauggaacccgaacaugcccuacuggcuaagucaaucuucaagcuaacauaccaaaauaaagugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugaaggaaucuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugacaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauacuuaggaaaaagggaagaucaaugguguggaucccugauaggcuuaacagcaagggccaccugggccaccaacauacaaguggccauaaaccaagugagaagacuucuugggaaugagaauuaucuagauuacaugacaucaaugaagagauucaagaaugagagugauccugaaggggcacucugguga

SEQ ID NO: 6187 - RNA, 9879 nt, Artificial Sequence
  derived and/or modified CDS sequence (wt) from DENV-1__JQ045637__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaaugguugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucacccagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaaugucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggacuaaacucaaggagcacgucccuuucgaugacguguauugcaguuggccuaguaacacuauaccuaggagucaugguucaggcggauucaggauguguaauaaauuggaaagguagagaacucaaauguggaaguggcauuuuuguuaccaaugaaguucacacuuggacagagcaauacaaauuucaagcugacuccccaaagagacuaucagcagccaucgggaaggcaugggaggaagguguguguggaauucgaucagcaacucgucucgagaacaucauguggaagcaaauaucaaaugaacugaaucacaucuuacuugaaaaugauaugaaauucacggugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaagucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagccuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccgcuuuuaaaaugagaccaauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaacuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauugggaucucuuggaugcaaaccacuaaccauguuucuuauagcagaaaacaaaaucuggggaaggagaaguuggccucucaaugaaggaaucauggcuguuggaauagucagcauccuacuaaguucacuccucaaaaaugauguaccgcuagcugggccacuaauagcaggaggcaugcuaauagcauguuauguuauaucuggaagcucggccgaccuaucauuagagaaagcggccgaggucuccugggaagaagaagcagaacacucuggcgccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacaccuagcccuccagaaguggaaagagcaguucuugaugaugguaucuauagaauuaugcaaagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugauuucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccaggcaaaacaguuugguuuguuccaagcauuaaaucaggaaaugacauugccaacugcuuaagaaagaaugggaaacgggugauccaauugagcaggaaaaccuuugauacagaguaccaaaaaacaaaaaacaacgacugggacuacgucgucacaacagacaucucagaaaugggagcaaauuuccgagccgacagggugauagacccaagacgguguuugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcccacuggacagaagcaaaaaugcuccuugauaauauaaacacaccagaagggauuaucccagcccucuucgagccagagagagaaaagagugcagcaauagacggugaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauagaagaacugccagacaccauagaaacguugaugcuccuagcuuugauagcuguguuaacugguggagugacacuguucuuccuaucaggaaggggcuuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguggaaaaucaccaccaugccgcaaugcuggacguagaccuacauccagcuucagccuggacccucuaugcaguggccacaacaauuaucacucccaugaugaggcacacaaucgaaaacacaacggcaaacauuucccugacagccauugcaaaccaggcagccauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuuuagaggaaguuaucuagcaggagcaggucuggccuucucauuaaugaaaucucuaggaggagguaggagaggcacgggagcucaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaaguugcacucugggaaagacguauucuuuauaccaccugagaaaugugacacccuuuugugugauauuggugaguccucuccaaacccaacuauagaggaaggaagaacgcuacguguccuaaagaugguggaaccauggcucagaggaaaccaauuuugcauaaaaaucuugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuuggauucaugaacgaagaucacugguucagcagagagaauucacucagcggaguggaaggagagggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaggucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggccagaguaucacaaggugcaggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6188 - RNA, 9879 nt, Artificial Sequence
  derived and/or modified CDS sequence (wt) from DENV-1__JQ045638__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaaugguugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucacccagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaaugucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggacuaaacucaaggagcacgucccuuucgaugacguguauugcaguuggccuaguaacacuauaccuaggagucaugguucaggcggauucaggauguguaauaaauuggaaagguagagaacucaaauguggaaguggcauuuuuguuaccaaugaaguucacacuuggacagagcaauacaaauuucaagcugacuccccaaagagacuaucagcagccaucgggaaggcaugggaggaagguguguguggaauucgaucagcaacucgucucgagaacaucauguggaagcaaauaucaaaugaacugaaucacaucuuacuugaaaaugauaugaaauucacggugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaagucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagccuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccgcuuuuaaaaugagaccaauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaacuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauugggaucucuuggaugcaaaccacuaaccauguuucuuauagcagaaaacaaaaucuggggaaggagaaguuggccucucaaugaaggaaucauggcuguuggaauagucagcauccuacuaaguucacuccucaaaaaugauguaccgcuagcugggccacuaauagcaggaggcaugcuaauagcauguuauguuauaucuggaagcucggccgaccuaucauuagagaaagcggccgaggucuccugggaagaagaagcagaacacucuggcgccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacaccuagcccuccagaaguggaaagagcaguucuugaugaugguaucuauagaauuaugcaaagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugauuucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccaggcaaaacaguuugguuuguuccaagcauuaaaucaggaaaugacauugccaacugcuuaagaaagaaugggaaacgggugauccaauugagcaggaaaaccuuugauacagaguaccaaaaaacaaaaaacaacgacugggacuacgucgucacaacagacaucucagaaaugggagcaaauuuccgagccgacagggugauagacccaagacgguguuugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcccacuggacagaagcaaaaaugcuccuugauaauauaaacacaccagaagggauuaucccagcccucuucgagccagagagagaaaagagugcagcaauagacggugaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauagaagaacugccagacaccauagaaacguugaugcuccuagcuuugauagcuguguuaacugguggagugacacuguucuuccuaucaggaaggggcuuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguggaaaaucaccaccaugccgcaaugcuggacguagaccuacauccagcuucagccuggacccucuaugcaguggccacaacaauuaucacucccaugaugaggcacacaaucgaaaacacaacggcaaacauuucccugacagccauugcaaaccaggcagccauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuuuagaggaaguuaucuagcaggagcaggucuggccuucucauuaaugaaaucucuaggaggagguaggagaggcacgggagcucaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucgguuguggaagagguggcugggcauacuauugcgcugggcugaagaaagucacagaagugaagggauauacaaaaggaggaccuggacaugaggaaccaaucccaauggcgaccuauggauggaaccuaguaaaguugcacucugggaaagacguauucuuuauaccaccugagaaaugugacacccuuuugugugauauuggugaguccucuccaaacccaacuauagaggaaggaagaacgcuacguguccuaaagaugguggaaccauggcucagaggaaaccaauuuugcauaaaaaucuugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuuggauucaugaacgaagaucacugguucagcagagagaauucacucagcggaguggaaggagagggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaggucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggccagaguaucacaaggugcaggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6189 - RNA, 9879 nt, Artificial Sequence
  derived and/or modified CDS sequence (wt) from DENV-1__JQ045639__SS-prME
ucugugaccauguuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaaaugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugacugacuacggagcucuaacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaauuggcugagacccagcauggaaccguuuuagugcagauuaaauacgaaggaacagaugcaccaugcaagaucccuuuuucgacccaagaugaaaaaggagugacccagaaugggagauugauaacagcuaaccccauaguuacugacaaagaaaaaccaguuaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaacuaguacaccagaucuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacauccuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaagucaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugacuugugugaggguaccacaguuguuguggaugaacauuguggaaaucgaggaccaucucuuaggaccacaacagucacaggaaagauaauucaugaaugguguugcagaucuugcacguuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagcugaccuaucauuagagaaagcggcugaggucuccugggaagaagaagcagaacacucuggugccucacacaauauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucguguggcacuuuuggcagaaaaagaaacagagaucuggaguguuaugggacacacccagcccuccagaaguggaaagagcaguucuugaugaugguaucuacagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccagagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccaccuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcgcacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccaugcggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaaucguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaagcuaucuagcaggagcaggucuggccuucucauuaaugaaaucucuaggaggagguaggagaggcacgggagcccaaggggaaacacugggagaaaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaaaggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugagagagacguggaccuaggcgccggaacaagacauguggcaguggaaccagagguggccaaccuagauaucauuggccagaggauagagaacauaaaacaugaacauaagucaacauggcacuaugaugaggacaauccauauaaaacaugggccuaccauggaucguaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacggcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaagaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggggaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaacuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguugggaagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucuaugaagagauucaagaacgagagugaucccgaaggggcacucugguga

SEQ ID NO: 6190 - RNA, 9879 nt, Artificial Sequence
  derived and/or modified CDS sequence (wt) from DENV-1__JQ045641__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagagguuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcucccacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaauuggcugagacccagcauggaaccguucuagugcagauuaaauacgaaggaacagaugcaccaugcaagaucccuuuuucgacccaagaugaaaaaggaguggcccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacaucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacauccuacuugaaaaugauaugaaauucacagugguuguaggagauguugcugggaucuuggcucaaggaaagaaaaugauuaggccacaaccuauggaauacaaauacucguggaaaagcuggggaaaggcuaaaaucauaggggcagauguacagaacaccaccuucaucauagauggcccaaacaccccagaaugcccugaugaccaaagagcauggaacauuugggaaguugaggacuauggauuuggaauuuucacgacaaacauauggcugaaauugcgcgauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccaauguuugcuguagggcuauuauuucgcagacuaacauccagagaaguucuucuucuaacaauuggauugagucuaguggcaucuguggaguuaccaaauucccuggaggagcugggggauggacuugcaaugggcauuaugauucuaaaauuauuaacugauuuucaaucacaucagcugugggccaccuugcuguccuugacauuuaucaaaacaacgcuuuccuugcacuaugcauggaagacaauggcuaugguacugucaauuguaucucucuucccuuuaugccuguccacgaccucccaaaaaacaacauggcuuccgguguuauugggaucccuuggauguaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacaccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccauaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaagaaacaaccaggugcuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcauaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauaggucuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaagggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaagcuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugacauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaaucacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaacuuagccgagagaguucucgacuggcuggaaaaauauggcgucgaaagguugaaaagaauggcaaucagcggagaugacugcguggugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaaccgcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6191 - RNA, 9879 nt, Artificial Sequence
  derived and/or modified CDS sequence (wt) from DENV-1__JQ045642__SS-prME
ucugugaccaugcuccuuaugcugaugccuacagccuuggcguuccacuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaaugugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacagggcuagacuuuaaugaaaugguguuguugacaaugaaagaaaaaucauggcuaguucacaaacaaugguuuuuagaccuaccacugccuuggaccucgggagcuucaacaucacaagagacuuggaacagacaagauuuguuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguacuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggcuauacugggagacacugcaugggacuuugguucuauaggaggaguguucacgucuguuggaaaauuaguacaccagauuuuuggaacugcauauggaguuuuguucagcgguguuuccuggaccaugaaaauaggaauagggguuuugcugacauggcugggacuaaacucaaggagcacgucucuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauuagaucagcaacucgccucgagaacaucauguggaagcaaauaucaaaugaacugaaucacauuuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagacgggugcugguacggcauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaaugcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguauuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaagugggaagagcaguucuugaugaugguaucuauagaauuaugcagagaggacuguugggcaggucccaaguagggguaggaguuuuccaggaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcucuagacuuuaaaccuggcacaucuggaucucccaucgugaacagagaaggaaaaauaguaggucucuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcaguaaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaauuuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuugucccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaacauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcucccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcgugcugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaagaggagugggauuauggaaguggacagaucagaagccaaagagggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagacaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucauccccauggucacacaaauagccaugacugacacuacacccuuuggacagcagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaaacuaggagaguucggaaaggcaaaaggaagucgugcaauaugguacaugugguugggagcacgcuuucuagaguucgaggcucuugguuucaugaacgaagaucacugguucagcagagagaauucacucagcggaguggaaggagaaggacuccacaaacuuggauauauacucagagacauaucaaagauuccagggggaaacauguaugcagaugacacagccggcugggauacaaggauaacagaggaugaccuucagaaugaggccagaauuaccgacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucaccuagcgaauuagagaccccaaauuuggccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauacuuaggaaaaagggaagaccaaugguguggaucccugauaggcuuaacagcaagggccaccugggccaccaauauacaaguggccauaaaccaagugagaagacuaauugggaaugagaauuaucuagauuacaugacaucaaugaagagauucaagaacgagagugaucccgaaggggcacucugguga

SEQ ID NO: 6192 - RNA, 9879 nt, Artificial Sequence
  derived and/or modified CDS sequence (wt) from DENV-1__JQ045644__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuuuauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugccgacgaacguuuguggacagaggcuggggcaaugguugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucacccagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaauaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccgcuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaacuauugacugauuuucaaucacaucagcugugggccaccuugcuguccuuaacauuuaucaaaacaacguuuuccuugcacuacgcauggaagacaauggcuaugguacugucaauuguaucucucuucccuuuaugccuguccacgaccucccaaaaaacaacauggcuuccgguguuauugggaucucuuggaugcaaaccacuaaccauguuucuuauagcagaaaacaaaaucuggggaaggagaaguuggccucucaaugaaggaaucauggcuguuggaauagucagcauccuacuaaguucacuccuuaaaaaugauguaccgcuagcugggccacuaauagcuggaggcaugcuaauagcauguuauguuauaucuggaagcucagccgaccuaucauuagagaaagcggccgaggucuccugggaagaagaagcagaacacucuggcgccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacaccuagcccuccagaaguggaaagagcaguucuugaugaugguaucuauagaauuaugcaaagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccaggcaaaacaguuugguuuguuccaagcauuaaaucaggaaaugacauugccaacugcuuaagaaagaaugggaaacgggugauccaauugagcaggaaaaccuuugauacagaguaccaaaaaacaaaaaacaacgacugggacuacgucgucacaacagacaucucagaaaugggagcaaauuuccgagcugacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcccacuggacagaagcaaaaaugcuccuugauaauauaaacacaccagaagggauuaucccagcccucuucgagccagagagagaaaagagugcagcaauagacggugaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggcuuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagccauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagcgggauuauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcuaaagaaagucacagaagugaagggauauacaaaaggaggaccuggacaugaggaaccaaucccaauggcgaccuauggauggaaccuaguaaaguugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaaucuugaaucccuacaugccaagugugguggaaacccuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuuggauucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaggucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggaaucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcucauuaugaaggaugggagggaaauaguggugccaugccgcaaccaagaugaacuuguggguagggccagaguaucacaaggugcaggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgaaagugaucccgaaggggcacucugguga

SEQ ID NO: 6193 - RNA, 9879 nt, Artificial Sequence
  derived and/or modified CDS sequence (wt) from DENV-1__JQ045648__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagagguuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcucccacgacggaaauacagcugaccgacuacggagcucuuacauuggauuguucacccagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaauuggcugagacccagcauggaaccguucuagugcagaucaaauacgaaggaacagaugcaccaugcaagaucccuuuuucgacccaagaugaaaaaggaguggcccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacaucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacauccuacuugaaaaugauaugaaauucacagugguuguaggagauguugcugggaucuuggcucaaggaaagaaaaugauuaggccacaaccuauggaauacaaauacucguggaaaagcuggggaaaggcuaaaaucauaggggcagauguacagaacaccacuuucaucauagauggcccaaacaccccagaaugcccugaugaccaaagagcauggaacauuugggaaguugaggacuauggauuuggaauuuucacgacaaacauauggcugaaauugcgcgauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccaauguuugcuguagggcuauuauuucgcagacuaacauccagagaaguucuucuucuaacaauuggauugagucuaguggcaucuguggaguuaccaaauucccuggaggagcugggggauggacuugcaaugggcauuaugauuuuaaaauuauugacugauuuucaaucacaucagcugugggccaccuugcuguccuugacauuuaucaaaacaacgcuuuccuugcacuaugcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacaccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccauaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccaggugcuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcauaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauaggucuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaagggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaagcuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugacauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaacuuagccgagagaguucucgacuggcuggaaaaauauggcgucgaaaggcugaaaagaauggcaaucagcggagaugacugcguggugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaaccgcaugccuaggcaagucauaugcacaaauguggcagcugauguacuuccacaggagagaccugagacuagccgcuaaugcuaucuguucagccguuccaguugauuggaucccaaccacauguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6194 - RNA, 9879 nt, Artificial Sequence
  derived and/or modified CDS sequence (wt) from DENV-1__JQ045649__SS-prME
ucugugaccaugcuccuuaugcugaugccuacagccuuggcguuccacuugacuacacgagggggagagccgcacaugauagucagcaagcaggaaagaggaaagucacucuuguuuaagaccucagcaggugucaacaugugcacccuuauagcgauggauuugggagaguuaugugaggacacgaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacguaggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuucaaugaaaugguguuguugacaaugaaagaaaaaucauggcuaguccacaaacaaugguuuuuagaccuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaauauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagguguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacauccuacuugaaaaugauaugaaauucacagugguuguaggagauguugcugggaucuuggcucaaggaaagaaaaugauuaggccacaacccauggaacacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuagaaagugaaaugauaauuccaaagaucuauggaggaccaauaucucagcacaacuacagaccaggauauuuuacacaaacagcagggccguggcaccuaggcaaguuggaacuggauuuugaucugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucagggaaaaggaagaaaaucuagucaaaucaauggucucugcagggucaggggaaguggacaguuuuucacuaggacugcuaugcauaucaauaaugaucgaggaggugaugagauccagauggaguagaaaaaugcugaugacugguacacuggcuguguucuuccuucucauagugggacaauugacauggaacgaucugaucagauuaugcaucaugguuggagccaacgcuuccgacaggauggggaugggaacgacguaccuagcccugauggccaccuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccuccuugcuguccuugacauuuaucaaaacaacguuuuccuugcacuacgcauggaagacaauggcuaugguacugucaguuguaucucucuucccuuuaugccuguccacgaccucccaaaaaacuacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagcgccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuucugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaaugacugggacuacgucgucacaacagacaucuccgaaaugggagcaaauuuccgagccgacagggugauagacccaagacggugucugaaaccgguaauacuaaaagauggcccagagcgugucauuuuagcaggaccaaugccagugacuguggccagugccgcccagaggagaggaagaauuggaaggaaccauaauaaagaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggagaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacauccauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccuguggucuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggauaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaguggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguuugaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuuaagaaugaggccagaaucacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucuccacuggcuggaaaaguauggcgucgaaaggcugaaaagaauggcaaucagcggagaugacugcguagugaaaccaauugaugauagauuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggagcacucugguga

SEQ ID NO: 6195 - RNA, 9879 nt, Artificial Sequence
  derived and/or modified CDS sequence (wt) from DENV-1__JQ045650__SS-prME
ucugugaccaugcuccuuaugcugaugccuacagccuuggcguuccacuugacuacacgagggggagagccgcacaugauagucagcaagcaggaaagaggaaagucacucuuguuuaagaccucagcaggugucaacaugugcacccuuauagcgauggauuugggagaguuaugugaggacacgaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacguaggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuucaaugaaaugguguuguugacaaugaaagaaaaaucauggcuaguccacaaacaaugguuuuuagaccuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaauuggccgagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaauauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagguguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacauccuacuugaaaaugauaugaaauucacagugguuguaggagauguugcugggaucuuggcucaaggaaagaaaaugauuaggccacaacccauggaacacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuagaaagugaaaugauaauuccaaagaucuauggaggaccaauaucucagcacaacuacagaccaggauauuuuacacaaacagcagggccguggcaccuaggcaaguuggaacuggauuuugaucugugugaggguaccacgguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucagggaaaaggaagaaaaucuagucaaaucaauggucucugcagggucaggggaaguggacaguuuuucacuaggacugcuaugcauaucaauaaugaucgaggaggugaugagauccagauggaguagaaaaaugcugaugacugguacacuggcuguguucuuccuucucauagugggacaauugacauggaacgaucugaucagauuaugcaucaugguuggagccaacgcuuccgacaggauggggaugggaacgacguaccuagcccugauggccaccuuuaaaaugagaccaauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccuccuugcuguccuugacauuuaucaaaacaacguuuuccuugcacuacgcauggaagacaauggcuaugguacugucaguuguaucucucuucccuuuaugccuguccacgaccucccaaaaaacuacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagcgccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuucugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaaugacugggacuacgucgucacaacagacaucuccgaaaugggagcaaauuuccgagccgacagggugauagacccaagacggugucugaaaccgguaauacuaaaagauggcccagagcgugucauuuuagcaggaccaaugccagugacuguggccagugccgcccagaggagaggaagaauuggaaggaaccauaauaaagaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggagaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacauccauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccuguggucuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucgguuguggaagagguggcugggcauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggauaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaguggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguuugaagcucuugguuucaugaacgaagaucacugguucagcagagagaauucacucagcggaguggaaggggaaggacuccacaaacuuggauauauacucagagacauaucaaagauuccagggggaaacauguaugcagaugacacagccggaugggauacaaggauaacagaggaugaccuuaagaaugaggccagaaucacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucuccacuggcuggaaaaguauggcgucgaaaggcugaaaagaauggcaaucagcggagaugacugcguagugaaaccaauugaugauagauuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggccagaguaucacaaggugcaggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6196 - RNA, 9879 nt, Artificial Sequence
  derived and/or modified CDS sequence (wt) from DENV-1__JQ045651__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuucaaugaaaugguguuguugacaaugaaagaaaaaucauggcuaguccacaaacaaugguuuuuagacuuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucuggaacgacaacaaucuuugcaggacacuugaaaugcagacuaaagauggacaaacugacucuaaaagggaugucauaugugaugugcacaggcucauucaagcuagagaaagaauuggcugagacccagcauggaaccguucuagugcagauuaaauacgaaggaacagaugcaccaugcaagaucccuuuuucgacccaagaugaaaagggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauccgaucagcaacucgucucgagaacaucauguggaagcaaauaucaaaugaacugaaucacauccuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacaaaacaccaccuucaucaucgauggcccaaacaccccagaaugcccugaugaccaaagagcauggaacauuugggaaguugaggacuauggauuuggaauuuucacgacaaacauauggcugaaauugcgugauuccuauacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacaggccaggauauuuuacacaaacagcagggccguggcaccuaggcaaguuggaacuggauuuugauuugugugaggguaccacagucguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggggccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuaugucauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccacuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggcccuuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccaggcaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuaugcugcacaacuccgaacaaggaggaagagccuauagacaugcaauggaagaacugccagacaccauagaaacguugaugcuccuagcuuugauagcugugcuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuuccuugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucuaaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacaggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaauaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuguaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaaugcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaaucacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagacauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaaaucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguugggaagauguuccauauuuaggaaaaagggaagaccagugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6197 - RNA, 9879 nt, Artificial Sequence
  derived and/or modified CDS sequence (wt) from DENV-1__JQ045652__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuucaaugaaaugguguuguugacaaugaaagaaaaaucauggcuaguccacaaacaaugguuuuuagacuuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucuggaacgacaacaaucuuugcaggacacuugaaaugcagacuaaagauggacaaacugacucuaaaagggaugucauaugugaugugcacaggcucauucaagcuagagaaagaauuggcugagacccagcauggaaccguucuagugcagauuaaauacgaaggaacagaugcaccaugcaagaucccuuuuucgacccaagaugaaaagggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauccgaucagcaacucgucucgagaacaucauguggaagcaaauaucaaaugaacugaaucacauccuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacaaaacaccaccuucaucaucgauggcccaaacaccccagaaugcccugaugaccaaagagcauggaacauuugggaaguugaggacuauggauuuggaauuuucacgacaaacauauggcugaaauugcgugauuccuauacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacaggccaggauauuuuacacaaacagcagggccguggcaccuaggcaaguuggaacuggauuuugauuugugugaggguaccacagucguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggggccaacgcuuccgacaggauggggaugggaacgacguaccuagcccugauggccacuuuuaaaaugagaccaauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuaugucauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccacuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggcccuuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaaugcaguuauccaagaugaggaaagagacauuccugagagaucauggaacucaggcuaugaguggaucacugacuucccaggcaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuaugcugcacaacuccgaacaaggaggaagagccuauagacaugcaauggaagaacugccagacaccauagaaacguugaugcuccuagcuuugauagcugugcuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuuccuugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucuaaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacaggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaauaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuguaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucauaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaaugcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaaucacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagacauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggccagaguaucacaaggugcaggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6198 - RNA, 9879 nt, Artificial Sequence
  derived and/or modified CDS sequence (wt) from DENV-1__JQ045653__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggaugucuucugaaggcgcuuggaaacagauacaaagaguggagacuugggccuugagacacccaggauucacggugauagcucuuuuucuagcacaugccauaggaacauccaucacccagaaagggauuauuuucaucuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccacuaccgacucaagauguccaacacaaggagaagccacacuaguggaagaacaagacgcgaacuuugugugucgacgaacgcuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuauggagcucuuacauuggauuguucaccuagaacaggacuagacuuuaaugaaaugguguuguugacaaugaaagaaaaaucaugguuaguccacaaacaaugguuuuuagaccuaccacugccuuggaccucgggagcuucaacaucacaagagacuuggaacagacaagaucugcuggugacauuuaagacagcucaugcaaagaagcaggaaguagucgugcuaggaucacaagaaggagcaaugcacacugcguugaccggagcgacagaaauccaaacgucuggaacgacaacaauuuuugcaggacacuugaaaugcagacuaaagauggacaaacugacccuaaaagggaugucauaugugaugugcacaggcucauucaagcuagagaaagaauuggcugagacccagcauggaaccguucuagugcagauuaaauacgaaggaacagaugcaccaugcaagauccccuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguucuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacauccuacuugaaaaugacaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccggaaugcccugaugaccaaagagcauggaacauuugggaaguugaggacuauggauuuggaauuuucacgacaaacauauggcugaaauugcgugauuccuacacccaagugugugaccaccggcuuaugucagcugccaucaaggacagcaaggcaguucacgcugacaugggguacuggauagaaagugaaaagaacgagaccuggaagcuggcaagagccucuuucauagaaguuaaaacauguaucuggccaagaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguaaaaaaaugcugaugacugguacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagccuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacugcgcauggaagacaauggcuaugauauugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccuaaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggauacacccagcccuccagaaguggaaagagcaguucuugaugaugguaucuauagaauuaugcagagaggacuguugggcaggucccaaguagggguaggaguuuuccaagaagacguguuccacacaauguggcaugucaccaggggagcuguacucauguaucaagggaagagauuggaaccgagcugggccagugucaaaaaagaccugaucucauauggaggagguuggaggcuucaaggaucuuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuaugucagugccauagcucaagccaaagcaucacaagaagggccccuaccagagauugaagacgagguguucaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcuuaagggaaugccaauaagguaccaaacaacagcagugaagagugaacauacaggaaaagagauaguugaccuaaugugucacgccacuuucaccaugcgccuccugucucccguaagaguucccaauuacaacaugaucaucauggaugaagcacauuucacugauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcaucaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggcuagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuacgaccucgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccggagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguggacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacacuacgauagcgguuuccauggcaaacauuuucagaggaaguuaucuagcaggagcaggucuggccuucucauuaaugaaaucucuaggaggagguaggagaggcacgggagcccaaggggaaacauugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguagaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaacuuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggugucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugacuggaucccaaccagccguaccaccuggucgauccaugcccaucaccaauggaugacgacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6199 - RNA, 9879 nt, Artificial Sequence
  derived and/or modified CDS sequence (wt) from DENV-1__JQ045657__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucugcuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacacuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaaguguguuacaaaacuggaaggaaagauaguucaauaugaaaacuugaaauauucaguaauagucacaguccacacuggagaccagcaccaggugggaaaugaaagcacagaacaugggacaacugcaacuauaacaccucaagcuccuucgacggaaauacagcugacugacuacggagcucuuacauuggauuguucaccuagaacaggacuagacuuuaaugaaaugguguuguugacaaugaaagaaaaaucauggcuaguccacaaacaaugguuucuagaccuaccauugccuuggaccucgggagcuucaacaucacaagagacuuggaacagaaaagauuugcuggugacauucaagacagcucaugcaaagaagcaggaaguagucguacuaggaucacaagaaggagcaaugcacacugcguugaccggagcaacagaaauccaaacgucuggaacgacaacaauuuuugcaggacauuugaaaugcagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaucccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggagggcguguguggaauacgaucaacaacucgucucgagaacaucauguggaagcaaauaucaaaugaacugaaccacaucuuacuugaaaaugacaugaaauucacagugguuguaggagauguugcuggaaucuuggcucaaggaaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccauuaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuccuucuaacaauuggauugaguuuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacauuuuccuugcacuaugcauggaagacaauggccaugguacugucaauuguaucucucuuccccuuaugccuguccacgacuucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacaaagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccagugugaaaaaagaccuaaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacguuagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccucgauaauauaaacacaccagaagggauuaucccagcccucuucgagccggagagagaaaagagugcagcaauagacggggaauauagacuacggggugaagcaaggaaaacguuuguggagcuuaugagaagaggagaucuaccugucuggcuauccuacaaaguugccucagaaggcuuucaguacucugacagaagauggugcuuugauggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaccugguuauguugcacaacuccgaacaaggaggaagagccuauagacaugcaauggaggaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcugcugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugauaaaggauggccaauaucgaagauggacauaggaguuccacuucuugccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccuugguuguggaagagguggcuggucauacuauugcgccgggcugaagaaagucacagaagugaagggauauacgaaaggaggaccuggacaugaggagccaauuccaauggcgaccuauggauggaaucuaguaaaacugcacuccgggaaagacguauucuuuguaccacccgagaaaugugacacccuuuugugugauauuggugaguccucuccaaauccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgauucugggaccuugugcacagagagagggagcuucacaaacagggaaaaugugccacguguguuuacaacaugauggggaagagagagaaaaaacuaggagaguucggaaaggcaaaaggaagucgugcaauaugguauauguggcugggagcacgcuuucuagaguucgaagcucuuggcuucaugaacgaagaucacugguucagcagagagaauucacucagcggaguggaaggagaaggacuccacaaacuuggauauauacucagagacauaucaaagauuccaggaggaaacauguaugcagaugacacagccggaugggauacaaggauaacagaggaugaccuucagaacgaggccagaauuacugacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugaggaaauuuuuucacccagcgaauuagagaccccaaauuuagccgggagaguucucgacuggcuggaaaaacauggcgucgaaaggcugaaacgaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacucacauauccaguuggggagauguuccauauuuaggaaaaagggaagaucaaugguguggaucccugauaggcuugacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6200 - RNA, 9879 nt, Artificial Sequence
  derived and/or modified CDS sequence (wt) from DENV-1__JQ045659__SS-prME
ucugugaccaugcuccuuaugcugaugccuacagccuuggcguuccauuugacuacacgagggggagagccgcacaugauagucagcaagcaggaaagaggaaagucacuccuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaaggguggagacuugggcccugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcucccacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagauuuguuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggagcaacccagaaugggagauugauaacagcuaaccccauagucacugacaaagaaaaaccagucaacauugaggcagaaccgcccuuuggugagaguuacaucguaauaggagcaggggaaaaagcucugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggaugugugauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauuagaucagcaacucgucucgagaacaucauguggaagcaaauaucaaaugaacugaaucacaucuuacuugaaaaugauaugaaauucacagugguuguaggagauguuacugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauucccacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguugcuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuauggaguuaccaaauuccuuggaggagcugggggauggacuugcaaugggcauuaugauucuaaaauuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauugggaucccuuggauguaaaccacuaacaauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaaaaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcaacccuuuucgugugguacuuuuggcagaaaaagaaacagagaucuggaguguuaugggacacacccagcccuccagaagugggaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcucuagacuuuaaaccuggcacaucuggaucucccaucgugaacagagaaggaaaaauaguaggucuuuauggaaauggaguagugacaacgaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaacgggaaacgggugauucaauugagcaggaaaaccuuugauacagaguaccaaaaaacaaaaaacaacgacugggacuacgucgucacaacagacaucucugaaaugggagcaaauuuccgagccgacagggugauagacccaagacggugucugaaaccgguaauacuaaaagaugguccugagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacuccgacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaagaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauucuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaagaggagugggauuauggaaguggacagauccgaagccaaagagggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauacacaaaaggaggaccuggacaugaggaaccaaucccaauggcgaccuauggauggaaccuaguaaagcugcacucugggaaagacguauucuuuauaccaccugagaaaugugacacccuuuugugcgauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagagaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggcugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucaccuagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggggcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6201 - RNA, 9879 nt, Artificial Sequence
  derived and/or modified CDS sequence (wt) from DENV-1__JQ045661__SS-prME
ucugugaccaugcuccuuaugcugaugccuacagccuuggcguuccauuugacuacgcgagggggagagccgcacaugauagucagcaagcaggaaagaggaaagucacucuuguuuaagaccucagcaggugucaacaugugcacccuuauagcgauggauuugggagaguuaugugaggacacgaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacguaggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccuuccauggccaugcgaugcgugggaauaggcagcagggacuucguggaaggacugucaggagcaacuuggguagaugugguacuggaacauggaaguugcgucaccaccauggcaaaagacaaaccaacauuggauauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacacuggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuucaaugaaaugguguuguugacaaugaaagaaaaaucauggcuaguccacaaacaaugguuuuuagaccuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaauuggcugagacccagcauggaaccguucuaguacagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucuccugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacauccuacuugaaaaugauaugaaauucacagugguuguaggagauguugcugggaucuuggcucaaggaaagaaaaugauuaggccacaacccauggaacacaaauauucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacucaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaccuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaauggugcugcagaucuugcacgcuaccacccuuacguuucagaggagaagaugggugcugguacgguauggaaaucagaccagucaaggaaaaggaagaaaaucuagucaaaucaauggucucugcagggucaggggaaguggacaguuuuucacuaggacugcuaugcauaucaauaaugaucgaggaggugaugagauccagauggaguagaaaaaugcugaugacugguacacuggcuguguucuuccuucucauagugggacaauugacauggaacgaucugaucagauuaugcaucaugauuggagccaacgcuuccgacaggauggggaugggaacgacguaccuagcccugauggccaccuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacucgcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaguuguaucucucuucccuuuaugccuguccacgaccucccaaaaaacuacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaauuuucaugacagccacucccccaggaucaguggaggccuuuccacagagcaaugcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccauaauaaagaaggugaucaguacaucuacaugggacagccuuuaaacaacgaugaagaucacgcucacuggacggaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacacccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucucaggugaauccacugacgcugacagcggcaguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaauaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggauaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaguggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguuugaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaguauggcguugaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccacuugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6202 - RNA, 9879 nt, Artificial Sequence
  derived and/or modified CDS sequence (wt) from DENV-1__JQ045663__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagagguuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcucccacgacggaaauacagcugaccgacuacggagcucucacauuggauuguucaccuagaacaggacuagacuuuaaugaaaugguguuguugacaaugaaagaaaaaucauggcuaguccacaaacaaugguucuuagaccuaccacugccuuggacuucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaauuggcugagacccagcauggaaccguucuagugcagauuaaauacgaaggaacagaugcaccaugcaagaucccuuuuucgacccaagaugaaaaaggagugacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacauccuacuugaaaaugauaugaaacucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaagcaccccagaaugcccugaugaccaaagagcauggaacauuugggaaguugaggacuauggauuuggaauuuucacgacaaacauauggcugaaauugcgugauucccacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaauggugcugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauucccuggaggagcugggggauggacuugcaaugggcauuaugauuuuaaaauuauugacugauuuucaaucacaucagcugugggccaccuugcuguccuugacauuuaucaaaacaacguuuuccuugcacuaugcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaacuccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaacaaggaaggugaccaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggcgaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacacuauagaaacguugaugcuccuagcuuugauagcuguguuaacugguggagugacacuguuccuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccaacuggcauauguggugauaggucuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuauuacucccaugaugaggcacacaaucgaaaacacaacggcaaacauuucccugacagccauugcaaaccaggcagccauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaagcuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauacaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauacauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaacuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuugacagcaagggccaccugggccaccaauauacaaguggccauaaaccaagugagaagacuaauugggaaugagaauuaucuagauuacaugacaucaaugaagagauucaagaacgagagugaucccgaaggggcacucugguga

SEQ ID NO: 6203 - RNA, 9879 nt, Artificial Sequence
  derived and/or modified CDS sequence (wt) from DENV-1__JQ045665__SS-prME
ucugugaccaugcuccuuaugcugaugccuacagccuuggcguuccauuugacugcacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggaugucuucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaaccccgccguccugcgcaaacugugcauugaagccaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucaugguuaguccacaaacaaugguuuuuagaccuaccacugccuuggaccucgggagcuucaacaucacaggagacuuggaacagacaagaucugcuggugacauuuaagacagcucaugcaaagaagcaggaaguagucgugcuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaauuggcugagacccagcauggaaccguucuagugcagauuaaauacgaaggaacagaugcaccaugcaagaucccuuuuucgacccaagaugaaaaaggagcaacccagaaugggagauugauaacagcuaaccccauaguuacugacaaagaaaaaccagucaacauugaggcagaaccgcccuuuggugaaaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacauccuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgcgauuccuacacccaagugugugaccaccggcuuaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguugugaaugaacauuguggaaaucgaggaccaucucuuaggaccacaacagucacagggaagauaauucaugaaugguguugcagaucuugcacgcuaccacccuuacgcuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauugaguagaaaaaugcugaugacugguacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagccuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcaccacgcauggaagacaauggcuaugauacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccacuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggaucuuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuaugucagugccauagcucaagccaaagcaucacaagaagggccccuaccagagauugaagacgagguguucaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcuuaagggaaugccaauaagguaccaaacaacagcagugaagagugaacauacaggaaaagagauaguugaccuaaugugucaugccacuuucaccaugcgccuccugucucccguaagaguucccaauuacaacaugaucaucauggaugaagcacauuucacugauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucaccgacuucccagguaaaacaguuugguuuguuccaagcauuaaaucaggaaaugacauugccaacugcuuaagaaagaaugggaaacgggugauucaacugagcaggaaaaccuuugauacagaguaccaaaaaacaaaaaacaacgacugggacuacgucgucacaacagacaucuccgagaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaucguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacuguuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcaacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacacuacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggaucauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuucauaccaccugagaaaugugacacccuuuugugugauauuggugaguccucuccgaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaagacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguagaaccagagguagccaaccuagacaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaacuuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauuggaucccaaccacauguaccaccuggucgauccaugcccaucaccaauggaugacgacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6204 - RNA, 9879 nt, Artificial Sequence
  derived and/or modified CDS sequence (wt) from DENV-1__JQ045666__SS-prME
ucugugaccaugcuccuuaugcugaugccuacagccuuggcguuccauuugacugcacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggaugucuucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaaccccgccguccugcgcaaacugugcauugaagccaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucaugguuaguccacaaacaaugguuuuuagaccuaccacugccuuggaccucgggagcuucaacaucacaggagacuuggaacagacaagaucugcuggugacauuuaagacagcucaugcaaagaagcaggaaguagucgugcuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaauuggcugagacccagcauggaaccguucuagugcagauuaaauacgaaggaacagaugcaccaugcaagaucccuuuuucgacccaagaugaaaaaggagcaacccagaaugggagauugauaacagcuaaccccauaguuacugacaaagaaaaaccagucaacauugaggcagaaccgcccuuuggugaaaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacauccuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgcgauuccuacacccaagugugugaccaccggcuuaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguugugaaugaacauuguggaaaucgaggaccaucucuuaggaccacaacagucacagggaagauaauucaugaaugguguugcagaucuugcacgcuaccacccuuacgcuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauugaguagaaaaaugcugaugacugguacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagccuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcaccacgcauggaagacaauggcuaugauacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccacuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggaucuuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuaugucagugccauagcucaagccaaagcaucacaagaagggccccuaccagagauugaagacgagguguucaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcuuaagggaaugccaauaagguaccaaacaacagcagugaagagugaacauacaggaaaagagauaguugaccuaaugugucaugccacuuucaccaugcgccuccugucucccguaagaguucccaauuacaacaugaucaucauggaugaagcacauuucacugauccauccaguauagcggccagaggguacaucucaacccgagugggcaugggugaagcagcugcaaucuucaugacagccacucccccaggaucaguggaggccuuuccacagagcaaugcaguuauccaagaugaggaaagagacauuccugagagaucauggaacucaggcuaugaguggaucaccgacuucccagguaaaacaguuugguuuguuccaagcauuaaaucaggaaaugacauugccaacugcuuaagaaagaaugggaaacgggugauucaacugagcaggaaaaccuuugauacagaguaccaaaaaacaaaaaacaacgacugggacuacgucgucacaacagacaucuccgagaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaucguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacuguuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcaacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacacuacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggaucauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuucauaccaccugagaaaugugacacccuuuugugugauauuggugaguccucuccgaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaagacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguagaaccagagguagccaaccuagacaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaacuuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauuggaucccaaccagccguaccaccuggucgauccaugcccaucaccaauggaugacgacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6205 - RNA, 9879 nt, Artificial Sequence
  derived and/or modified CDS sequence (wt) from DENV-1__JQ045667__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgggacaaacguuccgucgcacuggccccacacgugggacuugguuuggaaacaagaaccgaaacguggauguccucugaaggcgcuuggaaacagauacaaagaguggagaccugggcccugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaagcugcgucaccaccauggcaaaagacaaaccaacauuggauauugaacucuugaagacggaagucacaaacccugccauccugcgcaaacugugcauugaagcuaaaauaucaaacaccaccaccaacucaagauguccaacacaaggagaagccacacuaguggaagaacaagacgcgaacuuugugugccgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucacuguucacaccggagaucagcaccaagugggaaaugaaagcacagaacaugggacaacugcaacuauaacaccucaagcuccuacgacggaaauacagcugaccgacuacggagcucuuacauuggauuguucaccuagaacaggacuagauuuuaaugaaaugguguuguugacaaugaaaggaaaaucauggcuaguccacaaacaaugguuuuuagaccuaccacugccuuggaccucgggagcuucaacaucacaagagacuuggaacagacaagauuuguuggugacauuuaagacagcucaugcaaagaagcaggaaguagucguacugggaucacaagaaggagcaaugcacacugcauugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaguacgaaggaacagaugcaccaugcaagaucccuuuuucgacccaagaugaaaaaggaguaacccagaaugggagauugauaacagcuaaccccauagucacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaagauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauuagaucagcaacucgucucgagaacaucauguggaagcaaauaucaaaugaacugaaucacaucuuacuugaaaaugacaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucauugauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguccacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggagaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaaugcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucauaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuacugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauggcauguuauguuauaucuggaagcucagccgaccuaucauuagagaaagcggcugaggucuccugggaagaagaagcagaacauucuggugccucacacaacauauuaguggaaguccaaggcgauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaagugggaagagcaguucuugaugaugguaucuauagaauuaugcagagaggacuguugggcaggucccaaguagggguaggaguuuuucaagaaaacguguuccauacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcucuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacagucugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccugagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuuugagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacuccgacagaagauggugcuuugacggggaaaggaauaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguuacacaacuccgaacaaggaggaagagccuauagacaugcaauggaagaacugccagacaccauagaaacguugaugcuccuagcucugauagcuguguugacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccuuuaugcaguggccacaacaauuaucacucccaugaugaggcacacaaucgaaaacacaacugcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacaucuacaagaggagugggauuauggaaguggacagauccgaagccaaagagggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacccaugaaauguauuggguuucauguggaacaggaaacaucgugucagcaguaaacaugacaucuagaaugcugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucguccauggucaauggcguggugaaacugcucaccaaaccaugggaugucauccccauggucacacaaauagccaugacugacacuacacccuuuggacaacagaggguguuuaaagagaaaguugacacacgcacaccaaaagcaaaacggggcacaauacaaaucauggaggugacagccaagugguuauggggcuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugccacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggcugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggccaggucggaacuuacgguuuaaacacuuucaccaacauggaagcccagcugauaagacaaauggagucugagggaaucuuuucaccuagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6206 - RNA, 9879 nt, Artificial Sequence
  derived and/or modified CDS sequence (wt) from DENV-1__KU094071__SS-prME
uccgugaccaugcuccuuaugcugcugcccacagcccuggcguuccaucugaccacacgagggggagagccgcacaugauaguuagcaagcaggaaagaggaaagucacuuuuguuuaagaccucugcaggugucaacaugugcacccuuauugcgauggauuugggagaguuaugugaggacacaaugaccuacaaaugcccucggaucacuaaggcggaaccagaugacguugacuguuggugcaaugccacggacacaugggugaccuauggaacguguucucaaacuggcgaacaccgacgagacaagcguuccgucgcacuggccccacauguggggcuuggucuagaaacaagagccgaaacguggauguccucugaaggcgcuuggaaacaaauacaaaaaguggagacuugggcucugagacacccaggauucacgguaauagcccucuuucuagcacaugccauaggaacauccaucacccagaaagggauuauuuucauuuuguugaugcugguaacaccauccauggccaugcgaugcgugggaauaggcaacagagacuucguggaaggacugucaggaggaacguggguggaugugguacuggagcauggaaguugcgucaccaccauggcaaaagauaaaccaacauuggacauugaacucuugaagacggaggucacaaacccugccguccugcguaaacugugcauugaagcuaaaauaucaaacaccaccaccgauucaagauguccaacacaaggggaagccacacugguggaagaacaagacgcgaacuuugugugucgacgaacguuuguggacagaggcuggggcaaugguugugggcuuuucggaaaagguagccuaauaacgugugcuaaguucaagugugugacaaaacuggaaggaaagauuguucaauaugagaacuugaaauauucagugauagucaccguccacacuggugaccagcaccaggugggaaaugagaccacagaacauggaacaauugcaaccauaacaccucaagcuccuacgucggaaauacagcugaccgacuacggagcucuuacauuggauugcucacccagaacagggcuagacuuuaaugagaugguguuguugacaaugaaaagaaaaucauggcuuguccacaaacaaugguuucuagacuuaccacugcccuggaccucgggagcuucaacaccccaagagacuuggaacagagaagauuugcugguuacauuuaagacagcucaugcaaagaagcaggaaguagucguacuaggaucacaagaaggagcaaugcacacugcguugaccggagcgacagaaauccaaacgucuggaacgacaaaaauuuuugcaggacacuugaaauguagacuaaaaauggacaaacugaccuuaaaagggaugucauaugugaugugcacaggcucauucaaguuagagaaagaaguggcugagacccagcauggaacuguucuagugcagguuaaauacgaaggaacagaugcaccaugcaagauccccuuuucgacccaagaugagaaaggaguaacccagaaugggagauugauaacagccaaccccauagucacugacaaagaaaaaccagucaacauugaggcagaaccaccuuuuggugagaguuacaucgugguaggagcaggugaaaaagcucugaaacuaagcugguucaagaaaggaagcagcauagggaaaaugcuugaagcaacugcccgaggagcacgaaggauggccauccuaggagacaccgcaugggacuucgguucuauaggaggaguguucacgucugugggaaaacugguacaccagaucuuuggaacugcauauggaguuuuguucagcgguguuuccuggacuaugaaaauaggaauagggauucugcugacauggcuaggauuaaauucaaggagcgcgucccuuucgaugacgugcauugcaguuggcaugguuacacuguaccuaggagucaugguucaggcggacucgggauguguaauuaacuggaaaggcagagaacucaaauguggaaguggcauuuuugucaccaaugaaguucacacuuggacagaacaauacaaauuccgggccgacuccccaaagagacuaucagcagccauugggaaggcaugggaagaggguguguguggaauucgaucagccacucgucucgagaacaucauguggaagcagauaucgaaugaacuaaaccacaucuuacuugaaaaugacaugaaauucacaguggucguaggagauguuagugggaucuugacccaaggaagaaaaaugauugggccacaacccauggaacacaaauacucguggaaaagcuggggaaaagccaaaaucauaggagcagauguacagaacaccaccuucauuaucgacggcccaaacaccccagaaugcccugaugaccaaagagcauggaacauuugggaaguugaggacuauggauuuggaauuuucacgacaaauauaugguugaaauugcgugacuccuacacccaagugugugacccccggcuaaugucagcugccauuaaggacagcaaggcaguucaugccgauaugggauacuggauagaaagugaaaagaacgagaccuggaggcuggcgagagccuccuucauagaaguuaagacaugcgucuggccaaaaucccacacucuauggagcaacggaguuuuggaaagugaaaugauaaucccaaagauauauggaggaccaauaucucagcacaacuacagaccaggauauuccacacaaacagcaggaccguggcaccuaggcaaguuggaacuagauuuugauuugugugaggguaccacaguuguuguggaugaacauuguggaaaucgaggaccaucucuuagaaccacaacaguaacaggaaagauaauccaugaauggugcuguagaucuuguacgcuaccccccuuacguuucaaaggagaagacggguguugguacggcauggaaaucagaccagucaaggacaaggaagagaaccuaguaaagucauuggucucugcagggucaggagaaguggauagcuuuucacuaggacuguuaugcguaucaauaaugaucgaagaggugaugagauccagauggaguagaaaaaugcugaugacuggaacacuggcuguguuccuccuucucauaaugggacaauugacauggaaugaucugaucagguuaugcaucaugguuggagccaaugcuucagacaggauggggaugggaacaacguaccuagcucugauagccacuuuuaaaaugagaccaauguucgcugucggguuauuauuucgcagacuaacaucuagagaaguucuucuucuuacgauuggauugagucugguggcaucuguggagcuaccaaauuccuuggaggagcugggggauggacuugcaaugggcaucaugauuuuaaaauuacugacugacuuucagucacaucagcugugggcugcccugcuguccuugacauuuaucaaaacaacuuuuucauugcacuaugcauggaagacaauggcuaugguacugucaacuguaucucucuucccuuuaugccuguccacgaccucucgaaaaacaacauggcuuccggugcuguugggaucucuuggaugcaaaccacuaaccauguuucuuauagcagaaaacaaaaucuggggaaggaaaaguuggccccucaaugaaggaaucauggcuguuggaauaguuagcauccuacuaaguucacuccucaagaaugacgugccgcuagccggcccacuaauagcuggagguaugcuaauagcauguuauguuauauccggaagcucagccgauuuaucacuggagaaagcggcugaggucuccugggaagaagaagcagaacacucuggugccucacacaacauacuaguggaaguccaagaugauggaaccaugaagauaaaagaugaagagagagaugacacacucaccauucuccuuaaagcaacucuguuggcagucucagggguguacccaauaucaauaccagcgacccuuuuugugugguauuuucggcagaaaaagaaacagagaucaggagugcuaugggacacaccuagcccuccagaaguggaaagagcaguucuugaugaugguaucuauagaauucugcaaagaggacuguuggguaggucccagguaggaguaggaguuuuccaagaaggcguguuccacacaauguggcaugucaccaggggagcuguccucauguaucaagggaagagacuggaaccgaguugggccagugucaaaaaagacuugaucucauauggaggagguuggagguuucaaggauccuggaacacgggagaagaagugcaggugauugcuguugaaccggggaaaaaccccaaaaacguacagacagcgccgggcaccuucaagaccccugaaggcgaaguuggagucauagcccuagauuuuaaacccggcacaucuggaucucccauugugaacagagagggaaaaauaguaggucuuuauggaaauggaguggugacaacaaguggaaccuacgucagugccauagcucaagcuaaagcaucacaagaagggccucuaccagagauugaggacgagguguuuaggaaaagaaacuuaacaauaauggaccuacauccaggaucggggaaaacaagaagauaucuuccagccauaguccgugaggcuauaaaaaggaagcugcguacgcuaaucuuggcucccacaagaguugucgcuucugaaauggcagaggcgcucaagggaaugccaauaagguaucagacaacagcagugaagagugaacacacaggaagggagauaguugaccuuaugugccaugccacuuucaccaugcgucuccugucucccgugagaguucccaauuacaacaugaucaucauggaugaagcacauuucaccgauccagccaguauagcggccagaggguacaucucaacccgggugggcaugggugaagcagcugcgaucuucaugacagccacucccccaggaucgguggaggccuuuccacagagcaaugcaguuauccaagaugaggaaagagacauuccugagagaucauggaacucaggcuaugacuggaucacugauuucccagguaaaacagucugguuuguuccaagcauuaaaucaggaaaugacauugccaacuguuuaagaaagaaugggaaacgggugauccaauugagcagaaaaaccuuugauacugaguaccagaaaacaaaaaauaaugacugggacuaugucgucacaacagacauuuccgaaaugggagcaaacuuccgagccgacaggguaauagacccaagacgguguucgaaaccgguaauacuaaaagaugguccagagcgugucauucuagccggaccgaugccagugacuguggccagugccgcccagaggagaggaagaauuggaaggaaccaaaauaaggaaggugaucaguacauuuacaugggacagccuuuaaacaacgaugaggaucacgcucauuggacagaagcaaaaaugcuccuugacaacauaaacacaccagaagggauuaucccagcccucuuugagccggagagaggaaaaagugcagcaauagacggggaauacagacugcggggugaagcaaggaaaacguuuguggagcucaugagaagaggagaucuaccugucuggcuauccuacaaaguugccucagaaggcuuccaguacucugacagaaaguggugcuuugauggggaaaggaacaaccagguguuggaggagaacauggacguggagaucuggacaaaagaaggagaaagaaagaaacuacgaccccgcuggcuggacgccagaacauacucugacccacaggcucugcgcgaguuuaaagaguuugcagcaggaagaagaagcgucucaggugaucuaauauuagaaauagggaaacuuccacaacauuugacgcaaagggcccagaaugcucuggacaaccuggucauguugcacaacuccgaacaaggaggaaaagccuauagacaugcuauggaagaacuaccagacaccauagaaacguugaugcuccuagcuuugauagcuguguuaacugguggagugacgcuguucuuccuaucaggaagaggccuagggaaaacaucuaucggccuacucugcgugauggcuucaagcguacuguuauggguggccaguguggagccccauuggauagcggccuccaucauacuggaguucuuucugauggugcugcuuauuccagagccagacagacaacgcacuccacaggacaaccagcuggcauauguggugauagguuuguuauucaugauauugacaguagcagccaaugagaugggauuauuggaaaccacaaagaaagaccuagggauuggccauguggcuguugaaaaccaccaccaugccacaaugcuggacguagacuuacguccagcuucagccuggacccucuaugcaguggccacaacaaucaucacucccaugaugagacacacaauugaaaacacaacggcaaauauuucccugacagcuauugcaaaccaggcagcuauauugaugggacuugacaagggauggccaauaucgaagauggacauaggaguuccacuccucgccuuggggugcuauucccaggugaacccgccgacgcugauagcggcgguauugaugcuaguggcucauuacgccauaauuggaccuggacugcaagcaaaagccacuagagaagcucaaaaaagaacagcggccggaauaaugaaaaauccaacugucgacggaauuguugcaauagauuuggacccugugguuuaugaugcaaaauuugaaaaacagcuaggccaaauaauguuguugauacuuugcacaucacagauucucucgaugcggacuacaugggccuugugugaauccaucacacuggcuacuggaccucugaccacgcuuugggagggaucuccaggaaaauucuggaacaccacgaucgcgguguccauggcaaacauuuucaggggaaguuaucuagcaggagcaggucuggccuucccauuaaugaaaucucuaggaggagguaggagagguacgggagcccaaggggaaacacugggagaaaaauggaaaagacagcuaaaccaacugagcaagucagaauucaacacuuacaaaaggagugggauuauggagguggauagaucugaagcuaaagagggauugaaaagaggagaaacaaccaaacaugcagugucgagaggaacagccaaacugaggugguuuguggagaggaaccuugugaagccggaagggaaagucauagaccucgguuguggaagagguggcuggucauauuauugugcugggcugaagaaagucacagaagugaaaggauauacaaaaggaggaccuggacaugaggaaccaaucccaauggcgaccuauggauggaaccuaguaaagcuacacuccgggaaagauguauucuuuacaccaccugagaaaugugacacccuuuugugugauauuggugaguccucuccgaacccaacuauagaagaaggaagaacguuacguguucuaaagaugguggaaccauggcucagaggaaaccaauuuugcauaaaaauucuaaaucccuauaugccgagugugguggaaacucuggagcaaaugcaaagaaaacauggaggaaugcuagugcgaaauccacucucaagaaauuccacccaugaaauguacuggguuucauguggaacaggaaacauugugucagcaguaaacaugacaucuagaauguugcuaaaucgauucacaauggcucacaggaagccaacauaugaaagagacguggacuuaggugcuggaacaagacauguggcaguggaaccagagguagccaaccuagauaucauuggccagaggauagagaauauaaaaaaugagcauaagucaacauggcauuaugaugaggacaauccauacaaaacaugggccuaucauggaucauaugagguuaagccaucaggaucagccucauccauggucaauggcguggugagauugcucaccaaaccaugggauguuaucccuauggucacacaaauagccaugacugacacuacacccuuuggacaacagaggguguuuaaagagaaaguugacacgcgcacaccaaaagcaaaacgaggcacagcacaaaucauggaggugacagccaggugguuaugggguuuucuuucuagaaacaaaaaaccaagaaucugcacaagagaggaguucacaagaaaagucaggucaaacgcagcuauuggagcaguguucguugaugaaaaucaauggaacucagcaaaagaagcgguggaagaugaacgguucugggaccuugugcacagagagagggagcuccauaaacagggaaaaugugccacguguguuuacaauaugauggggaagagagagaaaaaauuaggagaguucggaaaggcaaaaggaagucgugcaauaugguacaugugguugggagcacgcuuucuagaguucgaagcccuugguuucaugaacgaagaucacugguucaguagagagaauucacucaguggaguggaaggagaaggacuccacaaacuuggauauauacucagagacauaucaaagauuccagggggaaauauguaugcagaugacacagccggaugggacacaagaauaacagaggaugaucuucagaaugaggccaaaaucacugacaucauggagcccgaacaugcccuauuggcuacgucaaucuuuaagcugaccuaccaaaacaaggugguaagggugcagagaccagcaaaaaauggaaccgugauggaugucauauccagacgugaccagagaggaaguggacaggucggaacuuauggcuuaaacacuuucacuaacauggagguccaacuaauaagacaaauggagucugagggaaucuuuucacccagcgaauuggagaccccaaauuuagccgaaagaguucucgacugguuggaaaaacauggcgucgaaaggcugaaaagaauggcaaucagcggagaugacuguguggugaaaccaacugaugacagguucgcuacagccuuaacagcuuugaaugacaugggaaaaguaagaaaagacauaccgcaaugggaaccuucaaaaggauggaaugauuggcaacaagugccuuuuuguucacaccauuuccaccagcugaucaugaaggaugggagggagauaguggugccaugccgcaaccaagaugaacuuguggguagggcuagaguaucacaaggcgccggauggagccugagagaaacugcaugccuaggcaagucauaugcacagauguggcagcugauguacuuccacaggagagaccugagacuagcggccaaugccaucuguucagccguuccaauugauugggucccaaccagccgcaccaccuggucgauccaugcccaucaucaauggaugacaacagaagacauguugucaguguggaauaggguuuggauagaggaaaacccauggauggaggauaaaacccauguauccaguugggaagauguuccauacuuaggaaaaagggaagaucagugguguggaucccugauaggcuuaacagcaagggccaccugggccacuaauauacaaguggccauaaaccaagugagaaggcuuauugggaaugagaauuaucuagauuacaugacaucaaugaagagauucaaggaugagagugaucucgaaggggcacucugguaa

SEQ ID NO: 6207 - RNA, 9879 nt, Artificial Sequence
  derived and/or modified CDS sequence (wt) from DENV-1__HQ624983__SS-prME
ucugugaccaugcuccuuaugcuggugccuacagccuuggcguuccauuugaccacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaaaugcccucgaaucucugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaacugaaacguggauguccucugaaggcgcuuggaaacagauacaaagaguggagacuugggcccugagacacccaggauucacggugauagcccuuuuucuagcacaugccauaggaacauccaucacccagaaagggauuauuuucauuuuguuaaugcugguaacaccauccauggcaaugcgaugugugggaauaggcagcagggacuucguagaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaauaccaccacugacucaagauguccaacacaaggagaagccacacugguagaagaacaagacgcgaacuuugugugucgacgaacguuuguggacagaggcuggggcaauggaugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacgucacaagagacuuggaacagacaagauuugcuggugacauucaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagauuccuuuuucgacccaagaugaaaaaggaguaacucagaauggaagacugauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagauaccgcaugggacuuugguucuauaggaggaguguucacgucuguuggaaaauuaguacaccagauuuuuggaaccgcauauggaguuuuguucagcgguguuuccuggaccaugaaaauaggaauagggguucugcugacauggcuaggauuaaacucaaggagcacgucccuuucgaugacgugcauugcaguuggcuuaguaacacuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacauuuuacuugaaaaugacaugaaauucacagugguuguaggagauguugcuggaauuuuggcucaagggaaaaaaaugauuaggccacaacccauggaauacaaguacucguggaaaagcuggggaaaggcuaaaaucauaggggcagaugugcagaacaccaccuucaucaucgacggcccaaacaccccagaaugcccugaugaccaaagagcauggaacauuugggaaguugaggacuauggauuuggaauuuucacgacgaacauauggcugaaauugcgugauuccuauacccaagugugugaccaccggcuaaugucagcugccaucaaggacagcaaggcaguucacgcugacaugggguacuggauagaaagugaaaagaacgagaccuggaagcuggcaagagccucuuucauagaagucaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaagcuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgcuuccgacagaauggggaugggaaugacguaccuagcucugauggccacuuuuaaaaugagaccaauguuugcuguaggacuauuauuccgcagacuaacauccagagaaguucuucuucuaacaauuggauugagucuaguggcaucuguggaguuaccaaauuccuuggaggagcugggggauggacuugcaaugggcauuaugauucuaaaauuauugacugacuuucaaucacaucaguugugggccaccuugcuguccuugacauuuaucaaaacaacguuuuccuugcacuaugcauggaagacaauggccaugguacugucaauuguaucucucuuucccuuaugccuguccacgaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuucucaaaaaugaugugccgcuagcugggccacugauagccggaggcaugcuaauagcauguuauguuauaucuggaagcucagccgaccuaucacuagagaaagcagcugaggucuccugggaagaagaagcagaacacucuggugccucacauaacauauuaguggagguccaagaugauggaaccaugaagauaaaggaugaagagagagaugacacgcuaaccauucuccucaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagagaacguguuccacacaauguggcaugucaccaggggagcuguacucauguaucaagggaagagacuggaaccgagcugggccagugucaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggaacaucuggaucucccaucgugaacagagaaggaaagauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcaucaaaucaggaaaugacauugccaacugcuuaagaaagaaugggaaacgggugauucaauugagcaggaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcucaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauacuagaaauagggaaacuuccacaacacuugacgcaaagggcccagaaugccuuggacaaucugguuauguugcacaacuccgaacaaggaggaagagccuauagacaugcaauggaagaacugccagacaccauagaaacguugaugcuccuggcuuugauagcuguguugacugguggagugacgcuguucuuccuaucaggaaggggccuagggaaaacaucuaucggccuacucugcgugauggcuucaagcguacugcuauggauggccaguguggagccccauuggauagcggccuccaucauacuggaauucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagauuuagggauuggccauguggcuguugaaaaucaccaccaugccgcaaugcuggacguagacuuacauccagcuucagccuggacccucuaugcaguggccacaacaauuaucacucccaugaugaggcacacaauagaaaacacaacggcaaacauuucccugacagccauugcaaaccaggcggcuauauuaaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggaccacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaucugagcaagucagaauucaacacuuauaaaaggagugggaucauggaaguggacagauccgaagccaaagagggacugaaaagaggagaaacaaccaaacaugcagugucgagaggaaccgcuaaacugaggugguuuguggagaggaaucuugugaaaccagaagggaaagucauagaccucgguuguggaagagguggcuggucauacuauugcgccgggcugaagaaagucacagaagugaagggauauacaaaaggaggaccuggacaugaggagccaauuccaauggcgaccuauggauggaaccuaguaaaacugcacuccgggaaagacguauucuuuguaccacccgagaaaugugacacccucuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaagcauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacauaugaaagagacguggaccuaggcgccggaacaagacauguagcaguggaaccagagguagccaaccuagauaucauuggccagaggauagagaacauaaaacaugaacauaagucaacauggcauuaugaugaggacaauccauacaaaacaugggccuaccauggaucauaugaggucaagccaucaggaucagccucauccauggucaauggcguggugaaacugcucaccaaaccaugggaugucauccccauggucacacaaauagccaugacugacaccacacccuuuggacaacagaggguguuuaaagagaaaguugacacacgcacaccaaaagcaaaacgaggcacagcacaaaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugcgccacguguguuuacaacaugauggggaagagagagaaaaaacuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuucagggggaaacauguaugcagaugacacagccggaugggauacaaggauaacagaggaugaccuucagaacgaggccaaaauuacugacaucauggaacccgaacaugcccuacuggcuaauucaaucuucaagcuaacauaccaaaauaaggugguaaggguacagagaccagcaaaaaauggaaccgugauggaugucauaucuagacgugaccagagaggaaguggccagguuggaacuuauggcuuaaauacuuucaccaacauggaagcccagcugauaagacagauggagucugaaggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagccgcaccaccuggucuauccaugcccaucaccaauggaugacagcagaagacaugcugucaguguggaauaggguuuggauagaggaaaacccauggauggaggacaaaacccauauauccaguugggaagauguuccauauuuaggaaaaagggaagaucaaugguguggaucccugauaggcuuaacagcaagggccaccugggccacuaacauacaaguggccauaaaccaagugagaaggcuaauugggaaugagaauuaucuagauuacaugacaucaaugaagagauucaagaacgagagugauccugaaggggcacucugguga

SEQ ID NO: 6208 - RNA, 9879 nt, Artificial Sequence
  derived and/or modified CDS sequence (wt) from DENV-1__FJ384655__SS-prME
uccgugaccaugcuccucaugcugcugcccacagcccuggcguuccauuugaccacacgagggggagagccacacaugauaguuaguaagcaggaaagaggaaagucacucuuguucaagaccucugcaggugucaauaugugcacucucauugcgauggauuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagacaaacguuccguggcacuggccccacacgugggacucggucuagaaacaagaacugaaacauggaugucuucugaaggcgccuggaaacaaauacaaaaaguggagacuugggcuuugagacacccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucgucgaaggacugucaggagcaacguggguagacgugguauuggagcauggaagcugcgucaccaccauggcaaaaaauaaaccaacauuggacauugaacucuugaagacggaggucacgaacccugccgucuugcgcaaacugugcauugaagccaaaauaucaaacaccaccaccgauucaagauguccaacacaaggagaggcuacacugguggaagaacaagacgcgaacuuugugugucgccgaacguuuguggacagaggcugggguaauggcugcggauuauucggaaaaggaagccuauugacgugugccaaguucaagugugugacaaaacuagaaggaaagauaguucaauaugaaaacuuaaaauauucagugauagucaccguccacacuggggaucagcaccaggugggaaacgagacuacagaacauggaacaauugcaaccauaacaccucaagcucccacgucggaaauacagcugacugacuacggagcccucacauuggacuguucaccuagaacagggcuggacuuuaaugagauggugcuauugacaaugaaagaaaaaucauggcuuguccacaaacaaugguuucuagacuuaccacugccuuggacuucgggggcuucaacaucccaagagacuuggaacagacaagauuugcuggucacauucaagacagcucaugcaaagaaacaggaaguagucguacugggaucacaagaaggagcaaugcacaccgcguugacuggggcgacagaaauccagacgucaggaacgacaacaaucuuugcagggcaccugaaaugcagacuaaaaauggauaaacugacuuuaaaggggacgucauaugugaugugcacaggcucauuuaagcuagagaaggaaguggcugagacccagcauggaacuguucuagugcaggucaaauacgaaggaacagaugcgccaugcaagauccccuuuucgacccaagaugagaaaggagugacccagaaugggagauugauaacagccaaucccauaguuacugacaaagaaaaaccagucaacauugagacagaaccaccuuuuggugagagcuacaucgugguaggggcaggugaaaaagcuuugaaacuaagcugguucaagaaaggaagcagcauagggaaaauguucgaagcaaccgcccgaggagcacgaaggauggcuauccugggagacaccgcaugggacuuuggcucuauaggaggaguguucacaucugugggaaaauugguacaccagguuuuuggaaccgcauaugguguucuguucagcgguguuucuuggaccaugaaaauaggaauagggauucugcugacaugguugggauuaaauucaaggagcacgucacuuucgaugacgugcauugcaguuggcaugguuacacuguaccuaggagucaugguucaagcggacucgggauguguaaucaacuggaagggcagagaacucaaauguggaaguggcauuuuugucacuaaugaaguccacacuuggacagagcaauacaaauuccaggcugacuccccaaaaagacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaagggaaaaaaaugauuaggccacaacccauggaacacaaauacucauggaaaagcuggggaaaagcuaaaaucauaggagcagacauacaaaauaccaccuucaucaucgacggcccagauacuccagaaugccccgaugaacaaagagcguggaacauuugggaaguugaggacuauggguuuggaauuuucacgacaaacauauggcugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaucuggccgaaaucccacacucuauggaguaauggaguuuuggaaagugaaaugauaaucccaaagauauauggaggaccaauaucucagcacaacuacagaccaggguauuucacacaaacagcagggccauggcaccuaggcaaguuggaauuggauuuugacuugugugaaggcaccacaguuguuguggaugaacauuguggaaaucgagguccaucucucagaacuacaacagucacaggaaagauaauccaugaaugguguugcagauccugcacgcuaccccccuuacgguucagaggagaagacggauguugguauggcauggaaaucagaccaguuaaggagaaggaggagaaccuaguuaggucaauggucucugcagggucaggagaaguggacaguuuuucauuaggaauacuaugcguaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaagauggggaugggaacaacguaccuagccuugauggcuacuuucaaaaugagaccaauguucgcuguugggcuauuauuucgcagacuagcauccagagaaguucuucuucucacgauuggauuaagccugguggcauccguggagcuaccaaauucuuuggaggagcuaggggauggacuugcaauggguaucaugauguuaaaauuauugacugaauuucagccacaccacuuauggaccaccuuacugucuuugacauuuaucaaaacaacucuuucauuggauuaugcauggaagacaacggcuaugguacugucaaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaaguucacuccucaaaaaugaugugccguuggccggcccacuaauagcuggaggcaugcuaauagcauguuaugucauauccggaagcucagccgauuuaucauuggagaaagcggcugagguauccugggaagaagaagcagaacacuccgguaccucacacaacauauuaguagagguucaagaugauggagcuaugaaaauaaaagaugaagagagggaugacacacucacuauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaggagcgguucuugaugauggcauuuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggacuugaucucauauggaggagguuggagguuucaaggaucauggaacacaggagaagaagugcaggugauagcuguugaaccaggaaaaaaccccaaaaauguacagacaacgccggguaccuucaagacuccugaaggcgaaguuggagccauagcucuagauuuuaaacccggcacaucuggaucucccaucgugagcagagagggaaaaauaguaggucuuuauggaaauggaguggugacaacaaguggaaccuacgucagugccauagcccaagcuaaagcaucacaggaagggccucuaccagagauugaggacgagguguuuaagaaaagaaacuuaacaauaauggaccuccauccaggaucaggaaaaacaagaagauaucuuccagccauaguccgugaggccauaaaaaggaaacugcguacguuaaucuuggcucccacaagaguugucgccucugaaauggcagaggcgcucaagggaaugccaauaagauaucagacaacagcagugaagagugagcacacaggaagggagauaguugaccucaugugccacgccacuuuuaccaugcgucucuuauccccagugagaguucccaauuacaacaugauuauuauggaugaagcacauuuuaccgauccagccagcauagcggccagaggguacaucucaacccgaguggguaugggugaagcagcugcgaucuuuaugacagccacucccccaggaucgguggaggcuuuuccacagagcaaugcaguuauccaagaugaggaaagagacauuccugagagaucauggaauucaggcuacgacuggaucacugauuuuccagguaaaacagucugguuuguuccaagcauuaaaucaggaaaugacauugccaacugcuuaagaaagaacggaaaacggguaauccaauugagcagaaaaaccuuugacacugaguaccagaaaacaaaaaacaaugacugggacuauguugucacaacagacauuucugaaaugggggcaaauuuccgggcugacaggguaauagacccaaggcggugcuugaaaccgguaauacuaaaagaugguccagagcguguuauucuagccggaccgaugccagugacuguggccagugcugcccaaaggagaggaagaauuggaaggaaccagaacaaggaaggugaucaguauguuuacaugggacagccuuuaaauaaugaugaggaucacgcucauuggacagaagcaaaaaugcuccuugacaauauaaacacaccagaagggaucaucccagcccucuuugagccagagagagaaaagagugcagcaauagacgggggguacagacugcggggagaagcgaggaaaacguucguggagcucaugagaagaggagaucuaccaguuuggcuauccuacaaaguugccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccacuggcccugcgcgaguuuaaagaguuugcagcaggaagaagaagugucucaggugaccuaauauuggaaauagggaaacuuccacaacauuugacgcuaagagcccagaaugcucuggauaacuuggucauguugcacaauuccgaacaaggaggaaaagccuauagacaugcuauggaggaacuaccagacaccauagaaacauugaugcuccuggcuuugauagcuguguugacugguggagugacgcuguucuuccuaucaggaaaaggucuagggaaaacauccauuggcuugcucugugugacggccucaagcgcacuguuauggauggccaguguggagccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacccucuaugcaguagccacaacaguuaucacucccaugaugagacacacaauugaaaauacaacggcaaacauuuccuugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagaccuggauccugugguuuaugaugcaaaauuugaaaaacagcuaggccaaauaauguuacugauacuuuguacaucacagauccucuugaugcggaccacaugggccuugugugaaucuaucacacuggcuacuggaccccugaccacucucugggagggaucuccaggaaaauucuggaauaccacgauagcaguguccauggcaaacaucuucaggggaaguuaucuagcaggagcaggucuggccuucucauuaaugaaaucuuuaggaggagguaggagagguacgggagcucaaggggaaacacugggagagaaauggaaaagacaguuaaaccaacugagcaagucagaauucaacaccuacaaaaggagugggauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaaccugucccaauggcgaccuauggauggaaccuaguaaagcuacacucuggaaaagauguauuuuuuaugccaccugagaaaugugacacccuucugugugauauuggugaguccucuccgaauccaacuauagaagaagguagaacguuacguguucuaaagaugguggaaccauggcucagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucaugugggacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugacugauaccacacccuuuggacaacagaggguguuuaaagagaaaguugacacgcgcacaccaagagcaaaacgaggcacagcacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaauuaggagaguuuggaaaggcaaaaggaagucgugcaauaugguauauguggcugggagcacguuuucuggaguucgaagcccuuggcuucaugaaugaagaucacugguuuaguagagagaauucacucaguggaguggaaggagaaggacugcacaaacuuggauacauacucagagacauaucaaagauuccggggggaaauauguaugcagaugauacagccggaugggauacaagaauaacagaggaugaucuucagaaugaggcuaaaaucacugacaucauggagccugaacaugcucuauuggcuacgucaauuuuuaagcugacuuaccaaaauaagguggugagggugcaaagaccagcaaaaaauggaaccgugauggauguuauauccagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauuguguagugaaaccaauugaugacagguucgcaacagccuuaauagcucugaaugacaugggaaaaguaagaaaagacauaccgcagugggaaccuucaaaaggauggaaugauuggcagcaagugccuuucuguucacaccauuuucaccaguugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuggcggcuaaugcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccaccaacauacaaguagccauaaaccaagugagaaggcucaucgggaaugagaauuaucuagauuacaugacaucaaugaagagauucaagaaugagagugaucccgaaggggcacucugguaa

SEQ ID NO: 6209 - RNA, 9879 nt, Artificial Sequence
  derived and/or modified CDS sequence (wt) from DENV-1__KC759167__SS-prME
ucugugaccaugcuccuuaugcugaugcccacagccuuggcguuccauuugaccacacgagggggagagccgcacaugauagucagcaagcaggaaagaggaaaaucacuccuguuuaagaccucagcaggugucaacaugugcacccuuauagcgauggauuugggagaguuaugugaggacacaaugacuuacaaaugcccucgaaucacugaagcugaaccagaugacguugauuguugguguaaugccacagacacaugggugaccuauggaacauguucccaaacuggcgagcaccgacgagacaaacguuccgucgcacuggcaccacacgugggacuugguuuggaaacaagaaccgaaacguggauguccucugaaggcgcuuggaaacagauacaaagaguggagacuugggcccugagacacccaggauucacagugauagcccuuuuucuagcacaugccauaggaacauccgucacucagaaagggauuauuuucauuuuguuaaugcugguaacaccauccauggccaugcgaugcgugggaauaggcagcagggacuucguggaaggacugucaggagcaaccuggguagaugugguacuggaacauggaaguugcgucaccaccauggcaaaagacaaaccaacauuggacauugaacucuugaagacggaagucacaaacccugccauccugcgcaaacuaugcauugaagcuaaaauaucaaacaccaccaccgacucaagauguccaacacaaggagaagcuccagaaguggaagaacaagacgcgaacuuugugugucgacgaacguuuguggacagaggcuggggcaauggcugcgggcucuuuggaaaagggagccuaauaacgugugccaaguucaagugugugacaaaacuggaaggaaagauaguucaauaugaaaacuugaaauauucaguaauagucaccguucacaccggagaccagcaucaggugggaaaugaaagcacagaacaugggacaacugcaaccauaacaccucaagcuccuacgacggaaauacagcugacugacuauggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucgacaucacaagagacuuggaacagacaagauuugcuggugacauuuaagacagcccaugcaaagaagcaggaaguagucgugcuaggaucacaagaaggagcaaugcacacugcguugaccggagcaacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagauugauaacagcuaacccuauaguuacugacaaagaaaaaccagucaacauugaggcaaaaccgccuuuuggugagaguugcaucguaauaggagcaggugaaaaagcuuugaaacuaagcugguuuaagaaaggaagcagcauagggaaaauguuugaggcaacugcuagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucucuuucgaugacgugcauugcaguuggucuaguaacacuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuuuaucaucgacggcccaaacaccccagaaugcccugaugaccaaagagcauggaacauuugggaaguugaggacuauggauuuggaauuuucacgacaaacauauggcugaaauugcgugauuccuauacccaagugugugaccaccggcuaaugucagcugccaucaaggacaguaaggcaguucacgcugacaugggguacuggauagaaagugaaaagaacgagaccuggaagcuggcaagagcuucuuucauagaagucaaaacauguaucuggccaaaaucccacacuuuauggagcaauggaguucuggaaagugaaaugauaauuccaaagaucuauggaggaccaauaucucagcacaacuacagaccaggauauuucacacaaacagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgccaccaccccuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaagaggugaugagauccagauggaguagaaaaaugcugaugacuggagcacuggcuguguuccuccuucucauaaugggacaauugacauggaaugaucugaucagauuaugcaucaugguuggagccaacgcuuccgacagaauggggaugggaacgacguaccuagcucugauggccacuuuuaaaaugagaccgauguuugcuguagggcuauuauuucgcaaacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuaugcauggaagacaauggcuaugguacugucgauuguaucucucuuccccuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaagcucacuucucaaaaaugaugugccgcuagcugggccacuaauagcuggaggcauguuaauagcauguuauguuauaucuggaagcucagccgaccuaucacuagagaaagcggcugaggucuccugggaagaagaagcagaacacucuggugccucacacaacauacuaguggagguccaagaugauggaaccaugaagauaaaggaugaagagagagaugacacgcuaaccauucuccuuaaagcaacucugcuagcgguuucagggguguacccauuaucaauaccagcgacccuuuucgugugguacuuuuggcggaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccagugucaaaaaagacuugaucucauauggaggagguuggaggcuucaaggauccuggaacacaggagaaggagugcaggugauugcuguugaaccagggaaaaaccccaaaaauguacaaacagcgccgggcaccuuuaagaccccugaaggugaaguuggagcuauugcccuagauuuuaaacccggcacaucuggaucucccaucgugaacagagaaggaaaaauaguaggucuuuauggaaauggaguagugacaacaaguggaacuuacgucagugccauagcucaagccaaggcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcguacacuaauucuggcucccacaaggguugucgcuuccgaaauggcagaggcgcucaagggaaugccaauaagauaccaaacaacagcagugaagagugaauacacaggaaaagagauaguugaccucaugugucaugccacuuucaccaugcgccuccugucucccgugagaguucccaauuacaacaugauuauuauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguaauccaagaugaggaaagagacauuccugagagaucauggaacucaggcuaugaguggaucacugacuucccagguaaaacaguuugguuuguuccaagcauuaaaucaggaaaugacauagccaacugcuuaagaaagaaugggaaacgggugauucaauugagcaggaaaaccuuugauacagaguaccaaaaaacaaaaaacaacgacugggacuaugucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccggagagagaaaagagugcagcaauagacggggaauacagacugcggggugaggcaaggaaaacguauguggagcucaugagaagaggagaucuaccuguuuggcuaucuuacaaaguugccucagaaggcuuccaguacucugacagaagaugguacuuugacggggaaaggaacaaccagguguuggaggagaacauggacguggagaucuggacaaaagagggagaaagaaagaaacuacgaccccgcuggcuggaugccagaacauacucagacccacuagcccugcgcgaguuuaaagaguuugcagcagggagaagaagcgucucaggugaucuaauauuggaaauagggaaacuuccacaacacuugacgcaaagggcccagaaugccuuggacaaccugguuauguugcacaacuccgaacaaggaggaagagccuacagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaucagcuggcauauguggugauagguuuguuauucaugauacugacaguagcagccaaugagaugggacugcuggaaaccacaaagaaagacuuagggauuggccauguggcuguuggaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaagggauggccaauaucgaagauggacauaggaguuccacuucucgccuugggcugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugaugggauuguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaaguuagaauuuaacuccuauaaaaggagugggauuauggaaguggacagauccgaagccaaagagggauugaaaagaggagaaacaaccaaacaugcagugucgagaggaaccgcuaaacugagaugguuuguggagaggaaccuugugaaaccagaagggaaagucauagaccucgguuguggaagaggcggcuggucauacuauugcgcugggcugaagaaagucacagaagugaagggauauacaaaagggggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauucugcauaaaaauucugaaucccuacaugccaagugugguggaaacucuggagcaaaugcaaagaaaacauggaggaaugcuagugcgaaauccacucucaagaaauucuacucaugaaauguacuggguuucauguggaacaggaaacauugugucagcaguaaacaugacaucuagaauguugcuaaaucgauucacaauggcucacaggaaaccaacauaugaaagagauguggaccuaggcgcuggaacaagacauguggcaguggaaccagagguagcuaaccuagauaucauuggccagaggauagagaacauaaaacaugaacauaagucaacauggcauuaugaugaggacaauccauauaaaacaugggccuaucacggaucauaugaggucaagccaucaggaucauccucauccauggucaauggcguggugaaacugcucaccaagccaugggaugucauccccauggucacacaaauagccaugacugacacuacacccuuuggacaacagaggguguuuaaagagaaaguugacacacgcacaccaaaagcaaaacgaggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuacacaaacagggaaaaugugccacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacugaggaugaccuucagaaugaggccagaauuacugacaucauggaacccgaacaugcccuacuggcuaagucaaucuucaagcugaccuaccaaaauaaggugguaaggguacagagaccagcaaaaaauggaacugugauggaugucauauccagacgugaccagagaggaaguggccaggucggaacuuauggcuuaaacacuuucaccaacauggaagcccagcugauaagacaaauggagucugaggaaaucuuuucacccagcgaauuagagaccccaaauuuagccgagagaguucucgacuggcuggaaaaauauggcaucgaaaggcugaaaagaauggcaaucagcggagaugauugcguggugaaaccaauugauaauagguuugcaacagccuuaacagcucugaaugacaugggaaaaguaagaaaggauauaccacaaugggaaccuucaaaaggauggaaugauuggcaacaagugccucuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacagauguggcagcugauguacuuccacaggagagaccugagacuagccgcuaaugcuaucuguucagccguuccaguugauuggaucccaaccagccgcaccaccuggucgauccaugcccaucaccaauggaugacaacagaagacaugcugucaguauggaauaggguuuggauagaggaaaacccauggauggaggacaaaacccauauauccaguuggggagauguuccauauuuagggaaaagggaagaucaaugguguggaucccugauaggcuuaacagcaagggccaccugggccaccaacauacaaguggccauaaaccaagugagaagacuaauugggaaugagaauuaccuagauuacaugacaucaaugaagagauucaagaacgagagugaucccgaaggggcacucugguga

SEQ ID NO: 6210 - RNA, 9879 nt, Artificial Sequence
  derived and/or modified CDS sequence (wt) from DENV-1__JQ048541__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuaugugaggacacaaugacuuacaaaugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccuccgaaggcgcuuggaaacagauacaaagaguggagacuugggcccugagacacccaggauucacggugauagcccuuuuucuagcacaugccauaggaacauccaucacccagaaagggauuaucuucauuuuguuaaugcugguuacaccauccauggccaugcgaugcgugggaauaggcagcagggacuucguggaaggacugucaggagcaacuuggguagaugugguguuggaacauggaaguugcgucacuaccauggcaaaagauaaaccaacauuggacauugaacucuugaagacggaagucacaaacccugccgucuugcgcaaacugugcauugaagcuaaaauaucaaacaccaccaccgacucaagauguccaacacaaggagaagccacauugguggaagaacaagacgcgaacuuugugugucgacgaacguuuguggacagaggcuggggcaauggcugugggcucuucggaaaaggaagccuuauaacgugugcuaaguucaagugugugacaaaacuggaaggaaaaauaguucaauaugaaaacuugaaauauucaguaauagucaccguccacacuggagaccagcaccaggugggaaaugaaagcacagaacaugggacaacugcaaccauaacaccucaagcuccuacgacagaaauacagcugaccgacuacggagcucuuacauuggauuguucaccuagaacaggacuggacuucaaugaaaugguguuguugacaaugaaagaaaaaucauggcuaguccacaaacaaugguuucuagaccuaccacugccuuggaccucgggagcuucaacaucacaagaaacuuggaacagacaagauuugcuggugacauuuaagacagcucaugcaaagaagcaggaaguagucguacuaggaucacaagaaggagcaaugcacacugcguugaccggagcgacggaaauccaaacgucuggaacgacaacaauuuuugcaggacacuugaaauguagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuuugacccaagaugaaaaaggaguaacccagaaugggagauugauaacagccaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcaguuggccuaguaacgcuauacuuaggagucaugguucaggcggauucaggauguguaauuaauuggaaagguagagaacucaaauguggaaguggcauuuuugucaccaaugaaguucacacuuggacagagcaauacaaauuucaagcugauuccccaaagagacuaucagcagccauugggaaggcaugggaggaggguguguguggaauucgaucagcaacucgucucgagaacaucauguggaagcaaauaucaaaugaauugaaccacaucuugcuugaaaaugacaugaaauucacagugguuguaggagauguugcugggaucuuggcucaaggaaaaaaaaugauuaggccacaacccauggaacacaaauacucguggaaaagcuggggaaaggcuaaaaucauaggggcagauguacagaacaccaccuuuaucaucgacggcccaaacaccccagaaugcccugaugaucaaagagcauggaacauuugggaaguugaggauuauggauuuggaauuuucacgacaaacauauggcugaaauugcgcgacuccuacacccaagugugugaccaccggcuaaugucagcugccauuaaggacagcaaggcaguucacgcugacaugggguacuggauagaaagugaaaagaacgagaccuggaagcuggcaagagccucuuucauagaagucaaaacauguaucuggccaaaaucucacacucuauggagcaauggaguucuggaaagugaaaugauaauuccaaagaucuauggaggaccaauaucucagcacaaacucagaccaggauauuucacacaaacggcagggccguggcaccuaggcaaguuggaacuggauuuugauuugugugaggguaccacgguuguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccagucaaggaaaaggaagagaaucuagucaaaucaauggucucugcagggucaggggaaguggacagcuuuucacuaggacuguuaugcauaucaauaaugaucgaagaggugaugagauccagauggaguagaaaaaugcugaugacuggaacacuggcuguguucuuccuucucauaaugggacaacugacauggaaugaucugaucagaucaugcaucaugguuggagccaacgcuuccgacaggauggggaugggaacgacguaccuagcucugauggccacuuuuaaaaugagaccaauguuugccguagggcuacuauuccgcagacuaacauccagagaaguucuucuucuaacaauuggauugagucuaguggcaucuguggaguuaccaaauuccuuggaggagcugggggauggacuugcaaugggcauuaugaucuuaaaauuauugacugacuuucaaucacaucaguugugggcuaccuugcuguccuugacauuuaucaaaacaacguuuuccuugcacuaugcauggaagacaauggcuaugguacugucaauuguaucucucuuccccuuaugccuguccacgaccucccaaaaaacaacauggcuuccggugcuguugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccauugauagcuggaggcaugcuaauagcauguuaugucauaucuggaagcucagccgaucuaucacuagagaaagcggcugaggucuccugggaagaagaagcagaacacucuggugccucacacaacauauuaguggagguccaagaugauggaacuaugaagauaaaggaugaagagagagaugacacgcuaaccauucuccucaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugauggcaucuauagaaucaugcagagaggacuguugggcaggucccaaguggggguaggaguguuucaagaaaacguguuccacacaauguggcaugucaccaggggagcuguacucauguaucaagggaagagacuggaaccgagcugggccagugucaaaaaagaccuaaucucauauggaggagguuggaggcuucaaggauccuggaacacgggagaagaagugcaggugauugcuguugaaccagggaaaaaccccaaaaauguacaaacagcgccgggcaccuuuaagaccccugaaggcgaaguuggagccauugcccuagauuuuaaacccggcacaucuggaucucccaucgugaacagagaagggaaaauaguaggucuuuauggaaauggaguggugacaacaaguggaaccuacgucagugccauagcucaagccaaagcaucacaagaagggccccuaccagagauugaagacgagguguuuaggaaaagaaacuuaacaauaauggaccugcauccaggaucgggaaaaacaagaagauaccuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccagcauagcggcuagaggguacaucucaacccgagugggcaugggugaagcagcugcgaucuucaugacagccacucccccaggaucaguggaggccuuuccacagagcaacgcaguuauucaagaugaggaaagagacauuccugagagaucauggaauucagguuaugaguggaucacugacuucccaggcaaaacaguuugguuuguuccaagcauuaaaucaggaaaugauauugccaacugcuuaagaaagaaugggaaacgggugauucaauugagcaggaaaaccuuugacacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuauaugggacagccuuuaaacaacgaugaagaucacgcucacuggacggaagcaaaaaugcuccuugauaauauaaacacaccagaaggaauuaucccagcccucuucgagccggagagagaaaagagugcggcaauagacggggaauacagacugcggggugaagcaaggaaaacguuuguggagcucaugagaagaggagaucuaccugucuggcuauccuacaaaguugccucagaaggcuuccaguacucugauagaagauggugcuuugacggggaaaggaacaaccagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuggaaauagggaaacuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggaguaacgcuguucuuccuaucaggaaggggcuuagggaaaacaucuaucggccuacucugcgugauggcuucaagcguacugcuauggauggccaguguagagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacagcaaacauuucccugacagccaucgcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcccauuacgcuauaauuggaccuggacugcaagcaaaagcuacuagagaagcucaaaaaaggacagcggccggaauaaugaaaaauccaaccguugauggaaucguugcaauagauuuggacccugugguuuaugaugcgaaauuugagaaacaacuaggccaaauaaugcuguugauacuaugcacaucacagauccucuugaugcggacuacaugggccuugugcgaauccaucacacuggccacuggaccucugaccacgcucugggagggaucuccaggaaaauuuuggaacaccacgauagcaguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacaccuauaaaaggagugggauuauggaaguggacagauccgaagccaaagagggacugaaaagaggagaaacaaccaaacaugcagugucgagaggaaccgcuaaauugaggugguuuguggagaggaaccuugugaaaccagaagggaaagucauagaccuugguuguggaagagguggcuggucauacuauugcgcugggcugaagaaagucacagaagugaagggauacacaaaaggaggaccuggacacgaagaaccaaucccaauggcgaccuauggauggaaccuaguaaagcuguacuccgggaaagacguauucuuuaugccaccugagaagugugacacccuuuugugugauauuggugaguccucuccaaacccaacuauagaggaaggaagaacgcuacgcguccuaaagaugguggaaccauggcucagaggaaaccaauuuugcauaaaaguucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucauaggaaaccaacauaugaaagagacguggaccuaggcgccggaacaagacauguggcaguggaaccagagguagccaaccuagauauuauuggccagaggauagagaacauaaaacaugaacacaagucaacauggcauuaugaugaggacaauccauauaaaacaugggccuaucauggaucauaugaggucaagccaucaggaucagccucauccauggucaaugguguggugaaacugcucaccaaaccaugggaugucauccccauggucacacaaauagccaugacugacacuacacccuuuggacaacagaggguguuuaaagagaaaguugacacacgcacaccaaaagcaaaacgaggcacagcacaaaucauggaggugacagccaggugguuaugggguuuucuuucuagaaacaagaagccaagaauuuguacaagagaggaguucacaagaaaagucaggucaaacgcagccaucggagcaguguuuauugacgaaaaucaauggaacucagcaaaagaagcaguggaagaugagcgguucugggaccuugugcacagagagagggagcuucacaaacagggaaaaugugccacguguguuuacaacaugauggggaagagagagaaaaagcuaggagaauuuggaaaggcaaaaggaagucgugcaauaugguacaugugguugggagcacgcuuucuagaguucgaagcucuugguuucaugaacgaagaccacugguucagcagagagaacucacucagcggaguggaaggagaaggacuccacaaacuuggauauauacucagagacauaucaaagauuccagggggaaacauguaugcugaugacacagccggaugggauacaaggauaacagaggaugaccuucagaaugaggccaaaauuacugacaucauggaacccgaacaugcccuacuagcuaaggcaaucuucaagcuaaccuaccaaaauaaagugguaaggguacagagaccagcaaaaaauggaacugugauggaugucauuuccagacgugaccagagaggaaguggccaggucggaacuuauggcuuaaacacuuucaccaacauggaagcccagcugauaagacaaauggagucugagggaaucuucucaccuagugaauuagagaccccaaauuuggccgagagaguucucgacuggcuggaaaaauauggcgucgaaaggcuaaaaagaauggcaaucaguggagaugacugcguagugaaaccaauugaugauagguuugcaacagccuuaacagcucugaaugauaugggaaaaguaagaaaagauauaccacaaugggaacccucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggggccugagagaaaccgcaugccuaggcaaaucauaugcacaaauguggcagcugauguacuuccacaggagagaccugagacuagcugcuaaugcuaucuguucagccguuccaguugauugggucccaacuagccgcaccaccuggucgauccaugcccaucaccaauggaugacaacagaagacaugcugucaguguggaauaggguuuggauagaggaaaacccauggauggaggacaaaacccauauauccaguugggaagauguuccauauuuagggaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6211 - RNA, 9879 nt, Artificial Sequence
  derived and/or modified CDS sequence (wt) from DENV-1__JN697056__SS-prME
ucugugaccaugcuccucaugcugcugcccacagcccugacguuccauuugaccacccgagggggagagccgcacaugauaguuagcaaacaggaaagaggaaagucacucuuguuuaagaccucugcaggugucaacaugugcacccuuauugcaauggaccugggagaguuaugugaugacacgaugaccuacaaaugcccccggaucacugagacggaaccagaugacguugacuguuggugcaaugccacagagacgugggugaccuauggaacauguucucaaaccggugaacaccgacgagacaaacguuccguugcacuggcaccacacauagggcuuggucuggaaacaagaaccgaaacguggauguccucugaaggcgcuuggagacaaauacaaaaaguggagacaugggcccugagacacccaggauucacggugauagcccuuuuucuagcacaugccauaggaacauccaucacucagaaagggauuauuuucauuuugcugaugcugguaacuccauccauggccaugcggugcgugggaauaggaaacagagacuucguggaaggacugucaggagcuacguggguggauguaguacuggagcauggaaguugcgucacuaccauggcaaaagacaaaccaacacuggacauugaacucuugaagacggaggucacaaacccugccguccugcgcaaacugugcauugaagccaaaauaucaaauaccaccacugauucgagauguccgacacaaggagaagccacgcugguggaagaacaagacacgaacuuugugugucgacgaacguucguggacagaggcuggggcaaugguuguggacuauucggaaaagguagcuuaauaacgugugcuaaguuuaagugugugacaaaauuggaaggaaagauaguccaauaugaaaacuuaaaauacucagugaucguuaccguccacacuggagaccagcaccaaguuggaaaugagaccacagaacauggaacaauugcaaccauaacaccucaagcucccacgucggaaauacaacugacagacuacggagcucugacauuggacuguucacccagaacagggcuagacuuuaaugagaugguguuguugacaaugaaagaaaaaucauggcucguccacaaacaaugguuuuuagaccuaccacugccuuggaccucaggggcuucaacaucccaagagacuuggaauagacaagacuugcuggucacauuuaagacagcucaugcaaagaagcaggaaguagucguacuaggaucacaagaaggagcaaugcauacugcguugacuggagcuacagaaauccaaacgucuggaacgacaacaauuuuugcaggucaucugaaaugcagacuaaaaauggacaaacugacucuaaaaggaauaucauauguaaugugcacaggcccauucaaguuagagaaggaaguggcugagacccagcauggaacuguucuaguacagguuaaauacgaaggaacagaugcaccaugcaagauccccuucucgucccaagaugagaagggaguaacccagaaugggagauugguaacggccaaccccauagucacugacaaagaaaaaccagucaacauugaggcggagccaccuuuuggugagagcuacaucgugguaggagcaggagaaaaagcuuugaaacuaagcugguucaagaagggaagcagcauagggaaaauguuugaagcaacugcccguggagcacgaaggauggccauccugggagacaccgcaugggacuucgguucuauaggaggaguguucacgucugugggaaaacugguacaccagauuuuuggaacugcguacggaguuuuguucaguggugucucuuggaccaugaaaauaggaauagggauucugcugacauggcugggauuaaacucaaggagcacgucucuuucaaugacguguaucgcaguuggcaugaucacacuguaccuaggagucaugguccaggcggacucgggauguguaaucaacuggaaaggcagagaacucaaauguggaagcggcauuuuugucaccaaugaaguucacaccuggacagagcaauauaaauuucaggccgacuccccaaagagacuaucagcagccauugggaaggcaugggaggaagguguguguggaauucgaucagccacucgucuugagaacaucauguggaagcaaauaucaaaugaauuaaaccacaucuuacuugaaaaugacaugaaauuuacaguggucguaggagacguuaguggaaucuuggcccagggaaagaaaucgauuaggccacaacccauggaacauaaauacucguggaaaagcuggggaaaagccaaaaucauuggagcagauguucagaacaccacuuucaucaucgacggcccaaacaccccagaaugcccugaugaccaaagagcauggaacaucugggaaguugaagauuauggauuuggaauuuucacgacaaacauaugguugaaauugcgugacuccuacacccaagugugugaucaucgacuaaugucagcugccaucaaggauagcaaagcaguccaugcugacaugggguacuggauagaaagugaaaagaacgagacuuggaaguuggcaagagccuccuucauagaagucaagacaugcaucuggccaaagucccacacucuauggagcaauggaguccuggaaagugagaugauaaucccaaagauauauggaggaccaauaucucagcauaauuacagaccaggauauuucacacaaacagcaggaccguggcacuuaggcaaguuggaacuagauuuugauuugugugaagguaccacaguuguuguggaugaacacuguggaaauagaggaccaucucuuagaaccacaacagucacaggaaagauaauccaugaauggugcuguagaucuugcacguuacccccccuacguuucaaaggagaagaugggugcugguauggcauggaaaucagaccagucaaggagaaggaagagaaccuagucaagucaauggucucugcagggucaggagagguggacaguuuuucacuaggacuguuaugcauaucaauaaugaucgaagagguaaugagauccagauggagcaagaaaaugcugaugacuggaacauuggcuguguuccuccuucucacaaugggacaauugacauggaacgaucugaucaggcuaugcaucaugguuggagccaaugcuucagacaauauggggaugggaacaacguacuuagcuuugauggccacuuucagaaugagaccaauguucgcagucgggcuauuauuucgcagauuaacaucuagagaaguucuucuucuuacgguuggauugagucugguggcaucuguagaacuaccaaauuccuuagaggagcuaggggauggacuugcaaugggcaucaugauauuaaaauuacuaacugauuuucaaucacaucagcuaugggccaccuugcugucucugacauuugucaaaacaaccuuuucauugcacuacgcauggaagacaauggcuaugauacugucaauuguaucucuccucccuuuaugccuguccacgacuucucaaaaaacgacauggcuuccggugcuucuggggucucuuggaugcaaaccacuaaccauguuucucauaacagaaaacaaaaucuggggaaggaaaaguuggccucucaaugaaggaaucauggcuguuggaauaguuagcauucuacuaagcucacuucucaaaaaugaugugccacuagcuggcccauuaauagcuggagggaugcuaauagcauguuauguuauauccggaagcucagccgauuuaucacuggagaaagcggcugaggucuccugggaagaagaagcagaacacucuggugccucacacaauauacuaguggagauccaagaugauggaaccaugaagauaaaagaugaagagagagaugacacgaucaccauccuccucaaagcaaccuugcuagcaaucucagggguauacccaaugucaauaccggcgacucucuuugugugguauuuuuggcagaaaaggaaacagagaucaggagugcuaugggacacaccaagcccuccagaaguggaaagagcaguccuugaugauggcauuuauagaauucuccaaagaggauuguugggcaggucucaaguaggaguaggaguuuuccaagaaggcguauuccacacaauguggcaugucaccaggggagcuguucucauguaccaagggaagagauuggaaccaaguugggccagugucaaaaaagacuugaucucauauggaggagguuggagguuucaaggauccuggaacacgggagaagaagugcaggugauugcuguugaaccggggaagaacccaaaaaauguacagacagcgccggguaccuucaagaccucugaaggcgaaguuggagccauagcucuagacuuuaaacccggcacaucuggaucuccuaucgugaacagagagggaaaaauaguaggucuuuauggaaauggaguggugacaacaaguggaaccuaugucagugcuauagcucaagcuaaagcaucacaagaagggccuuugccagagauugaagacgagguguuuaggaaaagaaaccuaacaauaauggaccuacacccaggaucgggaaaaacaagaagauaccuuccagccauaguccgugaggccauaaaaagaaaacugcgcacgcuaguuuuagcucccacaaggguugucgccucugaaauggcagaggcgcucaagggaaugccaauaagguaucagacaacagcagugaagagugaacacacgggaagggagauaguugaccuuaugugucacgccacuuucacuaugcgucuccugucuccugugagaguuccuaauuacaacaugauaaucauggaugaagcacauuucaccgauccagccagcauagcagccagaggguacaucucaacccgaguggguaugggugaagcagcugcgauuuucaugacagccacucccccuggaucgguggaggccuuuccacagagcaaugcaguuauccuagaugaggaaaaagacauuccugaaagaucauggaauucaggcuaugacuggaucacugauuuuccagguaaaacagucugguuuguuccaagcaucaaaucaggaaaugacauugccaacuguuuaagaaagaaugggaaacgggugauccaauugagcagaaaaacuuuugacacugaguaccagaaaacaaaaaauaacgacugggacuauguugucacaacagacauuucugaaaugggagcaaacuuucgagccgacagggugauagacccaaggcgaugccugaaaccgguaauacugaaagaugguccagagcgugucauucuagccggaccgaugccagugacuguggcuagcgccgcccagaggagaggaagaauuggaaggaaccaaaauaaggaaggugaucaguauauuuacaugggacagccuuuaaauaaugaugaggaccacgcccauuggacagaagcaaaaaugcuccuugacaacauaaacacaccagaagggaucaucccagcccucuuugagccggaaagagaaaagagugcugcaauagacggggaauacagacuacggggugaagcgaggaaaacguuuguggagcucaugagaagaggagaucuaccugucuggcuaucuuacaaaguugccucagaaggcuuccaauacuccgacagaaggugguguuuugacggggaaaggaacaaccagguguuggaggagaauauggacguggagaucuggacaaaagaaggagaaagaaagaaacuacgaccucgcuggcuggaugccagaacauacucugacccacuggcuuugcgcgaauucaaagaguucgcagcaggaagaagaagugucucaggugaccuaauauuagaaauagggaaacuuccacaacaucuaacgcaaagggcccagaaugcuuuggacaauuugguuaugcugcacaacucugaacaaggaggaaaagcuuauagacacgccauggaagaauugccagacaccauagagacgcugaugcuccuagcucugauagcugugcugacugguggagugacgcuguucuuccuaucaggaagaggcuuagggaaaacaucuauuggccuacucugcgugauguccucaagugcacuguuauggauggccaguguggagccccauuggauagcggccucuaucauacuggaguucuuucugaugguguugcuuauuccagagccagacagacagcgcacuccacaagacaaccaguuagcauauguggugauagguuuguuauucaugauauugacaguggcagccaaugagaugggauuauuagaaaccacaaagaaagaccuggggauuggucaugcagcugcugaaaaccaccaccacgccgcaaugcuggacguagacuuacauccagcuucagccuggacucucuacgcaguggccacaacgauuaucacucccaugaugagacacacaauugaaaacacaacggcaaacauuucccugacagccauugcaaaccaggcagcuauauugaugggacuugauaagggauggccaauaucaaagauggacauaggaguuccacuucucgccuuggggugcuauucucaggugaacccgcugacgcugacagcggcgguacugaugcuaguggcucauuaugccauaauuggaccaggacugcaagcaaaagccacuagagaagcucaaaaaaggacagcagccggaauaaugaaaaacccaacugucgacgggaucguugcaauagauuuagacccugugguuuaugaugcaaaauuugaaaaacagcuaggccaaauaauguuguugauacuuugcacaucucagauucucuugaugcggaccacaugggccuugugugaauccaucacacuggccacaggaccucugaccacgcuuugggagggauccccaggaaaauuuuggaacaccacgauagcgguguccauggcaaacauuuuuagggggaguuaucuagcaggagcgggucuggccuuuucauuaaugaaaucucuaggaggagguaggagagggacgggagcccaaggagaaacgcugggagaaaaguggaaaagacagcuaaaccaauugagcaagucagaauuuaacauuuacaagaggagugguauuguagagguggauagaucugaagccaaggagggguugaaaagaggagaaacaaccaaacacgcagugucgagaggaacggccaaacugaggugguuuguggagaggaaccuugugaaaccagaagggaaagucauagaccucggcuguggaagagguggcuggucauauuacugcgcugggcugaagaaagucacagaagugaaaggauauacaaaaggaggaccuggacaugaggaaccaaucccaauggcaaccuauggauggaaccuaguaaagcuauacuccgggaaagacguauucuuuauaccaccugaaaaaugugacacccuuuugugugauauuggugaguccucuccgaacccgacuauagaagaaggaagaacguugcguguucuaaagaugguagaaccauggcucagaggaaaccaauuuugcauaaagauucuaaaucccuacaugccgagugugguagaaacucuggagcaaaugcaaagaaaacauggaggaaugcuagugcgaaauccacucucaagaaacuccacucaugaaauguacuggguuucauguggaacaggaaacauugugucagcaguaaauaugacaucuagaaugcugcuaaaucgauucacgauggcucacaggaagccaacauaugaaagagauguggaccugggcgcuggaacgagacauguggcaguagaaccagagguggccaaccuagacaucauuggccagaggauagagaauauaaaaaaugaacacaaaucaacauggcauuaugaugaggacaauccguacaaaacaugggccuaucauggaucauaugaggucaagccaucaggaucagccucauccauggucaaugguguggugagacugcuaaccaaaccaugggaugucauucccauggucacacaaauagccaugacugacaccacacccuuuggacaacaaaggguguuuaaagagaaaguugacacgcguacaccaaaagcgaaacgaggcacagcacaaauuauggaggugacagccaagugguuaugggguuuccucuccagaaacaaaaaacccagaaucugcacaagagaggaguucacaagaaaagucaggucaaaugcagcuauuggagcgguguucguugaugaaaaucaauggaacucagcaaaagaggcaguggaagaugaaagguucugggaucuugugcgcagagagagggagcuucauaaacaaggaaaaugugccacgugugucuacaacaugauggggaagagagagaaaaaauuaggagaguucggaaaggcuaaaggaagucgcgcaauaugguacaugugguugggagcgcgcuucuuagaguuugaagcccucggcuucaugaaugaagaucacugguucagcagagagaauucacucaguggaguggaaggagaaggacuccacaaacuuggauacauacucagagacauaucaaagauuccagggggaaauauguaugcagaugauacagccggaugggacacaagaauaacagaggaugaucuucagaaugaggccaaaaucacugacaucauggaaccugaacaugcccuacuggccacgucaaucuuuaaguuaaccuaccaaaacaagguuguaagggugcagagaccagcaaaaaauggaaccgugauggaugucauuuccaggcgugaccagagaggaaguggacagguuggaacuuauggcuuaaacaccuucaccaacaugggggcccaacuaauaagacaaauggagucugagggaaucuuuuuacccagugaauuggaaacuccaaauuuagcuggaagaguccuugacugguuggaaaaacauggcauugagaggcugagaagaauggcaaucaguggagaugacugcguggugaaaccaauugaugacagauuugcaacagccuuaacagccuugaaugacaugggaaagguaagaaaagacauaccgcaaugggaacccucaaaaggauggaaugauuggcaacaagugccuuucugcucacaccacuuccaccagcugauuaugaaggaugggagggaaauaguggugccaugccgcaaccaagaugagcugguagguagggccagaguaucacaaggagccggauggagcuugagagaaacugcaugucugggcaagucguaugcacaaauguggcagcugauguacuuccacaggagagacuugagauuagcggcuaaugcuauuuguucagcuguuccaguugauugggucccaaccagucgcaccaccuggucgauccaugcccaccaucaauggaugacaacagaagacauguugucaguguggaauaggguuuggauagaggaaaacccauggauggaggauaaaacucacguguccagcugggaagauguuccauaccuagggaaaagggaagaucaaugguguggaucccuaauaggcuuaacagcacgagccaccugggccaccaacauacaaguggccauaaaccaagugagaaggcucauugggaaugagaauuaucuagacuacaugacaucaaugaagagauucaaaaacgagagugaucccgaaggggcacucugguaa

SEQ ID NO: 6212 - RNA, 9879 nt, Artificial Sequence
  derived and/or modified CDS sequence (wt) from DENV-1__JN697057__SS-prME
ucugugaccaugcuccuuaugcugaugccuacagccuuggcguuccauuugacuacccgagggggagagccucacaugauagucagcaagcaggaaagaggaaagucacuuuuguuuaagaccucagcaggugucaacauaugcacccuuauagcgauggauuugggagaguuaugugaggacacaaugacuuacaaaugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccuccgaaggcgcuuggaaacagauacaaagaguggagacuugggcccugagacacccaggauucacggugauagcccuuuuucuagcacaugccauaggaacauccaucacccagaaagggauuaucuucauuuuguuaaugcugguuacaccauccauggccaugcgaugcgugggaauaggcagcagggacuuuguggaaggacuguccggagcaacuuggguagauguggugcuggaacauggaaguugcgucacuaccauggcaaaagauaaaccaacauuggacauugaacucuugaagacggaagucacaaacccugccguccugcguaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuuauaacgugugcuaaguucaagugugugacaaaacuggaaggaaaaauaguucaauaugaaaacuugaaauauucaguaauagucaccguccacacuggagaccagcaccaggugggaaaugaaagcacagaacaugggacaacugcaaccauaacaccucaagcuccuacgacagaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagaaacuuggaauagacaagauuugcuggugacauuuaagacagcucaugcaaagaagcaggaaguagucguacuaggaucacaagaaggagcaaugcacacugcguugaccggagcgacggaaauccaaacgucuggaacgacaacaauuuuugcaggacacuugaaauguagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagccaaccccauagucacugacaaagaaaaaccagucaacauugaggcagaaccgccuuuuggugagaguuacaucgugauaggagcaggugaaaaagcuuugaaaguaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcaguuggccuaguaacgcuauacuuaggagucaugguucaggcggauucaggauguguaauuaauuggaaagguagagaacucaaauguggaaguggcauuuuugucaccaaugaaguucacacuuggacagagcaauacaaauuucaagcugauuccccaaagagacuaucagcagccauugggaaggcaugggaggaggguguguguggaauucgaucagcaacucgucucgagaacaucauguggaagcaaauaucaaaugaauugaaccacaucuugcuugaaaaugacaugaaauucacagugguuguaggagauguugcugggaucuuggcucaaggaaaaaaaaugauuaggccacaacccauggaacacaaauacucguggaaaagcuggggaaaggcuaaaaucauaggggcagauguacagaacaccaccuuuaucaucgacggcccaaacaccccagaaugcccugaugaucaaagagcauggaacauuugggaaguugaggauuauggauuuggaauuuucacgacaaacauauggcugaaauugcgugacuccuacacccaagugugugaccaccggcuaaugucagcugccaucaaggacagcaaggcaguucacgcugacaugggguacuggauagaaagugaaaagaacgagaccuggaagcuggcaagagccucuuucauagaagucaaaacauguaucuggccaaaaucucacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacgguuguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccagucaaggaaaaggaagagaaucuagucaaaucaauggucucugcagggucaggggaaguggacagcuuuucacuaggacuacuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugccguagggcuacuauuccgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcuguggguuaccuugcuguccuugacauuuaucaaaacagcguuuuccuugcacuaugcauggaagacaauggcuaugguacugucaauuguaucucucuuccccuuaugccuguccacgaccucccaaaaaacaacauggcuuccggugcuguugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuaugucauaucuggaagcucagccgaucuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugauggcaucuauagaaucaugcagagaggacuguugggcaggucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccccugaaggcgaaguuggagccauugcccuagauuuuaaacccggcacaucuggaucucccaucgugaacagagaaaggaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccugcauccaggaucgggaaaaacaagaagauaccuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccagcauagcggcuagaggguacaucucaacccgagugggcaugggugaagcagcugcgaucuucaugacagccacucccccaggaucaguggaggccuuuccacagagcaacgcaguuauccaagaugaggaaagagacauuccugagagaucauggaacucagguuaugaguggaucacugacuucccaggcaaaacaguuugguuuguuccaagcauuaaaucaggaaaugauauugccaacugcuuaagaaagaaugggaaacgggugauucaauugagcaggaaaaccuuugacacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuauaugggacagccuuuaaacaacgaugaagaucacgcucacuggacggaagcaaaaaugcuccuugauaauauaaacacaccagaaggaauuaucccagcccucuucgagccggagagagaaaagagugcagcaauagacggggaauacagacugcggggugaagcaaggaaaacguuuguggagcucaugagaagaggagaucuaccugucuggcuauccuacaaaguugccucagaaggcuuccaguacucugauagaagauggugcuuugacggggaaaggaacaaccagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuggaaauagggaaacuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacgcuguucuuccuaucaggaagggguuuagggaaaacaucuaucggccuacucugcgugauggcuucaagcguacugcuauggauggccaguguagagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuagcggcccauuacgcuauaauuggaccuggacugcaagcaaaagcuacuagagaagcucaaaaaaggacagcggccggaauaaugaaaaauccaaccguugauggaaucguugcaauagauuuggacccugugguuuaugaugcgaaauuugagaaacaacuaggccaaauaauguuguugauacuaugcacaucacagauccucuugaugcggacuacaugggccuugugcgaauccaucacacuggccacuggaccucugaccacgcucugggagggaucuccaggaaaauuuuggaacaccacgauagcaguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacaccuauaaaaggagugggauuauggaaguggacagauccgaagccaaagagggacugaaaagaggagaaacaaccaaacaugcagugucgagaggaaccgcuaaauugaggugguuuguggagaggaaccuugugaaaccagaagggaaagucguagaccucgguuguggaagagguggcuggucauacuauugcgcugggcugaagaaagucacagaagugaagggauacacaaaaggaggaccuggacaugaagaaccaaucccaauggcgaccuauggauggaaccuaguaaagcugcacuccgggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucauaggaaaccaacauaugaaagagacguggaccuaggcgccggaacaagacauguggcaguggaaccagagguagccaaccuagauaucauuggccagaggauagagaacauaaaacaugaacacaagucaacauggcauuaugaugaggacaauccauauaaaacaugggccuaucauggaucauaugaggucaagccaucaggaucagccucauccauggucaaugguguggugaaacugcucaccaaaccaugggaugucauccccauggucacacaaauagccaugacugacacuacacccuuuggacaacagaggguguuuaaagagaaaguugacacacgcacaccaaaagcaaaacgaggcacagcacaaaucauggaggugacagccaggugguuaugggguuuucuuucuagaaacaagaagccaagaauuuguacaagagaggaguucacaagaaaaguuaggucaaacgcagccaucggagcaguguucguugacgaaaaucaauggaacucagcaaaagaagcaguggaagaugagcgguucugggaccuugugcacagagagagggagcuucacaaacagggaaaaugugccacguguguuuacaacaugauggggaagagagagaaaaagcuaggagaauuuggaaaggcaaaaggaagucgugcaauaugguacaugugguugggagcacgcuuucuagaguucgaagcucuugguuucaugaacgaagaccacugguucagcagagagaauucacucagcggaguggaaggagaaggacuacacaaacuuggauauauacucagagacauaucaaagauuccagggggaaacauguaugcagaugacacagccggaugggauacaaggauaacagaggaugaccuucagaaugaggccaaaauuacugacaucauggaacccaaacaugcccuacuggcuaaggcaaucuucaagcuaaccuaccaaaauaaagugguaaggguacagagaccagcaaaaaauggaaccgugauggaugucauauccagacgugaccagagaggaaguggccaggucggaacuuauggcuuaaacacuuucaccaacauggaagcccagcugauaagacaaauggagucugagggaaucuuuucacccagugaauuagagaccccaaauuuagccgagagaguucucgacuggcuggaaaaauauggcgucgaaaggcuaaaaagaauggcaaucaguggagaugacugcguagugaaaccaauugaugauagguuugcaacagcccuaacagcucugaaugauaugggaaaaguaagaaaagauauaccacaaugggaacccucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaaccgcaugccuaggcaaaucauaugcacaaauguggcagcugauguacuuccacaggagagaccugagacuagcugcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccauauauccaguugggaagauguuccauauuuagggaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6213 - RNA, 9879 nt, Artificial Sequence
  derived and/or modified CDS sequence (wt) from DENV-1__HQ624984__SS-prME
ucugugaccaugcuccuuaugcugaugccuacagccuuggcguuccauuugacuacacgagggggagagccgcacaugauagucagcaagcaggaaagaggaaaaucacucuuguuuaagaccucagcaggugucaacaugugcacccuuauugcgauggauuugggagaguuaugugaggacacaaugacuuacaaaugcccucgaaucacugaagccgaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaagcgcuuggaaacagauacaaagaguggagacuugggcccugagacacccaggauucacggugauagcccuuuuucuagcacaugccauaggaacauccaucacucagaaagggauuauuuucauuuuguuaaugcugguaacaccauccauggccaugcgaugcgugggaauaggcagcagggacuucguggaaggacugucaggagcaaccuggguagaugugguacuggaacauggaaguugcgucaccaccauggcaaaagacaaaccaacauuggacauugaacucuugaagacggaagucacaaacccugccauccugcgcaaacugugcauugaagcuaaaauaucaaacaccaccaccgacucaagauguccaacacaaggagaagccacacugguggaagaacaagacgcgaauuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguucacaccggagaccagcaccaggugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagauugauaacagcuaacccuauaguuacugacaaagaaaaaccagucaacauugaggcagaaccgccuuuuggugagaguuacaucguaauaggagcaggugaaaaagcuuugaaacuaagcugguuuaagaaaggaagcagcauagggaaaauguuugaggcaacugccagaggagcacgaaggauggccauacugggagacaccgcaugggacuuugguucuauaggaggaguguucacuucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcaguuggccuaguaacacuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuuuaucaucgacggcccaaacaccccagaaugcccugaugaccaaagagcauggaacauuugggaaguugaggacuauggauuuggaauuuucacgacaaacauauggcugaaauugcgugauuccuauacccaagugugugaccaccggcuaaugucagcugccaucaaggacagcaaggcaguucacgcugacaugggguacuggauagaaagugaaaagaacgagaccuggaaacuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuucacacaaacagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguuccuccuucucauaaugggacaauugacauggaaugaucugaucagauuaugcaucaugguuggagccaacgcuuccgacaggauggggaugggaacgacguaccuagcucugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcugucuuugacauucaucaaaacaacguuuuccuugcacuaugcauggaagacaauggcuaugguacugucaauuguaucucucuuccccuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuucucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagagaacguguuccacacaauguggcaugucaccaggggagcuguacucauguaucaagggaagagacuggaaccgagcugggccagugucaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggaacaucuggaucucccaucgugaacagagaaggaaaaauaguaggucuuuauggaaauggaguagugacaacaaguggaaccuacgucagugccauagcucaagcuaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcguacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcacuaauccaagaugaggaaagagacauuccugagagaucauggaacucaggcuaugaguggaucacugacuucccagguaaaacaguuugguuuguuccaagcauuaaaucaggaaaugacauagccaacugcuuaagaaagaaugggaaacgggugauucaauugagcagaaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccggagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagagggagaaagaaagaaacuacgaccucgcuggcuggaugccagaacauacucagacccacuagcccugcgcgaguuuaaagaguuugcagcagggagaagaagcgucucaggugaucuaauauuagaaauagggaaacuuccacaacacuugacgcaaagggcccagaaugccuuggacaaccugguuauguugcacaacuccgaacaaggaggaagagccuacagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaucagcuggcauauguggugauagguuuguuauucaugauacugacaguagcagccaaugagaugggacugcuggaaaccacaaagaaagacuuagggauuggccauguggcuguuggaaaucaccaccaugccgcaaugcuggacguagacuugcauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugacgggauuguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuacggaaguggacagauccgaagccaaagagggauugaaaagaggagaaacaaccaaacaugcagugucgagaggaaccgcuaaacugaggugguuuguggagaggaaccuugugaaaccagaagggaaagucauagaccuugguuguggaagagguggcuggucauacuauugcgcugggcugaagaaagucacagaagugaagggauauacaaaagggggaccuggacaugaggaaccaaucccaauggcgaccuauggauggaaccuaguaaagcugcacucugggaaagacguguucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguacuggguuucauguggaacaggaaacauugugucagcaguaaacaugacaucuagaauguugcuaaaucgauucacaauggcucacaggaaaccaacauaugaaagagauguggaccuaggcgccggaacaagacauguggcaguggaaccagagguagcuaaccuagauaucauuggucagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaagccaugggaugucauccccaugguuacacaaauagccaugacugacacuacacccuuuggacaacagaggguguuuaaagagaaaguugacacacgcacaccaaaagcaaaacgaggcacagcacaaaucauggaggugacagccaagugguuaugggguuuucuuucuagaaauaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugccacguguguuuacaacaugauggggaagagagagaaaaaacuaggagaguucggaaaggcaaaaggaagucgugcaauaugguacaugugguugggagcacgcuuucuagaguucgaagcucuugguuucaugaacgaagaucacugguucagcagggagaauucacucagcggaguggaaggagaaggacuccacaaacuuggauauauacucagagacauaucaaagauuccagggggaaacauguaugcagaugacacagccggaugggauacaaggauaacugaggaugaccuucagaaugaggccagaauuacugacaucauggaacccgaacaugcccuacuggcuaagucaaucuucaagcugaccuaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguggugaaaccaauugaugauagguuugcaacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacagauguggcagcugauguacuuccacaggagagaccugagacuagccgcuaaugcuaucuguucagccguuccaguugauuggaucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaauuaccuagauuacaugacaucaaugaagagauucaagaacgagagugaucccgaaggggcacucugguga

SEQ ID NO: 6214 - RNA, 9879 nt, Artificial Sequence
  derived and/or modified CDS sequence (wt) from DENV-1__HQ891314__SS-prME
ucugugaccaugcuccuuaugcugaugccuacagccuuggcguuccauuugacuacacgagggggagagccgcacaugauagucagcaagcaggaaagaggaaagucacucuuguucaagaccucagcaggugucaacaugugcacccuuauagcgauggauuugggagaguuaugugaggacacaaugacuuacaaaugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaacugaaacguggauguccucugaaggcgcuuggaaacagauacaaagaguggagacuugggcccugagacacccaggauucacggugauagcccuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcuaaagacaaaccaacacuggacauugaacucuugaagacggaagucacaaacccugccguccugcgcaaacugugcauugaagcuaaaauaucaaacaccaccacugacucaagauguccaacacaaggagaagccacacugguggaagaacaagacgcgaacuuugugugucgacgaacguuuguggacagaggcuggggcaauggcugugggcucuucggaaaaggaagccuacuaacgugugcuaaguuuaagugugugacaaaacuggaaggaaagauaguucaauaugaaaacuugaaauauucaguaauagucaccguccacacuggagaccagcaucaggugggaaaugaaagcacagaacaugggacaacugcaacuauaacaccucaagcuccuacgacggaaauacagcugaccgacuacggagcucuuacauuggauuguucaccuagaacaggauuagacuucacugaaaugguguuguugacaaugaaagaaaaaucauggcuaguccacaaacaaugguuucuagacuuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagauuccuuuuucgacccaagaugaaaaaggaguaacccagaaugggagauugauaacagccaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacaugguuaggauuaaacucaaggagcacgucccucucgaugacgugcauugcaguuggccuaguaacacuauaccuaggagucaugguucaggcggauucaggaugcguaauuaauuggaaggguagagaacucaaauguggaaguggcauuuuugucaccaaugaaguucacacuuggacagagcaauacaaauuucaagcugacuccccaaaaagacuaucagcagccaucgggaaggcaugggaggaggguguguguggaauucgaucagcaacucgucucgagaacaucauguggaagcaaauaucaaaugaacugaaccacaucuuacuugaaaaugacaugaaauucacagugguuguaggagauguugcugggaucuuggcucaagggaagaaaaugauuaggccacaacccauggaacacaaauacucguggaaaaauuggggaaaggcuaaaaucauaggggcagauguacagaacuccaccuucaucauugacggcccaaacaccccagaaugcucugaugaccaaagagcauggaacaucugggaaguugaggacuauggauuuggaauuuucacgacaaacauauggcugaaauugcgugacuccuacacccaagugugugaccaccggcuaaugucagcugccaucaaggacagcaaggcaguucacgcugacaugggguacuggauagaaagugaaaagaacgagaccuggaagcuggcaagagccuccuucauagaaguuaaaacauguauuuggccaaaaucccacacucuauggagcaauggaguucuggaaagugaaaugauaauuccaaagaucuauggaggaccaauaucucagcauaacuacagaccaggauauuucacacaaacggcagggccguggcaccuaggcaaguuggaauuggauuuugauuugugugaggguaccacagucguuguggaugaacauuguggaaaucgaggaccaucucuuaggaccacaacagucacaggaaagauaauucaugaaugguguuguagaucuuguacgcuaccacccuuacguuucagaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgcuuccgacagaauggggaugggaacgacguaccuagcucugauggccacuuuuaaaaugagaccaauguuugcuguagggcuauuauuccgcagacuaacauccagagaaguucuucuucuaaccauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccaugacauuuaucaaaacaacguuuuccuugcacuaugcauggaagacaauggcuaugguacugucaauuguaucucucuuccccuuaugccuguccacgaccucccagaaaacaacauggcuuccggugcuauugggaucucuuggaugcaaaccacuaaccauguuucuuauagcagaaaacaaaaucuggggaaggaaaagcuggccccucaaugaagggaucauggcuguuggaauagucagcauccuacuaaguucacuccucaaaaaugaugugccgcuagcugggccacuaauagcuggagguaugcuaauagcauguuauguuauaucuggaagcucagccgaccuaucacuagagaaagcagcugaggucuccugggaagaagaagcagaacacucuggugccucacacaacauauuaguggagguucaagacgauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccaaaaguggaaagagcaguucuugaugaugguaucuauagaauuaugcagagaggacuguuggguaggucccaaguagggguaggaguuuuucaagaaaacguguuccauacaauguggcaugucaccaggggagcuguacucauguaucaagggaagagacuggaaccgagcugggccagugucaaaaaagaccugaucucauauggaggagguuggaggcuucaaggauccuggaacacgggagaagaagugcaggugauugcuguugaaccagggaaaaaccccaaaaauguacaaacggcgccgggcaccuuuaagaccccugaaggugaaguuggagccauugcccuagauuuuaaacccgguacaucuggaucccccaucgugaacagagaagggaaaauaguaggucuuuauggaaauggaguagugacaacaaguggaaccuacgucagugccauagcucaagccaaagcaucacaagaagggccccuaccagagauugaagacgaaguguucaggaaaagaaacuuaacaauaauggaccuacauccaggaucgggaaaaacaagaagauaucuuccagccauaguccgugaggccauaaaaaggaagaugcgcacacuaauucuggcccccacaaggguugucgcuuccgaaauggcagaagcgcucaagggaaugccaauaagguaccaaacaacagcagugaagagugaacacacaggaaaagagauaguugaccucaugugucacgccacuuucaccaugcgccuccugucucccgugagaguuccaaauuacaacaugauuaucauggaugaagcacauuucaccgauccauccagcauagcggccagaggguacaucucaacccgagugggcaugggugaagcagcugcgaucuucaugacagccacucccccaggaucaguggaggccuuuccacagaguaacgcagucauccaagaugaggaaagagacauuccugagagaucauggaacucaggcuaugaguggaucacugacuucccagguaaaacagucugguuuguuccaagcauuaaagcaggaaaugacauugccaacugcuuaagaaagaauggaaaacgagugauucaauugagcaggaagaccuuugauacagaguaccaaaaaacaaaaaauaacgacugggacuacgucgucacaacagacaucuccgaaaugggagcaaacuuucgggccgacagggugauagacccaagacggugucugaaaccgguaauacuaaaagaugguccagagcgcgucauuuuagcaggaccgaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugacaauauaaacacaccagaagggauuaucccagcccucuucgagccggagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagauuuggacaaaagaaggagaaagaaagaaacuacgcccccgcuggcuggaugccagaacauacucagacccacuggcccugcgcgaguuuaaagaguuugcagcaggaagaagaagcgucucaggugaucuaauacuagaaauagggaaacuuccacaacacuugacgcaaagggcccagaaugccuuggacaaccuggucauguugcacaacuccgaacaaggaggaagagccuauagacaugcaauggaagaacugccagauaccauagaaacguugaugcuccuagcuuugauagcuguguuaacugguggagugacgcuguucuuccuaucaggaaagggccuagggaaaacaucuaucggccuacucugcgugauggcuucaagcgcacugcuauggauggccaguguggagccccauuggauagcggccuccaucauacuggaguucuuccugaugguguugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuagggugcuauucccaggugaacccacugacgcugacagcggcgguguugaugcuaguggcucauuacgccauaauuggaccuggacugcaagcaaaagcuacuagagaagcucaaaaaaggacagcggccggaauaaugaaaaauccaaccauugauggaauuguugcaauagauuuggacccugugguuuaugaugcaaaauuugagaaacaacuaggccaaauaaugcuguugauacuaugcacaucacagauccucuugaugcggacuacaugggccuugugcgaauccaucacacuggccacuggaccucugaccacacuuugggaaggaucuccaggaaaauuuuggaacaccacgauagcaguuuccauggcaaacauuuucagaggaaguuaucuagcaggagcaggucuggcuuucucauuaaugaaaucucuaggaggagguaggagaggcacgggagcccaaggggaaacacugggagagaaauggaaaagacagcugaaccaacugagcaagucagaauucaacaccuauaaaaggagugggauuauggaaguggacagauccgaagccaaagagggacugaaaagaggagaaacaaccaaacaugcagugucgagaggaaccgcuaaacuaaggugguuuguggagaggaaccuugugaaaccagaagggaaagucauagaccucgguuguggaagagguggcuggucauacuauugcgcugggcugaagaaagucacagaagugaagggauauacaaaaggaggaccaggacaugaggaaccaaucccaauggcgaccuauggauggaaccuaguaaaacugcacuccgggaaagacguauuuuuuauaccaccugagaaaugugauacccuuuugugugauauuggugaguccucuccaaacccaaccauagaggaaggaagaacgcuacgcguucuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguacuggguuucauguggaacaggaaacauugugucagcaguaaacaugacauccagaauguugcuaaaucgauuuacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggauguuauccccaugguuacacaaauagccaugacugacaccacacccuuuggacaacagaggguguuuaaagagaaaguugacacacgcacaccaaaagcaaaacgaggcacagcacaaaucauggaagugacagccaggugguuauggaguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugaccgguucugggaccuugugcacagagagagggagcuucacaaacagggaaaaugugccacguguguuuacaacaugauggggaagagagagaaaaagcuaggagaguucggaaaggcaaaaggaagucgugcaauaugguacaugugguugggagcacgcuuucuagaguuugaagcucuugguuucaugaacgaagaucacugguucagcagagagaauucacucagcggaguggaaggagaaggacuucacaaacuuggauauauacucagagacauaucaaagauuccagggggaaacauguaugcagaugacacagccggaugggauacaaggauaacagaggaugaccuccagaaugaggccaaaauuacugacaucauggaacccgaacaugcccuacuggcuaagucaaucuucaagcuaaccuaccaaaauaaggugguaaggguacagagaccagcaaaaaauggaaccgugauggaugucauauccagacgugaccagagaggaaguggccagguuggaacuuauggcuuaaacacuuucaccaacauggaagcccagcugauaagacaaauggagucugaggaaaucuuuucacccaacgaauuagagaccccaaauuuagccgagagaguucucgacuggcuggaaaaauacggcgucgaaaggcugaaaagaauggcaaucagcggagaugacugcguagugaaaccaauugaugauagguuugcgacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggguuccaaccagccgcaccacuuggucgauccaugcccaucaccaauggaugacaacagaagacaugcugucaguauggaauaggguuuggauagaggaaaacccauggauggaggacaaaacccguguauccaguugggaagauguuccauaccuagggaaaagggaagaucaaugguguggaucucugauaggcuuaacagcaagggccaccugggccaccaacauacaaguggccauaaaccaagugagaagacuaauugggaaugagaauuauucggauuacaugacaucaaugaagagauucaagaacgagagugaacccgaaggggcacucugguga

SEQ ID NO: 6215 - RNA, 9879 nt, Artificial Sequence
  derived and/or modified CDS sequence (wt) from DENV-1__HQ891315__SS-prME
ucugugaccaugcuccuuaugcugaugccuacagccuuggcguuccauuugacuacacgagggggagagccgcacaugauagucagcaagcaggaaagaggaaagucacuuuuguucaagaccucagcaggugucaacaugugcacccuuauagcgauggauuugggagaguuaugugaggacacaaugacuuacaaaugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaacugaaacguggauguccucugaaggcgcuuggaaacagauacaaagaguggagacuugggcccugagacacccaggauucacggugauagcccuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcuaaagacaaaccaacauuggacauugaacucuugaagacggaagucacaaacccugccguccugcgcaaacugugcauugaagcuaaaauaucaaacaccaccacugacucaagauguccaacacaaggagaagccacacugguggaagaacaagacgcgaacuuugugugucgacgaacguuuguggacagaggcuggggcaauggcugugggcucuucggaaaaggaagccuacuaacgugugcuaaguuuaagugugugacaaaacuggaaggaaagauaguucaauaugaaaacuugaaauauucaguaauagucaccguccacacuggagaccagcaucaggugggaaaugaaagcacagaacaugggacaacugcaacuauaacaccucaagcuccuacgacggaaauacagcugaccgacuacggagcucuuacauuggauuguucaccuagaacaggauuagacuucaaugaaaugguguuguugacaaugaaagaaaaaucauggcuaguccacaaacaaugguuucuagacuuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagauuccuuuuucgacccaagaugaaaaaggaguaacccagaaugggagauugauaacagccaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacaugguuaggauuaaacucaaggagcacgucccucucgaugacgugcauugcaguuggccuaguaacacuauaccuaggagucaugguucaggcggauucaggaugcguaauuaauuggaaggguagagaacucaaauguggaaguggcauuuuugucaccaaugaaguucacacuuggacagagcaauacaaauuucaagcugacuccccaaaaagacuaucagcagccaucgggaaggcaugggaggaggguguguguggaauucgaucagcaacucgucucgagaacaucauguggaagcaaauaucaaaugaacugaaccacaucuuacuugaaaaugacaugaaauucacagugguuguaggagauguugcugggaucuuggcucaagggaagaaaaugauuaggccacaacccauggaacacaaauacucguggaaaaauuggggaaaggcuaaaaucauaggggcagauguacagaacuccaccuucaucauugacggcccaaacaccccagaaugcucugaugaccaaagagcauggaacaucugggaaguugaggacuauggauuuggaauuuucacgacaaacauauggcugaaauugcgugacuccuacacccaagugugugaccaccggcuaaugucagcugccaucaaggacagcaaggcaguucacgcugacaugggguacuggauagaaagugaaaagaacgagaccuggaagcuggcaagagccuccuucauagaaguuaaaacauguauuuggccaaaaucccacacucuauggagcaauggaguucuggaaagugaaaugauaauuccaaagaucuauggaggaccaauaucucagcauaacuacagaccaggauauuucacacaaacggcagggccguggcaccuaggcaaguuggaauuggauuuugauuugugugaggguaccacagucguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccagucaaggaaaaagaagagaaucuagucaaaucaauagucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgcuuccgacagaauggggaugggaacgacguaccuagcucugauggccacuuuuaaaaugagaccaauguuugcuguagggcuauuauuccgcagacuaacauccagagaaguucuucuucuaaccauuggauugagucuaguggcaucuguggaguuaccaaauuccuuggaggagcugggggauggacuugcaaugggcaucaugauuuuaaaauuauugacugacuuucaaucacaucaguugugggcuaccuugcuguccaugacauuuaucaaaacaacguuuuccuugcacuaugcauggaagacaauggcuaugguacugucaauuguaucucucuuccccuuaugccuguccacgaccucccagaaaacaacauggcuuccggugcuauugggaucucuuggaugcaaaccacuaacuauguuucuuauagcagaaaacaaaaucuggggaaggaaaagcuggccccucaaugaagggaucauggcuguuggaauagucagcauucuacuaaguucacuccucaaaaaugaugugccgcuagcugggccacuaauagcuggagguaugcuaauagcauguuauguuauaucuggaagcucagccgaccuaucacuagagaaagcagcugaggucuccugggaagaagaagcagaacacucuggugccucacacaacauauuaguggagguucaagacgauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccaaaaguggaaagagcaguucuugaugaugguaucuauagaauuaugcagagaggacuguuggguaggucccaaguagggguaggaguuuuucaagaaaacguguuccauacaauguggcaugucaccaggggagcuguacucauguaucaagggaagagacuggaaccgagcugggccagugucaaaaaagaccugaucucauauggaggagguuggaggcuucaaggauccuggaacacgggagaagaagugcaggugauugcuguugaaccagggaaaaaccccaaaaauguacaaacggcgccgggcaccuuuaagaccccugaaggugaaguuggagccauugcccuagauuuuaaacccgguacaucuggaucccccaucgugaacagagaagggaaaauaguaggucuuuauggaaauggaguagugacaacaaguggaaccuacgucagugccauagcucaagccaaagcaucacaagaagggccccuaccagagauugaagacgaaguguucaggaaaagaaacuuaacaauaauggaccuacauccaggaucgggaaaaacaagaagauaucuuccagccauaguccgugaggccauaaaaaggaagaugcgcacacuaauucuggcccccacaaggguugucgcuuccgaaauggcagaagcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagccacucccccaggaucaguggaggccuuuccacagaguaacgcagucauccaagaugaggaaagagacauuccugagagaucauggaacucaggcuaugaguggaucacugacuucccagguaaaacagucugguuuguuccaagcauuaaagcaggaaaugacauugccaacugcuuaagaaagaauggaaaacgagugauucaauugagcaggaagaccuuugauacagaguaccaaaaaacaaaaaauaacgacugggacuacgucgucacaacagacaucuccgaaaugggagcaaacuuccgggccgacagggugauagacccaagacggugucugaaaccgguaauacuaaaagaugguccagagcgcgucauuuuagcaggaccgaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugacaauauaaacacaccagaagggauuaucccagcccucuucgagccggagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagauuuggacaaaagaaggagaaagaaagaaacuacgcccccgcuggcuggaugccagaacauacucagacccacuggcccugcgcgaguuuaaagaguuugcagcaggaagaagaagcgucucaggugaucuaauacuagaaauagggaaacuuccacaacacuugacgcaaagggcccagaaugccuuggacaaccuggucauguugcacaacuccgaacaaggaggaagagccuauagacaugcaauggaagaacugccagauaccauagaaacguugaugcuccuagcuuugauagcuguguuaacugguggagugacgcuguucuuccuaucaggaaagggccuagggaaaacaucuaucggccuacucugcgugauggcuucaagcgcacugcuauggauggccaguguggagccccauuggauagcggccuccaucauacuggaguucuuccugaugguguugcuuauuccagagccagacagacaacgcacuccgcaggacaaccagcuggcauauguggugauagguuuguuauucaugauacugacaguagcagccaaugagaugggauugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagccauauugaugggacuugacaaaggauggccaauaucgaagauggacauaggaguuccacuucucgccuuggggugcuauucccaggugaacccacugacgcugacagcggcgguguugaugcuaguggcucauuacgccauaauuggaccuggacugcaagcaaaagcuacuagagaagcucaaaaaaggacagcggccggaauaaugaaaaauccaaccauugauggaauuguugcaauagauuuggacccugugguuuaugaugcaaaauuugagaaacaacuaggccaaauaaugcuguugauacuaugcacaucacagauccucuugaugcggacuacaugggccuugugcgaauccaucacacuggccacuggaccucugaccacacuuugggaaggaucuccaggaaaauuuuggaacaccacgauagcgguuuccauggcaaacauuuucagaggaaguuaucuagcaggagcaggucuggcuuucucauuaaugaaaucucuaggaggagguaggagaggcacgggagcccaaggggaaacacugggagagaaauggaaaagacagcugaaccaacugagcaagucagaauucaacaccuauaaaaggagugggauuauggaaguggacagauccgaagccaaagagggacugaaaagaggagaaacaaccaaacaugcagugucgagaggaaccgcuaaacuaaggugguuuguggagaggaaccuugugaaaccagaagggaaagucauagaccucgguuguggaagagguggcuggucauacuauugcgcugggcugaagaaagucacagaagugaagggauauacaaaaggaggaccaggacaugaggaaccaaucccaauggcgaccuauggauggaaccuaguaaaacugcacuccgggaaagacguauuuuuuauaccaccugagaaaugugauacccuuuugugugauauuggugaguccucuccaaacccaacuauagaggaaggaagaacgcuacgcguucuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguacuggguuucauguggaacaggaaacauugugucagcaguaaacaugacauccagaauguugcuaaaucgauuuacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggauguuauccccaugguuacacaaauagccaugacugacaccacacccuuuggacaacagaggguguuuaaagagaaaguugacacacgcacaccaaaagcaaaacgaggcacagcacaaaucauggaagugacagccaggugguuauggaguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugaccgguucugggaccuugugcacagagagagggagcuucacaaacagggaaaaugugccacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuucacaaacuuggauauauacucagagacauaucaaagauuccagggggaaacauguaugcagaugacacagccggaugggauacaaggauaacagaggaugaccuccagaaugaggccaaaauuacugacaucauggaacccgaacaugcccuacuggcuaagucaaucuucaagcuaaccuaccaaaauaaggugguaaggguacagagaccagcaaaaaauggaaccgugauggaugucauauccagacgugaccagagaggaaguggccagguuggaacuuauggcuuaaacacuuucaccaacauggaagcccagcugauaagacaaauggagucugaggaaaucuuuucacccaacgaauuagagaccccaaauuuagccgagagaguucucgacuggcuggaaaaauauggcgucgaaaggcugaaaagaauggcaaucagcggagaugacugcguagugaaaccaauugaugauagguuugcgacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagcuugagagaaacugcaugccuaggcaagucauaugcacaaauguggcagcugauguacuuccacaggagagaccugagacuagccgcuaaugcuaucuguucagccguuccaguugauuggguuccaaccagccgcaccacuuggucgauccaugcccaucaccaauggaugacaacagaagacaugcugucaguauggaauaggguuuggauagaggaaaacccauggauggaggacaaaacccguguauccaguugggaagauguuccauaccuagggaaaagggaagaucaaugguguggaucucugauaggcuuaacagcaagggccaccugggccaccaacauacaaguggccauaaaccaagugagaagacuaauugggaaugagaauuauucggauuacaugacaucaaugaagagauucaagaacgagagugaacccgaaggggcacucugguga

SEQ ID NO: 6216 - RNA, 9879 nt, Artificial Sequence
  derived and/or modified CDS sequence (wt) from DENV-1__HQ891316__SS-prME
ucugugaccaugcuccuuaugcugaugccuacagccuuggcguuccauuugacuacacgagggggagagccgcacaugauagucagcaagcaggaaagaggaaagucacuuuuguucaagaccucagcaggugucaacaugugcacccuuauagcgauggauuugggagaguuaugugaggacacaaugacuuacaaaugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaacugaaacguggauguccucugaaggcgcauggaaacagauacaaagaguggagacuugggcccugagacacccaggauucacggugauagcccuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcuaaagacaaaccaacacuggacauugaacucuugaagacggaagucacaaacccugccguccugcgcaaacugugcauugaagcuaaaauaucaaacaccaccacugacucaagauguccaacacaaggagaagccacacugguggaagaacaagacgcgaacuuugugugucgacgaacguuuguggacagaggcuggggcaauggcugugggcucuucggaaaaggaagccuacuaacgugugcuaaguuuaagugugugacaaaacuggaaggaaagauaguccaauaugaaaaccugaaauauucaguaauagucaccguccacacuggagaccagcaucaggugggaaaugaaagcacagaacaugggacaacugcaacuauaacaccucaagcuccuacgacggaaauacagcugaccgacuacggagcucuuacauuggauuguucaccuagaacaggauuagacuucaaugaaaugguguuguugacaaugaaagaaaaaucguggcuaguccacaaacaaugguuucuagacuuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacggaaauccaaacgucuggaacgacaacaauuuuugcaggacacuugaaauguagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagauuccuuuuucgacccaagaugaaaaaggaguaacccagaaugggagauugauaacagccaaccccauagucacugacaaagaaaaaccagucaacauugaggcagaaccgccuuuuggugagaguuacaucgugauaggagcuggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacaugguuaggauuaaacucaaggagcacgucccucucgaugacgugcauugcaguuggccuaguaacacuauaccuaggagucaugguucaggcggauucaggaugcguaauuaauuggaaggguagagaacucaaauguggaaguggcauuuuugucaccaaugaaguucacacuuggacagagcaauacaaauuucaagcugacuccccaaaaagacuaucagcagccaucgggaaggcaugggaggaggguguguguggaauucgaucagcaacucgucucgagaacaucauguggaagcaaauaucaaaugaacugaaccacaucuuacuugaaaaugacaugaaauucacagugguuguaggagauguugcugggaucuuggcucaagggaagaaaaugauuaggccacaacccauggaacacaaauacucguggaaaaauuggggaaaggcuaaaaucauaggggcagauguacagaacuccaccuucaucauugacggcccaaacaccccagaaugcucugaugaccaaagagcauggaacaucugggaaguugaggacuauggauuuggaauuuucacgacaaacauauggcugaaauugcgugacuccuacacccaagugugugaccaccggcuaaugucagcugccaucaaggacagcaaggcaguucacgcugacaugggguacuggauagaaagugaaaagaacgagaccuggaagcuggcaagagccuccuucauagaaguuaaaacauguauuuggccaaaaucccacacucuauggagcaauggaguucuggaaagugaaaugauaauuccaaagaucuauggaggaccaauaucucagcauaacuacagaccaggauauuucacacaaacggcagggccguggcaccuaggcaaguuggaauuggauuuugauuugugugaggguaccacagucguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgcuuccgacagaauggggaugggaacgacguaccuagcucugauggccacuuuuaaaaugagaccaauguuugcuguagggcuauuauuccgcagacuaacauccagagaaguucuucuucuaaccauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccaugacauuuaucaaaacaacguuuuccuugcacuaugcauggaagacaauggcuaugguacugucaauuguaucucucuuccccuuaugccuguccacgaccucccagaaaacaacauggcuuccggugcuauugggaucucuuggaugcaaaccacuaaccauguuucuuauagcagaaaacaaaaucuggggaaggaaaagcuggccccucaaugaagggaucauggcuguuggaauagucagcauccuacuaaguucacuccucaaaaaugaugugccgcuagcugggccacuaauagcuggagguaugcuaauagcauguuauguuauaucuggaagcucagccgaccuaucacuagagaaagcagcugaggucuccugggaagaagaagcagaacacucuggugccucacacaacauauuaguggagguucaagacgauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccaaaaguggaaagagcaguucuugaugaugguaucuauagaauuaugcagagaggacuguuggguaggucccaaguagggguaggaguuuuucaagaaaacguguuccauacaauguggcaugucaccaggggagcuguacucauguaucaagggaagagacuggaaccgagcugggccagugucaaaaaagaccugaucucauauggaggagguuggaggcuucaaggauccuggaacacgggagaagaagugcaggugauugcuguugaaccagggaaaaaccccaaaaauguacaaacggcgccgggcaccuuuaagaccccugaaggugaaguuggagccauugcccuagauuuuaaacccgguacaucuggaucccccaucgugaacagagaagggaaaauaguaggucuuuauggaaauggaguagugacaacaaguggaaccuacgucagugcuauagcucaagccaaagcaucacaagaagggccccuaccagagauugaagacgaaguguucaggaaaagaaacuuaacaauaauggaccuacauccaggaucgggaaaaacaagaagauaucuuccagccauaguccgugaggccauaaaaaggaagaugcgcacacuaauucuggcccccacaaggguugucgcuuccgaaauggcagaagcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagccacucccccaggaucaguggaggccuuuccacagaguaacgcagucauccaagaugaggaaagagacauuccugagagaucauggaacucaggcuaugaguggaucacugacuucccagguaaaacagucugguuuguuccaagcauuaaagcaggaaaugacauugccaacugcuuaagaaagaauggaaaacgagugauucaauugagcaggaagaccuuugauacagaguaccaaaaaacaaaaaauaacgacugggacuacgucgucacaacagacaucuccgaaaugggagcaaacuuccgggccgacagggugauagacccaagacggugucugaaaccgguaauacuaaaagaugguccagagcgcgucauuuuagcaggaccgaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugacaauauaaacacaccagaagggauuaucccagcccucuucgagccggagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagauuuggacaaaagaaggagaaagaaagaaacuacgcccccgcuggcuggaugccagaacauacucagacccacuggcccugcgcgaguuuaaagaguuugcagcaggaagaagaagcguuucaggugaucuaauacuagaaauagggaaacuuccacaacacuugacgcaaagggcccagaaugccuuggacaaccuggucauguugcacaacuccgaacaaggaggaagagccuauagacaugcaauggaagaacugccagauaccauagaaacguugaugcuccuagcuuugauagcuguguuaacuggaggagugacgcuguucuuccuaucaggaaagggccuagggaaaacaucuaucggccuacucugcgugauggcuucaagcgcacugcuauggauggccaguguggagccccauuggauagcggccuccaucauacuggaguucuuccugaugguguugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaauacaacggcaaacauuucccugacagccauugcaaaccaggcagcuauauugaugggacuugacaaaggauggccaauaucgaagauggacauaggaguuccacuucucgccuuggggugcuauucccaggugaacccacugacgcugacagcggcgguguugaugcuaguggcucauuacgccauaauuggaccuggacugcaagcaaaagcuacuagagaagcucaaaaaaggacagcggccggaauaaugaaaaauccaaccauugauggaauuguugcaauagauuuggacccugugguuuaugaugcaaaauuugagaaacaacuaggccaaauaaugcuguugauacuaugcacaucacagauccucuugaugcggacuacaugggccuugugcgaauccaucacacuggccacuggaccucugaccacacuuugggaaggaucuccaggaaaauuuuggaacaccacgauagcgguuuccauggcaaauauuuucagaggaaguuaucuagcaggagcaggucuggcuuucucauuaaugaaaucucuaggaggagguaggagaggcacgggagcccaaggggaaacacugggagagaaauggaaaagacagcugaaccaacugagcaagucagaauucaacaccuauaaaaggagugggauuauggaaguggacagauccgaagccaaagagggacugaaaagaggagaaacaaccaaacaugcagugucgagaggaaccgcuaaacuaaggugguuuguggagaggaaccuugugaaaccagaagggaaagucauagaccucgguuguggaagagguggcuggucauacuauugcgcugggcugaagaaagucacagaagugaagggauauacaaaaggaggaccaggacaugaggaaccaaucccaauggcgaccuauggauggaaccuaguaaaacugcacuccgggaaagacguauuuuuuauaccaccugagaaaugugauacccuuuugugugauauuggugaguccucuccaaacccaacuauagaggaaggaagaacgcuacgcguucuaaagaugguggaaccauggcucagaggaaaccaauuuugcauaaaaauccugaaucccuacaugccaagugugguggaaacucuggagcaaaugcaaagaaaacauggaggaaugcuagugcgaaauccacuuucaagaaauucuacucaugaaauguacuggguuucauguggaacaggaaacauugugucagcaguaaacaugacauccagaauguugcuaaaucgauuuacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggauguuauccccaugguuacacaaauagccaugacugacaccacacccuuuggacaacagaggguguuuaaagagaaaguugacacacgcacaccaaaagcaaaacgaggcacagcacaaaucauggaagugacagccaggugguuauggaguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugaccgguucugggaccuugugcacagagagagggagcuucacaaacagggaaaaugugccacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuucacaaacuuggauauauacucagagacauaucaaagauuccagggggaaacauguaugcagaugacacagccggaugggauacaaggauaacagaggaugaccuccagaaugaggccaaaauuacagacaucauggaacccgaacaugcccuacuggcuaagucaaucuucaagcuaaccuaccaaaauaaggugguaaggguacagagaccagcaaaaaauggaaccgugauggaugucauauccagacgugaccagagaggaaguggccagguuggaacuuauggcuuaaacacuuucaccaacauggaagcccagcugauaagacaaauggagucugaggaaaucuuuucacccaacgaauuagagaccccaaauuuagccgagagaguucuugacuggcuggaaaaauauggcgucgaaaggcugaaaagaauggcaaucagcggagaugacugcguagugaaaccaauugaugauagguuugcgacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggguuccaaccagccgcaccacuuggucgauccaugcccaucaccaauggaugacaacagaagacaugcugucaguauggaauaggguuuggauagaggaaaacccauggauggaggacaaaacccguguauccaguugggaagauguuccauaccuagggaaaagggaagaucaaugguguggaucucugauaggcuuaacagcaagggccaccugggccaccaacauacaaguggccauaaaccaagugagaagacuaauugggaaugagaauuauucggauuacaugacaucaaugaagagauucaagaacgagagugaacccgaaggggcacucugguga

SEQ ID NO: 6217 - RNA, 9879 nt, Artificial Sequence
  derived and/or modified CDS sequence (wt) from DENV-1__JN054256__SS-prME
ucugugaccaugcuccuuaugcugaugccuacagccuuggcguuccauuugacuacacgagagggagagccgcacaugauagucagcaagcaggaaagaggaaagucacucuuguucaagaccucagcaggugucaacaugugcacccuuauagcgauggauuugggagaguuaugugaggacacaaugacuuacaaaugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaacugaaacguggauguccucugaaggcgcuuggaaacagauacaaagaguggagacuugggcccugagacacccaggauucacggugauagcccuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcuaaagacaaaccaacacuggacauugaacucuugaagacggaagucacaaacccugccguccugcgcaaacugugcauugaagcuaaaauaucaaacaccaccacugacucaagauguccaacacaaggagaagccacacugguggaagaacaagacgcgaacuuugugugucgacgaacguuuguggacagaggcuggggcaauggcugugggcucuucggaaaaggaagccuacuaacgugugcuaaguuuaagugugugacaaaacuggaaggaaagauaguucaauaugaaaacuugaaauauucaguaauagucaccguccacacuggagaccagcaucaggugggaaaugaaagcacagaacaugggacaacugcaacuauaacaccccaagcuccuacgacggaaauacagcugaccgacuacggagcucuuacauuggauuguucaccuagaacaggauuagacuucacugaaaugguguuguugacaaugaaagaaaaaucauggcuaguccacaaacaaugguuucuagacuuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagauuccuuuuucgacccaagaugaaaaaggaguaacccagaaugggagauugauaacagccaaccccauagucacugacaaagaaaaaccagucaacauugaggcagaaccgcccuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacaugguuaggauuaaacucaaggagcacgucccucucgaugacgugcauugcaguuggccuaguaacacuauaccuaggagucaugguucaggcggauucaggaugcguaauuaauuggaaggguagagaacucaaauguggaaguggcauuuuugucaccaaugaaguucacacuuggacagagcaauacaaauuucaagcugacuccccaaaaagacuaucagcagccaucgggaaggcaugggaggaggguguguguggaauucgaucagcaacucgucucgagaacaucauguggaagcaaauaucaaaugaacugaaccacaucuuacuugaaaaugacaugaaacucacagugguuguaggagauguugcugggaucuuggcucaagggaagaaaaugauuaggccacaacccauggaacacaaauacucguggaaaaauuggggaaaggcuaaaaucauaggggcagauguacagaacuccaccuucaucauugacggcccaaacaccccagaaugcucugaugaccaaagagcauggaacaucugggaaguugaggacuauggauuuggaauuuucacgacaaacauauggcugaaauugcgugacuccuacacccaagugugugaccaccggcuaaugucagcugccaucaaggacagcaaggcaguucacgcugacaugggguacuggauagaaagugaaaagaacgagaccuggaagcuggcaagagccuccuucauagaaguuaaaacauguauuuggccaaaaucccacacucuauggagcaauggaguucuggaaagugaaaugauaauuccaaagaucuauggaggaccaauaucucagcauaacuacagaccaggauauuucacacaaacggcagggccguggcaccuaggcaaguuggaauuggauuuugauuugugugaggguaccacagucguuguggaugaacauuguggaaaucgaggaccaucucuuaggaccacaacagucacaggaaagauaauucaugaaugguguuguagaucuuguacgcuaccacccuuacguuucagaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgcuuccgacagaauggggaugggaacgacguaccuagcucugauggccacuuuuaaaaugagaccaauguuugcuguagggcuauuauuccgcagacuaacauccagagaaguucuucuucuaaccauuggauugagucuaguggcaucuguggaguuaccaaauuccuuggaggagcugggggauggacuugcaaugggcauuaugauuuuaaaauuauugauugacuuucaaucacaucaguugugggcuaccuugcuguccaugacauuuaucaaaacaacguuuuccuugcacuaugcauggaagacaauggcuaugguacugucaauuguaucucucuuccccuuaugccuguccacgaccucccagaaaacaacauggcuuccggugcuauugggaucucuuggaugcaaaccacuaaccauguuucuuauagcagaaaacaaaaucuggggaaggaaaagcuggccccucaaugaagggaucauggcuguuggaauagucagcauccuacuaaguucacuccucaaaaaugaugugccgcuagcugggccacuaauagcuggagguaugcuaauagcauguuauguuauaucuggaagcucagccgaccuaucacuagagaaagcagcugaggucuccugggaagaagaagcagaacacucuggugccucacacaacauauuaguggagguucaagacgauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccaaaaguggaaagagcaguucuugaugaugguaucuauagaauuaugcagagaggacuguuggguaggucccaaguagggguaggaguuuuucaagaaaacguguuccauacaauguggcaugucaccaggggagcuguacucauguaucaagggaagagacuggaaccgagcugggccagugucaaaaaagaccugaucucauauggaggagguuggaggcuucaaggauccuggaacacgggagaagaagugcaggugauugcuguugaaccagggaaaaaccccaaaaauguacaaacggcgccgggcaccuuuaagaccccugaaggugaaguuggagccauugcccuagauuuuaaacccgguacaucuggaucccccaucgugaacagagaagggaaaauaguaggucuuuauggaaauggaguagugacaacaaguggaaccuacgucagugccauagcucaagccaaagcaucacaagaagggccccuaccagagauugaagacgaaguguucaggaaaagaaacuuaacaauaauggaccuacauccaggaucgggaaaaacaagaagauaucuuccagccauaguccgugaggccauaaaaaggaagaugcgcacacuaauucuggcccccacaaggguugucgcuuccgaaauggcagaagcgcucaagggaaugccaauaagguaccaaacaacagcagugaagagugaacacacaggaaaagagauaguugaccucaugugucacgccacuuucaccaugcgccuccugucucccgugagaguuccaaauuacaacaugauuaucauggaugaagcacauuucaccgauccauccagcauagcggccagaggguacaucucaacccgagugggcaugggugaagcagcugcgaucuucaugacagccacucccccaggaucaguggaggccuuuccacagaguaacgcagucauccaagaugaggaaagagacauuccugagagaucauggaacucaggcuaugaguggaucacugacuucccagguaaaacagucugguuuguuccaagcauuaaagcaggaaaugacauugccaacugcuuaagaaagaauggaaaacgagugauucaauugagcaggaagaccuuugauacagaguaccaaaaaacaaaaaauaacgacugggacuacgucgucacaacagacaucuccgaaaugggagcaaacuuucgggccgacagggugauagacccaagacggugucugaaaccgguaauacuaaaagaugguccagagcgcgucauuuuagcaggaccgaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugacaauauaaacacaccagaagggauuaucccagcccucuucgagccggagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagauuuggacaaaagaaggagaaagaaagaaacuacgcccccgcuggcuggaugccagaacauacucagacccacuggcccugcgcgaguuuaaagaguuugcagcaggaagaagaagcgucucaggugaucuaauacuagaaauagggaaacuuccacaacacuugacgcaaagggcccagaaugccuuggacaaccuggucauguugcacaacuccgaacaaggaggaagagccuauagacaugcaauggaagaacugccagauaccauagaaacguugaugcuccuagcuuugauagcuguguuaacugguggagugacgcuguucuuccuaucaggaaagggccuagggaaaacaucuaucggccuacucugcgugauggcuucaagcgcacugcuauggauggccaguguggagccccauuggauagcggccuccaucauacuggaguucuuccugaugguguugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaaucaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuagggugcuauucccaggugaacccacugacgcugacagcggcgguguugaugcuaguggcucauuacgccauaauuggaccuggacugcaagcaaaagcuacuagagaagcucaaaaaaggacagcggccggaauaaugaaaaauccaaccauugauggaauuguugcaauagauuuggacccugugguuuaugaugcaaaauuugagaaacaacuaggccaaauaaugcuguugauacuaugcacaucacagauccucuugaugcggacuacaugggccuugugcgaauccaucacacuggccacuggaccucugaccacacuuugggaaggaucuccaggaaaauuuuggaacaccacgauagcaguuuccauggcaaacauuuucagaggaaguuaucuagcaggagcaggucuggcuuucucauuaaugaaaucucuaggaggagguaggagaggcacgggagcccaaggggaaacacugggagagaaauggaaaagacagcugaaccaacugagcaagucagaauucaacaccuauaaaaggagugggauuauggaaguggacagauccgaagccaaagagggacugaaaagaggagaaacaaccaaacaugcagugucgagaggaaccgcuaaacuaaggugguuuguggagaggaaccuugugaaaccagaagggaaagucauagaccucgguuguggaagagguggcuggucauacuauugcgcugggcugaagaaagucacagaagugaagggauauacaaaaggaggaccaggacaugaggaaccaaucccaauggcgaccuauggauggaaccuaguaaaacugcacuccgggaaagacguauuuuuuauaccaccugagaaaugugauacccuuuugugugauauuggugaguccucuccaaacccaaccauagaggaaggaagaacgcuacgcguucuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguacuggguuucauguggaacaggaaacauugugucagcaguaaacaugacauccagaauguugcuaaaucgauuuacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggauguuauccccaugguuacacaaauagccaugacugacaccacacccuuuggacaacagaggguguuuaaagagaaaguugacacacguacaccaaaagcaaaacgaggcacagcacaaaucauggaagugacagccaggugguuauggaguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugaccgguucugggaccuugugcacagagagagggagcuucacaaacagggaaaaugugccacguguguuuacaacaugauggggaagagagagaaaaagcuaggagaguucggaaaggcaaaaggaagucgugcaauaugguacaugugguugggagcacgcuuucuagaguuugaagcucuugguuucaugaacgaagaucacugguucagcagagagaauucacucagcggaguggaaggagaaggacuucacaaacuuggauauauacucagagacauaucaaagauuccagggggaaacauguaugcagaugacacagccggaugggauacaaggauaacagaggaugaccuccagaaugaggccaaaauuacugacaucauggaacccgaacaugcccuacuggcuaagucaaucuucaagcuaaccuaccaaaauaaggugguaaggguacagagaccagcaaaaaauggaaccgugauggaugucauauccagacgugaccagagaggaaguggccagguuggaacuuauggcuuaaacacuuucaccaacauggaagcccagcugauaagacaaauggagucugaggaaaucuuuucacccaacgaauuagagaccccaaauuuagccgagagaguucucgacuggcuggaaaaauacggcgucgaaaggcugaaaagaauggcaaucagcggagaugacugcguagugaaaccaauugaugauagguuugcgacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugacuggguuccaaccagccgcaccacuuggucgauccaugcccaucaccaauggaugacaacagaagacaugcugucaguauggaauaggguuuggauagaggaaaacccauggauggaggacaaaacccguguauccaguugggaagauguuccauaccuagggaaaagggaagaucaaugguguggaucucugauaggcuuaacagcaagggccaccugggccaccaacauacaaguggccauaaaccaagugagaagacuaauugggaaugagaauuauucggauuacaugacaucaaugaagagauucaagaacgagagugaacccgaaggggcacucugguga

SEQ ID NO: 6218 - RNA, 9879 nt, Artificial Sequence
  derived and/or modified CDS sequence (wt) from DENV-1__JN054255__SS-prME
ucugugaccaugcuccuuaugcugaugccuacagccuuggcguuccauuugacuacacgagggggagagccgcacaugauagucagcaagcaggaaagaggaaagucacuuuuguucaagaccucagcaggugucaacaugugcacccuuauagcgauggauuugggagaguuaugugaggacacaaugacuuacaaaugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaacugaaacguggauguccucugaaggcgcuuggaaacagauacaaagaguggagacuugggcccugagacacccaggauucacggugauagcccuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcuaaagacaaaccaacacuggacauugaacucuugaagacggaagucacaaacccugccguccugcgcaaacugugcauugaagccaaaauaucaaacaccaccacugacucaagauguccaacacaaggagaagccacacugguggaagaacaagacgcgaacuuugugugucgacgaacguuuguggacagaggcuggggcaauggcugugggcucuucggaaaaggaagccuacuaacgugugcuaaguuuaagugugugacaaaacuggaaggaaagauaguucaauaugaaaacuugaaauauucaguaauagucaccguccacacuggagaccagcaucaggugggaaaugaaagcacagaacaugggacaacugcaacuauaacaccucaagcucccacgacggaaauacagcugaccgacuacggagcucuuacauuggauuguucaccuagaacaggauuagacuucaaugaaaugguguuguugacaaugaaagaaaaaucauggcuaguccacaaacaaugguuucuagacuuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaaugucuggaacgacaacaauuuuugcaggacacuugaaauguagacuaaagauggacaaacugacucuaaaagggaugucauaugugaugugcacaggcucauucaagcuugagaaagaaguggcugagacccagcauggaaccguucuagugcagauuaaauacgaaggaacagaugcaccaugcaagauuccuuuuucgacccaagaugaaaaaggaguaacccagaaugggagauugauaacagccaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacaugguuaggauuaaacucaaggagcacgucccucucgaugacgugcauugcaguuggccuaguaacacuauaccuaggagucaugguucaggcggauucaggaugcguaauuaauuggaaggguagagaacucaaauguggaaguggcauuuuugucaccaaugaaguucacacuuggacagagcaauacaaauuucaagcugacuccccaaaaagacuaucagcagccaucgggaaggcaugggaggaggguguguguggaauucgaucagcaacucgucucgagaacaucauguggaagcaaauaucaaaugaacugaaccacaucuuacuugaaaaugacaugaaauucacagugguuguaggagauguugcugggaucuuggcucaagggaagaaaaugauuaggccacaacccauggaacacaaauacucguggaaaaauuggggaaaggcuaaaaucauaggggcagauguacagaacuccaccuucaucauugacggcccaaacaccccagaaugcucugaugaccaaagagcauggaacaucugggaaguugaggacuauggauuuggaauuuucacgacaaacauauggcugaaauugcgugacuccuacacccaagugugugaccaccggcuaaugucagcugccaucaaggacagcaaggcaguucacgcugacaugggguacuggauagaaagugaaaagaacgagaccuggaagcuggcaagagccuccuucauagaaguuaaaacauguauuuggccaaaaucccacacucuauggagcaauggaguucuggaaagugaaaugauaauuccaaagaucuauggaggaccaauaucucagcauaacuacagaccaggauauuucacacaaacggcagggccguggcaccuaggcaaguuggaauuggauuuugauuugugugaggguaccacagucguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgcuuccgacagaauggggaugggaacgacguaccuagcucugauggccacuuuuaaaaugagaccaauguuugcuguagggcuauuauuccgcagacuaacauccagagaaguucuucuucuaaccauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccaugacauuuaucaaaacaacguuuuccuugcacuaugcauggaagacaauggcuaugguacugucaauuguaucucucuuccccuuaugccuguccacgaccucccagaaaacaacauggcuuccggugcuauugggaucucuuggaugcaaaccacuaaccauguuucuuauagcagaaaacaaaaucuggggaaggaaaagcuggccccucaaugaagggaucauggcuguuggaauagucagcauccuacuaaguucacuccucaaaaaugaugugccccuagcugggccacuaauagcuggagguaugcuaauagcauguuauguuauaucuggaagcucagccgaccuaucacuagagaaagcagcugaggucuccugggaagaagaagcagaacacucuggugccucacacaacauauuaguggagguucaagacgauggaaccaugaagauaaaggacgaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccaaaaguggaaaaagcaguucuugaugaugguaucuauagaauuaugcagagaggacuguuggguaggucccaaguagggguaggaguuuuucaagaaaacguguuccauacaauguggcaugucaccaggggagcuguacucauguaucaagggaagagacuggaaccgagcugggccagugucaaaaaagaccugaucucauauggaggagguuggaggcuucaaggauccuggaacacgggagaagaagugcaggugauugcuguugaaccagggaaaaaccccaaaaauguacaaacggcgccgggcaccuuuaagaccccugaaggugaaguuggagccauugcccuagauuuuaaacccgguacaucuggaucccccaucgugaacagagaagggaaaauaguaggucuuuauggaaauggaguagugacaacaaguggaaccuacgucaguggcauagcucaagccaaagcaucacaagaagggccccuaccagagauugaagacgaaguguucaggaaaagaaacuuaacaauaauggaccuacauccaggaucgggaaaaacaagaagauaucuuccagccauaguccgugaggccauaaaaaggaagaugcgcacacuaauucuggcccccacaaggguugucgcuuccgaaauggcagaagcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagccacucccccaggaucaguggaggccuuuccacagaguaacgcagucauccaagaugaggaaagagacauuccugagagaucauggaacucaggcuaugaguggaucacugacuucccagguaaaacagucugguucguuccaagcauuaaagcaggaaaugacauugccaacugcuuaagaaagaauggaaaacgagugauucaauugagcaggaagaccuuugauacagaguaccaaaaaacaaaaaauaacgacugggacuacgucgucacaacagacaucuccgaaaugggagcaaacuuccgggccgacagggugauagacccaagacggugucugaaaccgguaauacuaaaagaugguccagagcgcgucauuuuagcaggaccgaugccagugacuguggccagugccgcccagaggagaggaagaauuggaaggaaccacaauaaggaaggugaucaguacaucuacaugggacagccuuuaaacaacgaugaaaaucacgcucacuggacagaagcaaaaaugcuccuugacaauauaaacacaccagaagggauuaucccagcccucuucgagccggagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagauuuggacaaaagaaggagaaagaaagaaacuacgcccccgcuggcuggaugccagaacauacucagacccacuggcccugcgcgaguuuaaagaguuugcagcaggaagaagaagcgucucaggugaucuaauacuagaaauagggaaacuuccacaacacuugacgcaaagggcccagaaugccuuggacaaccuggucauguugcacaacuccgaacaaggaggaagagccuauagacaugcaauggaagaacugccagauaccauagaaacguugaugcuccuagcuuugauagcuguguuaacugguggagugacgcuguucuuccuaucaggaaagggccuagggaaaacaucuaucggccuacucugcgugauggcuucaagcgcacugcuauggauggccaguguggagccccauuggauagcggccuccaucauacuggaguucuuccugaugguguugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacauagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaagugaacccacugacgcugacagcggcgguguugaugcuaguggcucauuacgccauaauuggaccuggacugcaagcaaaagcuacuagagaagcucaaaaaaggacagcggccggaauaaugaaaaauccaaccauugauggaauuguugcaauagauuuggacccugugguuuaugaugcaaaauuugagaaacaacuaggccaaauaaugcuguugauacuaugcacaucacagauccucuugaugcggacuacaugggccuugugcgaauccaucacacuggccacuggaccucugaccacacuuugggaaggaucuccaggaaaauuuuggaacaccacgauagcgguuuccauggcaaacauuuucagaggaaguuaucuagcaggagcaggucuggcuuucucauuaaugaaaucucuaggaggagguaggagaggcacgggagcccaaggggaaacacugggagagaaauggaaaagacagcugaaccaacugagcaagucagaauucaacaccuauaaaaggagugggauuauggaaguggacagauccgaagccaaagagggacugaaaagaggagaaacaaccaaacaugcagugucgagaggaaccgcuaaacuaaggugguuuguggagaggaaccuugugaaaccagaagggaaagucauagaccucgguuguggaagagguggcuggucauacuauugcgcugggcugaagaaagucacagaagugaagggauauacaaaaggaggaccaggacaugaggaaccaaucccaauggcgaccuauggauggaaccuaguaaaacugcacuccgggaaagacguauuuuuuauaccaccugagaaaugugauacccuuuugugugauauuggugaguccucuccaaacccaacuauagaggaaggaagaacgcuacgcguucuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguacuggguuucauguggaacaggaaacauugugucagcaguaaacaugacauccagaauguugcuaaaucgauuuacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcauggugaaacugcucaccaaaccaugggauguuauccccaugguuacacaaauagccaugacugacaccacacccuuuggacaacagaggguguuuaaagagaaaguugacacacgcacaccaaaagcaaaacgaggcacagcacaaaucauggaagugacagcuaggugguuauggaguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugaccgguucugggaccuugugcacagagagagggagcuucacaaacagggaaaaugugccacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuucacaaacuuggauauauacucagagacauaucaaagauuccagggggaaacauguaugcagaugacacagccggaugggauacaaggauaacagaggaugaccuccagaaugaggccaaaaucacugacaucauggaacccgaacaugcccuacuggccaagucaaucuucaagcuaaccuaccaaaauaaggugguaaggguacagagaccaucaaaaaauggaaccgugauggaugucauauccagacgugaccagagaggaaguggccagguuggaacuuauggcuuaaacacuuucaccaacauggaagcccagcugauaagacaaauggagucugaggaaaucuuuucacccaacgaauuagagaccccaaauuuagccaagagaguucucgacuggcuggaaaaauauggcgucgaaaggcugaaaagaauggcaaucaguggagaugacugcguagugaaaccaauugaugauagguuugcgacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugccaucuguucagccguuccaguugauuggguuccaaccagccgcaccacuuggucgauccaugcccaucaccaauggaugacaacagaagacaugcugucaguauggaauaggguuuggauagaggaaaacccauggauggaggacaaaacccguguauccaguugggaagauguuccauaccuagggaaaagggaagaucaaugguguggaucucugauaggcuuaacagcaagggccaccugggccaccaacauacaaguggccauaaaccaagugagaagacuaauugggaaugagaauuauucggauuacaugacaucaaugaagagauucaagaacgagagugaacccgaaggggcacucugguga

SEQ ID NO: 6219 - RNA, 9879 nt, Artificial Sequence
  derived and/or modified CDS sequence (wt) from DENV-1__KP406801__SS-prME
uccgugaccaugcuccucaugcugcugcccacagcccuggcguuccauuugaccacacgagggggagagccacauaugauagucagcaagcaggaaagaggaaagucacucuuguuuaagaccucggcaggugucaacauguguacccucauugcaauggauuugggagaguugugugaggacacaaugaccuacaaaugcccccggaucaccgaagcggaaccagaugacguugauugcuggugcaaugccacagacacaugggugaccuaugggacgugcucucaaacuggcgaacaccgacgggacaaacguucugucgcauuggccccacacguggggcuugguuuagaaacaagaaccgaaacguggauguccucugaaggcgccuggagacagauacaaaaaguggagacuugggccuugagacacccaggauucacggugauagcccuuuuccuagcacacaccauaggaacauccaucacccagaaagggaucaucuucauuuugcugaugcuggugacaccaucaauggccaugcgaugcgugggaauaggcaacagagacuucguugaagggcugucaggagcaacguggguggaugugguacuggagcauggaagcugcgucaccaccauggcaaaaaauaaaccaacauuggacauugaacucuugaagacggaggucacgaacccugccgucuugcgcaaacugugcauugaagcuaaaauaucaaauaccaccaccgauucacgaugcccaacacaaggagaagccacacugguggaagaacaggacgcgaacuuugugugucgacgaacauucguggacagaggcugggguaaugguuguggacuauucgggaaaggaagcuuacugacgugugcuaaauucaagugugugacaaaacuugaaggaaagauaguucaauaugaaaacuuaaaauauucggugauagucaccguccacacuggggaccagcaccaggugggaaaugagacuacagaacauggaacaauugcaaccauaacaccucaagcuccuacgucggaaauacagcuaacugacuacggagcccuuacauuggacuguucaccuagaacagggcuggacuucaaugagauggugcuguugacaaugaaagaaaaaucauggcuuguccacaaacaaugguuucuagacuuaccacugccuuggaccucgggggcuucaacaucucaagagacuuggaacagacaagauuugcuggucacauuuaagacagcucaugcaaagaagcaggaaguagucguacuggggucacaagaaggagcaaugcacacugcguuggcuggggcgacagaaauucagaugucaggaacgacgacaaucuucgcaggacaccugaaguguagacuaaaaauggauaaacugacuuugaaaggggugucauaugugaugugcacaggcucauuuaaguuagagaaggaaguagcugagacucagcauggaaccguucuagugcagguuaaauacgaaggaacagaugcaccaugcaagauucccuuuucaauccaagaugagaaaggagugacccagaaugggagauugauaacagccaaucccauagcuacugauaaagaaaagccagucaacauugagacagaaccaccuuuuggugagagcuacaucgugauaggggcgggugaaaaagcuuugaaacuaagcugguucaagaaaggaagcagcauagggaaaauguucgaagcuaccgcccggggagcacgaaggauggcuauccugggagacacugcaugggacuuugguuccauaggagggguguucacaucugugggaaaacugguacaccagguuuuuggaaccgcauauggggucuuguucagcgguguuucuuggacaaugaaaauaggaauagggauucugcugacauggcuaggauuaaauucaaggagcacgucacucucgaugacgugcauugcaguugguauggucacacuguacuuaggagucaugguucaagcggacucggggugugugaucaacuggaagggcagagaacucaaauguggaaguggcaucuuugucacuaaugaaguccacacuuggacagagcaauauaaauuccaggcugauuccccaaaaagacugucagcagccauugggaaggcaugggaggaaggcguguguggaauucgaucagccacacgucuugagaacaucauguggaagcaaauaucaaaugaauugaaccacauccuacuugaaaaugacaugaaauucacaguggucguaggagacgcuaauggaaucuugacccaagggaaaaagaugauuaggccacaacccauggaacacaaauacucauggaaaagcuggggaaaagccaaaaucauaggagcagacacacagaauaccaccuucaucauugauggcccagacacuccagaaugccccgaugaccagagagcauggaacauuugggaaguugaagacuauggguuugggauuuucacgacaaacauauggcugaaauugcgugacuccuacacccaaaugugugaucaccggcuaaugucagcugccaucaaggacagcaaggcaguccaugcugacaugggguacuggauagaaagugaaaagaacgagaccuggaagcuagcgagagccuccuucauagaagugaaaacaugcaucuggccaagaucccacacucuauggagcaauggagucuuggaaagugaaaugauaaucccaaagauauauggaggaccaauaucucagcacaacuacagaccaggguauuucacacaaacagcagggccauggcaucuaggcaaguuggaacuagacuuugauuugugugaaggcaccacaguuguuguggaugaacauuguggaaaucgaggcccaucucuuagaacuacaacaguuacaggaaagauaauccaugaaugguguugcagauccugcacgcuaccucccuuacgcuucaaaggagaagacggauguugguacggcauggaaaucagaccaguuaaggagaaggaagagaaucuagucaggucaauggucucugcagggucaggagaaguggacaguuuuucauugggacuacuaugcguaucaauaaugauugaagaagugaugagauccagauggaguagaaagaugcugaugacuggaacacuggcuguuuucuuccuccucauaaugggacaacugacauggaaugaucugaucagguuaugcaucaugguuggagccaacgucucagacaggauggggaugggaacaacguaccuagccuugauggcuacuuucaaaaugagaccgauguucgcuguugggcuauuauuccgcagacuaacauccagagagguucuccuucucacaauuggacuaagccugguggcauccguggagcuaccaaauucuuuagaggagcuaggggacggacuugcaaugggcaucaugauguuaaaauuauugacugauuuucagucacaccaguuauggacuaccuuacugucucugacauuuauuaaaacaacucuuucauuggauuaugcauggaagacaauagccaugguauugucaaucguaucucucuuuccuuuaugucuaucuacgaccucucaaaaaacaacauggcuuccggugcuguuaggaucuuuuggaugcaaaccacuaaccauguuucucauaacagaaaacaaaaucuggggaaggagaaguuggccucucaaugaaggaauuauggcuguuggaauagucagcauuuuacuaaguucacuccucaaaaaugaugugccacuagccggcccacuaauagcuggaggcaugcuaauagcauguuacgucauauccggaagcucggcugauuuaucauuggagaaagcagccgaggucuccugggaagaagaagcagaacacucuggugcuucacacaacauacuaguggagguccaagaugauggaacuaugaaaauaaaagaugaagagagagaugacacgcucaccauacuccucaaagcaacucuguuggcagucucagggguguacccaaugucaauaccagcaacccuuuuugugugguauuuuuggcagaaaaagaaacagagaucaggagucuugugggacacacccagcccuccagaaguggaaagagcaguucuugaugaugguaucuauagaaucuugcaaagaggacuguuggguaggucccaaguaggagugggaguuuuucaagacggcguguuccacacaauguggcaugucacuaggggggcuguccuuauguaccaggggaagaggcuggaaccaagcugggcuagugucaaaaaagacuugaucucauauggaggagguuggagguuucaaggaucauggaacacgggagaagaaguacaggugauagcuguugagccaggaaaaaacccaaaaaauguacagacaacgccggguaccuucaagaccccugaaggugaaguuggagcuauagcccuagauuuuaaacccggcacaucuggaucucccaucgugaacagagagggaaaaauaguaggucucuauggaaauggaguggugacaacaagcggaacauacgucagugccauugcccaagcuaaagcaucacaagaagggccucuaccagagauugaggacgagguguuuaagaaaagaaaccuaacaauaauggaccuacauccaggaucaggaaaaacaagaagauaucuuccagccauaguccgugaagccauaaaaaggaaacugcgcacgcuaaucuuggcccccacaagaguugucgccucugaaauggcagaggcgcuuaaaggaaugccaauaagauaucagacaacagcaguaaagagugaacacacaggaagggagauaguugaucucaugugccacgccacuuucaccaugcgucuccuaucuccagugagaguucccaacuacaauaugauuaucauggaugaagcacacuuuaccgauccagccagcauagcggcuagaggguacaucucaacccgaguggguaugggugaagcagcugcgaucuucaugacagcuacucccccaggaucgguagaggccuuuccacagagcaaugcaguuauacaagaugaggaaagagacauuccugagagaucauggaacucaggcuacgacuggaucacugauuuuccaggaaaaacagucugguuuguuccaagcaucaaaucaggaaaugacauugccaacuguuuaagaaagaacggaaaacgggugauccaauugagcagaaaaaccuuugacacugaauaccagaaaacaaaaaacaaugacugggacuauguugucacaacagacauuucugaaaugggagcaaauuuccgggccgacaggguaauagacccaaggcggugcuugaagccaguaauacuaaaagauggcccagagcgcgucauucuagccggaccaaugccagugaccguggccagugcugcccagaggagaggaagaauuggaaggaaccaaaacaaggaaggugaccaguauauuuauaugggacagccuuuaaauaaugaugaggaccacgcucauuggacagaagcaaaaaugcuccuugacaauauaaacacgccagaagggauuaucccagcccucuuugagccagagagagaaaagagugcagcaauagacggggaguacagacugcggggagaagcaaggaaaacguuuguggagcuaaugagaagaggggaucuaccagucuggcuaucuuacaaaguugccucagaaggcuuccaguacuccgacagaagguggugcuuugacggagaaaggaacaaccagguguuggaggagaacauggacguggagaucuggacaaaagagggagaaagaaagaaauuacgaccucgaugguuagaugccagaaccuacucugauccacuggcccugcgcgaguuuaaagaguucgcagcaggaagaagaagugucucaggugaccuaauauuagaaauagggaaacuuccacagcacuugacgcuaagggcccagaaugcuuuggacaauuuggucauguugcacaauuccgaacaggggggaaaagccuauagacaugcuauggaagaacuaccagacaccauagaaacauugaugcuccuagcucugauagcugugcugacugguggagugacguuguuuuuccuaucaggaaaaggucuagggaaaacauccauuggccuacuuugugugauggccucaaguguacuguuauggauggccaguguggagccccauuggauagcggccuccaucauacuagaguucuuucugauggugcugcucauuccagagccagacagacagcguacuccacaggacaaucaauuggcauauguggugauaggcuuguuauucaugauauugacaguggcagccaaugagaugggauuacuggaaaccacaaagaaagaccuggggaucggccauguagucgccgaaaaucaccaccaugcuacaaugcuagacauagacuuacauccagcuucagccuggacccucuaugcaguagcuacaacaauuauuacucccaugaugagacacacaauugaaaacacaacggcaaauauaucccugacagcuauugcaaaucaggcggcuauauugaugggacuugacaagggauggccaauaucgaagauggacauaggagugccacuucucgccuuagggugcuauucccaggugaacccauugacacugacagcggcgguguugauguuaguggcccauuaugccauaaucggaccuggacugcaagcaaaagccacuagagaagcccaaaaaaggacagcggcuggaauaaugaaaaauccaacuguagacggaauuguugcaauagauuuggauccugugguuuaugaugcaaaauuugaaaaacagcuaggccaaauaauguuauugauacuuugcacaucacagauucuuuugaugcggacuacaugggccuuaugugaauccaucacacuggcuacuggacccuugaccacucucugggaggguucuccaggaaaauucuggaauaccacgauagcaguguccauggcaaacaucuucaggggaagcuaucuagcaggagcaggucuggccuuuucauugaugaaaucuuuaggaggaggcaggagagguacgggagcucaaggggaaacauugggagaaaaauggaaaagacaacuaaaccaacugagcaagucagaauuuaacacuuacaaaaggaguggaauuauggagguggacagaucugaagccaaggagggacugaaaagaggagaaacaaccaaacaugcagugucgagaggaacagccaaacuuaggugguuuguggagaggaaccuugugagaccagaagggaaagugauagaccucgguuguggaagagguggcuggucauauuauugugcugggcugaagaagguuacagaagugaagggauacacaaaaggaggacccggucaugaggaaccuaucccaauggcgacuuauggauggaacuuagugaagcuauacuccggaaaagauguauucuuuacaccaccugagaaaugugacacccuuuugugugauauuggugaguccucuccgaauccaacuauagaagaaggaagaacguuacgcguucuaaagaugguggaaccauggcucagaggaaaucaguuuugcauaaaaauccuaaauccuuacaugccaagugugguagaaacucuggagcaaaugcaaagaaaacauggagggaugcuagugcgaaacccacucucaagaaauucuacccaugaaauguacuggguuucauguggaacaggaaacauugugucggcagugaacaugacauccagaaugcugcugaaucgguucacaauggcucacaggaagccaacauaugaaagagacguggacuugggcgcuggaacaagacauguggcaguggaaccagagauagccaaccuagacaucauuggccagaggauagagaacauaaaaaaugaacauaagucaacauggcauuaugaugaggacaauccauauaagacaugggccuaucauggaucauaugaggucaagccaucagggucagccucauccauggugaauggcguggugagauugcucaccaaaccaugggauguuauccccauggucacacaaauagcuaugacugauaccacacccuucggacaacagaggguguucaaagagaaaguugacacacgcacaccaagaccaaaacgaggcacagcacaaauuauggaggugacagcuaagugguugugggguuuccucucuagaaauaaaaaacccagaaucugcacaagagaggaguucacaagaaaaguuaggucaaacgcagcaauuggagcaguguucguugaugaaaaccaauggaacucagcaaaagaagcaguggaagacgaaaaguuuugggaccuugugcacagagagagggagcuucauaaacagggaaaaugugccacgugugucuacaacaugauggggaaaagagagaaaaaauuaggagaguuuggaaaggcaaaaggaagucgugcaauaugguacaugugguugggagcacgcuuucuagaguuugaagcccuuggcuucaugaaugaagaccacugguucaguagagagaauucacucaguggaguggaaggagaaggacuacacaaacuuggauacauacucagagacauaucaaagauuccagggggaaauauguaugcagaugacacagcuggaugggacacaagaauaacagaggaugaucuucagaaugaggccaaaaucacugacaucauggagcccgaacaugcucuacuggcuacgucaaucuucaagcugaccuaucaaaacaaggugguaagggugcaaagaccagcaaaaaguggaaccgugauggauguuauauccagacgugaccagagaggaaguggacaggucggaacuuaugguuuaaacacuuucacuaacauggagguccaacugauaagacaaauggaaucugaaggaaucuuuucacccagcgaacuggaaaauucaaaucuagcugagagaguucuagacuggcuggaaaaacauggcgucgaaagguugaaaagaauggcaaucagcggagaugacuguguggugaaaccaacugaugacagguucgcaacagcuuugacagcccugaaugacaugggaaaagugagaaaagacauaccgcaaugggaaccuucaaaaggauggaaugacuggcagcaagugccuuucuguucacaccauuuucaccaacugaucaugaaggaugggagggagauaguggugccaugccgcaaccaagaugaacuugugggcagagccagaguaucacaaggcgccggauggagccugagagaaacugcuugccuaggcaagucauaugcacaaauguggcagcugauguacuuccacaggagagaccuaagacuagcggccaaugcuaucuguucagccguuccaguugauugggucccaaccagccgcaccaccuggucgauccaugcccaccaccaauggaugacaacagaggacauguuaucaguguggaauaggguuuggauagaggaaaacccauggauggaggacaaaacucauguauccagcugggaagauguuccauacuuaggaaaaagggaagaucaaugguguggaucccugauaggcuuaacagcgagggccaccugggccaccaacauacaaguggccauaaaccaagugagaaggcucauugggaaugagaauuacuuagacuacaugacaucaaugaagagauucaagaaugagagugaucccgaaggagcccucugguaa

SEQ ID NO: 6220 - RNA, 9879 nt, Artificial Sequence
  derived and/or modified CDS sequence (wt) from DENV-1__KP406802__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcagguaucaacaugugcacccuuauagcgauggauuugggagaguuaugugaggacacacugacuuacaaaugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccuccgaaggcgcuuggaaacagauacaaagaguggagacuugggcccugagacacccaggauucacggugauagcccuuuuucuagcacaugccauaggaacauccaucacccagaaagggaucaucuucauuuuguuaaugcuggucacaccauccauggccaugcgaugcgugggaauaggcagcagggacuucguggaaggacugucaggagcaacuuggguagauguggugcuggaacauggaaguugcgucacuaccauggcaaaagacaaaccaacauuggacauugaacucuugaagacggaagucacaaacccugccguccugcgcaaacuaugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuuauaacgugugcuaaguucaagugugugacaaaacuggaaggaaaaauaguucaguaugaaaacuugaaauauucaguaauagucaccguccacacuggagaccagcaucaggugggaaaugaaagcacagaacaugggacaacugcaacuauaacaccucaagcuccuacgacagaaauacaguugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagaaauuuggaacagacaagauuugcuggugacauuuaagacagcucaugcaaagaagcaggaaguagucguacuaggaucacaagaaggagcaaugcacacugcgcugaccggagcgacggaaauccaaacgucuggaacgacaacaauuuuugcaggacacuugaaauguagacuaaagauggacaaacugacucuaaaagggaugucauaugugaugugcacaggcucauucaagcuagagaaagaaguggcugagacccagcauggaaccguucuagugcagaucaaauacgaaggaacagaugcaccaugcaagauuccuuuuucgacccaagaugaaaaaggaguaacccagaaugggagauugauaacagccaaucccauagucacugauaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagaucuuuggaacugcauauggaguuuuguucagcgguguuuccuggaccaugaaaauaggaauagggguucugcugacauggcuaggauuaaacucaaggagcacgucccuuucgaugacgugcauugcaguuggccuaguaacgcuauacuuaggagucaugguucaggcggauucaggauguguaauuaauuggaaagguagagaacucaaauguggaaguggcauuuuugucaccaaugaaguucacacuuggacagagcaauacaaauuucaagcugauuccccaaagagacuaucagcagccauugggaaggcaugggaggaggguguguguggaauucgaucagcaacucgucucgagaacaucauguggaagcaaauaucaaaugaauugaaccacaucuuacuugaaaaugacaugaaauucacagugguuguaggagauguugcugggaucuuggcucaagggaaaaaaaugauuaggccacaacccauggaacacaaauacucguggaaaagcuggggaaaggcuaaaaucauaggggcagauguacagaacaccaccuuuaucaucgacggcccaaacaccccagaaugcccugaugaucaaagagcauggaacauuugggaaguugaggauuauggauuuggaauuuucacgacaaacauauggcugaaauugcgugacuccuacacccaggugugugaccaccggcuaaugucagcugccaucaaggacagcaaggcaguucacgcugacaugggguacuggauagaaagugaaaagaacgagaccuggaagcuggcaagagccucuuucauagaagucaaaacauguaucuggccaaaaucucacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacggucguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguagggcuacuauuccgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuaugcauggaagacaauggcuaugguacugucaauuguaucucucuuccccuuaugccuguccacgaccucccaaaaaacaacauggcuuccggugcuguugggaucucuuggauguaaaccacuaaccauguuucuuauagcagaaaacaaaaucuggggaaggaaaaguuggccccucaaugaaggaaucauggcuguuggaauugucagcauccuacuaagcucacuccucaaaaaugaugugccgcuagcugggccacuaauagcuggaggcaugcuaauagcauguuauguuauaucuggaagcucagccgaucuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaaucaugcagagaggacuguugggcagaucccaaguagggguaggaguuuuucaagaaaauguguuccacacaauguggcaugucaccaggggagcuguacucauguaucaagggaagagacuggaaccgagcugggccagugucaaaaaagaccugaucucauauggaggagguuggaggcuucaaggaucuuggaacacaggagaagaagugcaggugauugcuguugaaccagggaaaaaccccaaaaauguacaaacagcgccgggcaccuuuaagaccccugaaggcgaaguuggagccauugcccuagauuuuaaacccggcacaucuggaucucccaucgugaacagagaagggaaaauaguaggucuuuauggaaauggaguagugacaacaaguggaaccuacgucagugccauagcucaagcuaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcgcacacuaauucuagcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccagcauagcggcuagaggguacaucucaacccgagugggcaugggugaagcagcugcgaucuucaugacagccacucccccaggaucaguggaggccuuuccacagagcaacgcaguuauccaagaugaggaaagagacauuccugagagaucauggaacucaggcuaugaguggaucacugacuucccaggcaaaacaguuugguuuguuccaagcauuaaaucaggaaaugauauugccaacugcuuaagaaagaaugggaaacgggugauucaauugagcagaaaaaccuuugacacagaguaccaaaaaacaaaaaauaacgacugggacuacgucgucacaacagacaucuccgaaaugggagcaaauuuccgggcagacagggugauagacccaagacggugucugaaaccgguaauacuaaaagaugguccagagcgugucauuuuagcaggaccgaugccagugacuguggccagugccgcccagaggagaggaagaguuggaaggaaccacaauaaggaaggugaucaguacaucuacaugggacagccuuuaaacaacgaugaagaucacgcucacuggacggaagcaaaaaugcuccuugauaauauaaacacaccagaagggauuaucccagcccucuucgagccggagagagaaaagagugcagcaauagacggggaauacagacugcggggugaagcaaggaaaacguuuguggagcucaugagaagaggagaucuaccugucuggcuauccuacaaaguugccucagaaggcuuccaguacucugauagaagauggugcuuugacggggaaaggaacaaccagguguuggaggagaacauggacguggagaucuggacaaaagaaggagaaagaaagaaacuacgaccccguuggcuggaugccagaacauacucagacccacuggcccugcgcgaguuuaaagaguuugcagcaggaagaagaagcgucucaggagaucuaauauuagaaauagggaaacuuccacaacacuugacgcaaagggcccagaaugccuuggacaaccugguuauguuacacaacuccgaacaaggaggaagagccuauagacaugcaauggaagaacugccagacaccauagaaacguugaugcuccuagcuuugauagcuguguuaacugguggagugacgcuguucuuccuaucaggaaggggcuuagggaaaacaucuaucggccuacucugcgugauggcuucaagcguacugcuauggauggccaguguagagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagccauauugaugggacuugacaaaggauggccaauaucgaagauggacauaggaguuccacuucucgccuuggggugcuauucccaagugaauccacugacgcugacagcggcgguauugaugcuaguggcucauuacgcuauaauuggaccuggacugcaagcaaaagcuacuagagaagcucaaaaaaggacagcggccggaauaaugaaaaauccaaccguugauggaaucguugcaauagauuuggacccugugguuuaugaugcgaaauuugagaaacaacuaggccaaauaauguuguugauacuaugcacaucacagauccucuugaugcggacuacaugggccuugugcgaauccaucacacuggccacuggaccucugaccacgcucugggagggaucuccaggaaaauuuuggaacaccacgauagcaguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacaccuauaaaaggagugggauuauggaaguggacagauccgaagccaaagagggacugaaaagaggggaaacaaccaaacaugcagugucgagaggaaccgcuaaauugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaagaaccaaucccaauggcgaccuauggauggaaccuaguaaagcugcacuccgggaaagacguauucuuuauaccaccugagaaaugugacacccucuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacauaugaaagagacguggaccuaggcgcuggaacaagacauguggcaguggaaccagagguagccaaccuagauaucauuggccagaggauagagaacauaaaacaugaacacaagucaacauggcauuaugaugaggacaauccauauaaaacaugggccuaucauggaucauaugaggucaagccaucaggaucagccucauccauggucaaugguguggugaaacugcucaccaaaccaugggaugucauccccauggucacacaaauagccaugacugacacuacacccuuuggacaacagaggguguuuaaagagaaaguugacacacgcacaccaaaagcaaaacgaggcacaacacaaaucauggaggugacagccaggugguuaugggguuuucuuucuagaaacaagaagccaagaauuuguacaagagaggaguuuacaagaaaaguuaggucaaacgcagccaucggagcaguguucguugacgaaaaucaauggaacucagcaaaagaagcaguggaagaugagcgguucugggaccuugugcacagagagagggagcuucacaaacagggaaaaugugcuacguguguuuacaacaugauggggaagagagagaaaaagcuaggagaauuuggaaaggcaaaaggaagucgugcaauaugguacaugugguugggagcacgcuuucuagaguucgaagcucuugguuucaugaacgaagaccacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccaaaauuacugacaucauggaacccgaacaugcccuacuggcuaaggcaaucuucaagcuaaccuaccaaaauaaagugguaaggguacagagaccagcaaaaaauggaaccgugauggaugucauauccagacgugaccagagaggaaguggccaggucggaacuuauggcuuaaacacuuucaccaacauggaagcccagcugauaagacaaauggagucugagggaaucuuuucacccagugaauuagagaccccaaauuuagccgagagaguucucgacuggcuggaaaaauauggcgucgaaaggcuaaaaagaauggcaaucaguggagaugacugcguagugaaaccaauugaugauagguuugcaacagccuuaacagcucugaaugauaugggaaaaguaagaaaagauauaccacaaugggaacccucaaaaggauggaaugauuggcaacaagugccuuuuuguucacaccacuuccaccagcugauuaugaaggaugggagggaaauaguggugccaugccgcaaccaagaugaacuuguggguagagcuagaguaucacaaggugcuggauggagccugagagaaaccgcaugccuaggcaaaucauaugcacaaauguggcagcugauguacuuccacaggagagaccugagacuagccgcuaaugcuaucuguucagccguuccaguugauugggucccaaccagccguaccaccuggucgauccaugcccaucaccaauggaugacaacagaagacaugcugucaguguggaauaggguuuggauagaggaaaacccauggauggaggacaaaacccauauauccaguugggaagauguuccauauuuagggaaaagggaagaucaaugguguggaucccugauaggcuuaacagcaagggccacuugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6221 - RNA, 9879 nt, Artificial Sequence
  derived and/or modified CDS sequence (wt) from DENV-1__KP406803__SS-prME
ucugugaccaugcuccucaugcugcugcccacagcccuagcguuucaucugaccacucggggaggagagccgcacaugauaguuagcaagcaggaaagaggaaaaucacuuuuguuuaagaccucugcaggugucaacaugugcacccuuaucgcaauggauuugggagaguuaugugaggacacaaugaccuacaaaugccccaggaucacugagacggagccagaugacguugacuguuggugcaaugccacggagacaugggugaccuauggaacauguucucaaacuggugaacaccgacgagacaaacguuccgucgcauuggcaccacacguagggcuuggccuagaaacaagaaccgaaacguggauguccucugaaggugcuuggagacaaauacaaaaaguggagacuugggcucugagacacccaggauucacggugauagcccuuuuuuuagcacaugcuauaggaacauccaucacccagaaagggauuauuuuuauuuugcugaugcugguaacuccauccauggccaugcggugcgugggaauaggcaacagagacuucguggaaggacugucaggagcuacguggguggauguaguacuggagcauggaaguugugucacuaccauggcaaaagacaaaccaacacuggacauugaacuccugaagacggaggucacaaacccugcaguccugcgcaaacugugcauugaagcuaaaauaucaaauaccaccaccgauucgagauguccaacacaaggagaagccacgcugguggaagagcaggacacgaacuuugugugccgacgaacguucguggacagaggcuggggcaaugguugugggcuauucggaaaagguagcuuaauaacgugugcuaaguuuaagugugugacaaaacuggaaggaaagauaguccaauaugaaaacuuaaaauauucagucauagucaccguacacacuggagaccaacaccaaguuggaaaugagaccacagaacauggaacaacugcaaccauaacaccucaagcucccacgucggaaauacagcugacagacuacggagcucuaacauuggauuguucaccuagaacaggacuagacuuuaacgagaugguguuguugacgaugaaagaaaaaucauggcucguccacaaacaaugguuucuggaccuaccacugccuuggaccucgggggccucaacaucccaagagacuuggaauagacaagacuugcuggucacauuuaagacagcucaugcaaaaaagcaggaaguagucguacuaggaucacaagaaggagcaaugcacacugcgcugacuggagcgacagaaauccaaacgucuggaacgacaacaauuuuugcagggcaccugaaaugcagacuaaaaauggauaaacugaccuuaaaagggguaucauauguaaugugcacagggucauucaagcuagagaaggaaguggcugagacccagcauggaacuguucuagugcaaguuaaauacgaaggaacagaugcaccaugcaagauccccuucucgucccaagaugagaagggaguaacccagaauggaagauugauaacagccaaccccauaguuacugacaaagaaaaaccagucaacauugaagcggagccaccuuuuggugagagcuaccuugugguaggagcaggugaaaaagcuuugaaacuaagcugguucaagaagggaagcaguauagggaaaauguuugaagcaacugcccgcggagcacgaaggauggccauccugggagacaccgcaugggacuucgguucuauaggagggguguucacgucugugggaaaacugauacaccagauuuuugggacugcguauggagucuuguucagcgggguuucuuggaccaugaaaauaggaauagggauucuguugacauggcuaggauuaaauucaaggagcacgucccuuucaaugacguguaucgcaguuggcauggucacacuguaccuaggagucaugguucaggcggacucgggauguguaaucaacuggaaaggcagagaacucaaauguggaagcggcauuuuugucaccaaugaaguccacaccuggacagagcaauacaaauuccaggccgacucccccaagagacuaucagcggccauugggaaggcaugggaggagggugugugugggauccgaucagccacucgucucgagaacauuauguggaagcaaauaucaaaugaauuaaaccacaucuuacuugaaaaugacaugaaauuuacaguggucguaggagacguuaauggaaucuuggcccaaggaaagaaaaugauuaggccgcaacccauggaacacaaauacucguggaaaagcuggggaaaagccaaagucauaggagcagauguacagaauaucaccuucaucaucgauggcccaaacaccccagaaugcccugaugaucaaagagcauggaauaucugggaagucgaagacuauggauuuggaauuuucacgacaaacauaugguugaaauugcgugacuccuacacucaagugugugaccaccggcuaaugucagcugccaucaaggauagcaaagcaguccaugcugacaugggguacuggauagaaagugaaaagaacgagacuuggaaguugacaagagccuccuucauagaaguuaagacaugcgucuggccaaaaucccacacccuauggagcaauggagucuuggaaagugagaugauaaucccaaagauauauggaggaccaauaucccagcacaacuacagaccaggauauuucacacaaacagcagggccguggcacuugggcaagcuagaacuggauuuugguuuaugugaagguaccacuguuguuguggaugaacauuguggaaaucgaggaccaucucuuagaaccacaacagucacagggaagauaauccaugaauggugcuguagaucuugcacguuacccccccuacguuucaaaggagaagacgggugcugguacgguauggaaaucagaccagucaaggagaaggaagagaaccuagucaagucaauggucucugcagggucaggagaaguggacaguuuuucacuaggacugcuaugcauaucaauaaugaucgaagagguaaugagauccagauggagcagaaaaaugcugaugacuggaacauuggcuguguuccuccuucuuauaaugggacaguugacauggaaugaucugaucagacuguguaucaugguuggagccaaugcuucagacaagauggggaugggaacgacguaccuagcuuugauggccacuuucagaaugagaccaauguuugcagucgggcuacuguuucgcagauuaacaucuagagaaguucuccuucuuacaguuggauugagucuaguggcaucuguagaacuaccaaauuccuuggaggagcuaggggauggacuugcaaugggcaucaugauguugaaauuacugacugauuuucagucacaucaacuaugggcugccuugcugucuuuaacauuugucaaaacaacuuuuucacugcacuaugcauggaagacaauggcuaugauacugucaauuguaucucucuucccuuuaugucuguccacgacuucucaaaaaacaacauggcuuccgguguugcugggaucucuuggaugcaaaccacuaaccauguuucuuauuacagaaaacaaaaucuggggaaggaaaagcuggccucucaaugagggaauuauggcuguuggaauaguuagcauucuucuaaguucacuucuaaaaaaugauguaccacuagcuggcccacuaauagcuggaggcaugcugauagcauguuaugucauaucuggaagcucggccgauuuaucacuggagaaagcagcugaggucuccugggaagaagaagcagaacauucuggugccucacacaacauacuaguggagguccaagaugauggaaccaugaagauaaaagaugaagagagagaugacacacuuaccauucuccucaaagcaacucugcuagcaaucucagggguauacccaaugucaauaccggcgacccucuuugugugguauuuuuggcagaaaaagaaacagagaucaggagugcuaugggacacacccagcccuccagaaguggaaagagcaguccuugaugaugguauuuauagaauucuccaaagaggacuguugggcaagucucaaguaggaguaggaguuuuucaggaagguguguuccacacaauguggcacgucaccaggggagcuguccucauguaccaagggaagagauuggaaccaaguugggccagugucaaaaaagacuugaucucauauggaggagguuggagguuucaaggauccuggaacacgggagaagaagugcaggugauugcuguugaaccggggaagaacccuaaaaauguacagacagcgccggguaccuuuaaaaccccugaaggcgaaguuggagccauagcucuagacuuuaaacccggcacaucuggaucucccauugugaacagagagggaaaaauaguaggucuuuauggaaauggaguggugacaacaaguggaaccuacgucagugccauagcucaagccaaagcaucacaagaagggccucuaccagagauugaggacgagguguuuaggaaaagaaacuugacaauaauggaccuacauccaggaucgggaaaaacaagaagauaccuuccagccauaguccgugaggcuauaaaaagaaagcuacgcacgcuagucuuagcucccacaagaguugucgccucugaaauggcagaggcacucaagggaauaccaauaagguaccagacaacagcagugaaaagugaacacacgggaaaggagauaguugaccuuaugugucacgccacuuuuaccaugcgucuccucuccccugugagaguucccaauuauaauaugauuaucauggaugaagcacauuucacugauccagccagcauagcagccagaggguauaucucaacccgaguggguaugggugaagcagcugcaauuuucaugacagccacccccccuggaucgauggaggccuuuccacagagcaaugcagcuauccaagaugaggaaagagauauuccugaaaggucuuggaacucaggcuaugacuggauuacugauuucccaggaaaaacaguuugguuuguuccaagcaucaaaucaggaaaugacauugccaacuguuuaagaaagaaugggaaacgggugguccaauugagcaggaaaaccuuugacacugaguaccagaagacaaaaaauaacgacugggacuauguugucacaacagacauauccgaaaugggagcaaacuuccgagcugacaggguaauagauccaaggcggugccuaaaaccgguaauacuaaaagauggcccagagcgugucauucuagccggaccgaugccagugacuguggcuagcgccgcccagaggagaggaagaauuggaaggaaccaaaauaaggaaggugaucaguauauuuacaugggacagccucuaaacaaugaugaggaccaugcccauuggacagaagcaaaaaugcuccuugacaacauaaacacaccagaagggauuaucccagcccucuuugagccggagagagaaaagagcgcagcaauagacggggaauacagacuacggggugaagcgaggaaaacuuucguggagcuuaugagaagaggagaucuaccugucuggcuguccuacaaaguugcuucagaaggcuuccaguacuccgacagaagguggugcuuugauggagaaaggaacaaccaggugcuggaggagaacauggauguggagaucuggacaaaagaaggagaaagaaagaaacuacgaccccgcuggcuggaugccagaacauacucugacccacuggcucugcgcgaauucaaagaguucgcagcaggaagaagaagcgucucaggugaccuaauauuagaaauagggaaacuuccacaacaucuaacgcaaagggcccagaaugccuuggacaaccugguuaugcugcacaacucugaacagggaggaaaagccuauagacacgccauggaagaauuaccagacacuauagaaacauuaaugcuucuggcuuuaauagcugugcugacugguggggugacguuguucuuccuaucaggaaggggucuaggaaaaacauccauuggucuacucugcgugauggccucaagugcacuguuauggauggccaguguggaaccccauuggauagcggccucuaucauacuggaguucuuucugaugguguugcuuauuccagaaccggacagacagcgcacuccacaagacaaccagcuagcauacguggugauaggucuacuauucaugauauugacaguggcagccaaugagaugggauuacuggaaaccacaaagaaggaccuagggauuggucauguggcugcugaaagccaccaucaugcugcaaugcuggacguggaccuacauccagcuucagccuggacccucuaugcaguggccacaacaauuaucacucccaugaugagacacacaauugaaaacacaacggcaaacauuucccugacagcuaucgcaaaccaggcagcuauauugaugggacuugacaagggauggccaauaucaaagauggacauaggaguuccccuucuugccuugggguguuacucucaggugaacccgcugacgcugacagcggcgguguugaugcuaguggcucauuaugccauaauuggacccggacugcaagcaaaagcuacuagagaagcucaaaaaaggacagcagcuggaauaaugaaaaacccaacuguugaugggaucguugcaauagauuuggacccugugguuuacgaugcaaaauuugagaaacagcuaggccaaauaaugcuguugauacuuugcacaucacagauucuccugaugcggaccacaugggccuugugugaauccaucacacuagccacuggaccucugaccacacucugggagggaucuccaggaaaauucuggaauaccacgauagcgguguccauggcaaacaucuuuaggggaagcuaucuagcaggagcaggucuggccuuuucauuaaugaaaucucuaggaggagguaggagaggcacgggagcccaaggggaaacacugggagaaaaauggaaaagacagcugaaccaacugaguaagucagaauucaacaccuacaaaaggagcgggaucauagagguggauagaucugaagccaaagagggguuaaaaagaggagaaacgacuaaacacgcggugucgagaggaacggccaaacugaggugguuuguagagaggaaccuugugaaaccagaagggaaagucauagaccucgguuguggaagagguggcuggucauauuauugcgcugggcugaagaaagucacagaagugaaaggauacacgaaaggaggaccugggcaugaggaaccaauuccaauggcaaccuauggauggaaccuaguaaaacuauacuccgggaaagauguguucuuuacaccaccugagaaaugugacacccucuugugcgauauuggugaguccucuccgaacccaaccauagaagaaggaagaacguuacgaguucuaaggaugguggaaccauggcuuagaggaaaccaauuuugcauaaaaguucuaaaucccuauaugccaagcgugguagaaacuuuggagcaaaugcaaagaaaacauggaggaaugcuagugcgaaauccacucucaagaaacuccacucaugaaauguacuggguuucauguggaacaggaaauauugugucagcagugaacaugacaucuagaaugcugcuaaaucgauucacaauggcucacaggaagccaacauaugagagagacguggacuuaggcgcuggaacaagacauguggcaguagaaccagagguggccaacuuagauaucauuggccagaggauagaaaauauaaaaaaugaacacaaaucaacauggcauuaugaugaagauaauccauacaaaacaugggccuaucauggaucauaugaggucaaaccaucaggaucagccucauccauggucaaugguguggugagacugcuaaccaaaccaugggaugucauccccauggucacacaaauagccaugacugacacuacacccuuuggacaacagaggguguucaaagagaaaguugacacacgcacaccaaaagcgaagcgaggcacagcacaaauuauggaggugacagcuaggugguuaugggguuuucucucuagaaacaaaaaacccagaaucugcacaagagaggaguucacaagaaaagucaggucaaacgcagcuauuggagcaguguucguugaugaaaaucaauggaacucagcaaaagaggcaguggaagaugaacgguucugggaccuugugcacagagaaagggagcuucacaagcaaggaaaaugugccacgugugucuacaacaugaugggaaagagagagaaaaaauuaggagaguuuggaaaggcaaaaggaagccgcgcaauaugguacaugugguugggagcgcgcuuuuuagaguuugaagcccuugguuucaugaaugaagaucauugguucagcagagagaauucacucaguggaguggagggagagggacuccacaaacuuggauacauacucagagacauaucaaagauuccagggggaaauauguaugcagaugacacagccggaugggacacaagaauaacagaggaugaucuucagaaugaggccaaaaucacugacaucauggaaccugaacaugcccuacuggccacgucaaucuuuaagcuaaccuaccaaaacaagguaguaagggugcagagaccagcaaaaaauggaaccgugauggaugucauauccagacgugaccagagaggaaguggacagguuggaaccuauggcuuaaacaccuucaccaacauggaggcccaacuaauaagacaaauggagucugagggaaucuuuuuacccagcgaauuggaaaccccaaaucuagcugaaagaguccuugacugguuggaaaaauauggcaucgagaggcugaaaagaauggcaaucaguggagacgacuguguggugaaaccaauugaugacagauucgcaacagccuuaacagcuuugaaugacaugggaaagguaagaaaagacauaccacaaugggaacccucaaaaggauggaaugauuggcaacaagugccuuucuguucacaccauuuccaccagcugauuaugaaggaugggagggagauaguggugccaugccgcaaccaagaugaacuuguggguagggcuagaguaucacaaggcgccggauggagccugagagaaacugcaugccuaggcaagucauaugcgcaaauguggcagcugauguauuuccacaggagagacuugagauuagcggcuaaugcuaucuguucagccgucccgguugauugggucccaaccagccgcaccaccuggucgauccaugcccaccaccaauggaugacaacagaagacauguugucaguguggaauaggguuuggauagaggaaaacccauggauggaggauaaaacucauguguccaguugggaagacguuccauaccuaggaaaaagggaagaucaaugguguggaucccuaauaggcuuaacagcacgagccaccugggccaccaacauacaaguggccauaaaccaagugagaaggcucauugggaaugagaauuaucuagacuacaugacaucaaugaagagauucaaaaacgagagugaucccgaaggggcacucugguga

SEQ ID NO: 6222 - RNA, 9879 nt, Artificial Sequence
  derived and/or modified CDS sequence (wt) from DENV-1__KJ438293__SS-prME
ucugugaccaugcuccuuaugcugaugccuacagccuuggcguuccauuugacuacacgagggggagagccgcacaugaucgucagcaagcaggaaagaggaaagucacuuuuguuuaagaccucagcaggugucaacaugugcacccuuauagcgauggauuugggagaguuaugugaggauacaaugacuuacaaaugcccuagaaucacugaggcggaaccagaugacguugauuguugguguaaugccacagacacaugggugaccuauggaacauguucccaaacuggcgagcaccgacgagacaaacguuccgucgcacuggccccacaugugggacuugguuuggaaacaagaacugaaacguggauguccucugaaggcgcuuggaaacagauacaaagaguggagacuugggcccugagacacccaggauucacggugauagcccucuuucuagcacaugccauaggaacauccaucacccagaaagggauuaucuucauuuuguuaaugcugguuacaccauccauggccaugcgaugcgugggaauaggcagcagggacuuuguggaaggacugucaggagcaacuuggguagauguggugcuggaacauggaaguugcgucacuaccauggcaaaagacaaaccaacacuggacauugaacucuugaagacggaagucacaaacccugccauccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuuaugacgugugcuaaguucaagugugugacaaaacuggaaggaaaaauaguucaauaugaaaacuugaaauauucaguaauagucaccguccacacuggagaccagcaccaggugggaaaugaaagcacagaacaugggacaacugcaacuauaacaccucaagcuccuacgacggaaauacagcugacugacuacggagcucuuacauuggauuguucaccuagaacaggacuagacuuuaaugaaaugguguuguugacaaugaaagaaaaaucauggcuaguucacaaacaaugguuucuagaccuaccacugccuuggaccucgggagcuucaacaucacaagaaacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagccaaccccauagucacugacaaagaaaaaccagucaacauugaggcagaaccgccuuuuggugagaguuacaucgugauaggagcaggugaaaaagcuuugaaaauaagcugguucaaaaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucucuuucgaugacgugcauugcaguuggccugguaacgcuauacuuaggagucaugguucaggcggauucaggcuguguaauuaauuggaaagguagagaacucaaauguggaaguggcauuuuugucaccaaugaaguucacacuuggacagagcaauacaaauuucaagcugauuccccaaagagacuaucagcagccauugggaaggcaugggaggaggguguguguggaauucgaucagcaacccgucucgagaacaucauguggaagcaaauaucaaaugaauugaaccacaucuuacuugaaaaugacaugaaauucacagugguuguaggagauguugcugggauauuggcucaagggaagaaaaugauuaggccacaacccauggaauacaaauacucguggaaaagcuggggaaaggcuaaaaucauaggggcagauguacagaacaccaccuucaucaucgacggcccaaacaccccagaaugcccugaugaucaaagagcguggaacauuugggaaguugaggauuauggauuuggaauuuucacgacaaacauauggcugaaauuacgugacuccuacacccaagugugugaccaccggcuaaugucagcugccaucaaggacagcaaggcaguucacgcugacaugggguacuggauagaaagugaaaagaacgagaccuggaagcuggcaagagccucuuucauagaagucaaaacauguaucuggccaaaaucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccagucaaagaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucauggucggagccaacgcuuccgacaggauggggaugggaacgacauaccuagcucugauggccacuuuuaaaaugagaccaauguuugcuguagggcuacuauuccgcagacuaacauccagagaaguucuucuucuaacaauuggauugagucuaguggcaucuguggaguuaccaaauuccuuggaggagcugggggauggacuugcaaugggcauuaugauuuuaaaacuauugacuggcuuucaaucacaucagcugugggcuaccuugcuguccuugacauuuaucaaaacaacguuuuccuugcacuaugcauggaagacaauggcuaugguacugucaauuguaucucucuuccccuuaugccuguccacgaccucccaaaaaacaacauggcuuccggugcuauugggaucucuuggaugcaaaccacuaaccauguuucuuauaacggaaaacaaaaucuggggaaggaaaaguuggccccucaaugaaggaaucauggcuguuggaauaguuagcauccuacuaaguucacuccucaaaaaugaugugccgcuagcugggccacuaauagcuggaggcaugcuaauagcauguuauguuauaucuggaagcucagccgaucuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauugucaauaccagcgacccuuuuugugugguacuuuuggcaaaaaaagaaacagagauccggaguguuaugggacacaccuagcccuccagaaguggaaagagcaguucuugaugaugguaucuauagaaucaugcagagaggacuguugggcaggucccaaguagggguaggagucuuucaagagaacguguuccacacaauguggcaugucaccaggggagcuguacucauguaucaagggaagagacuagaaccgagcugggccagugucaaaaaagaccugaucucauauggaggagguuggaggcuucaaggauccuggaacacgggagaagaagugcaggugauugcuguugaaccagggaagaacccaaaaaauguacaaacagcgccgggcaccuuuaagaccccugaaggcgaaguuggagccauugcccuagauuuuaaacccggcacaucuggaucucccaucgugaacagagaaggaaaaauaguaggucuuuauggaaauggaguagugacaacaaguggaaccuacgucagugccauagcucaagcuaaagcaucacaggaagggccccuaccagagauugaagacgagguguuuaggaaaagaaacuuaacaauaauggaccuacauccaggaucggggaaaacaagaagauaccuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccguccagcauagcggcuagaggguacaucucaacucgagugggcaugggugaagcagcugcgaucuucaugacagccacucccccaggaucaguggaggccuuuccacagagcaacgcaguuauccaagaugaggaaagagacauuccugagagaucauggaacucaggcuaugacuggaucacugacuucccaggcaaaacaguuugguuuguuccaagcauuaaaucaggaaaugauauugccaacugcuuaagaaagaauggaaaacgggugauucaauugagcaggaaaaccuuugacacagaguaccaaaaaacaaaaaauaacgacugggacuacgucgucacaacagacaucucagaaaugggagcaaauuuccgggccgacagggugauagacccaagacgguguuugaaaccgguaauacuaaaagaugguccagagcgugucguuuuagcaggaccgaugccagugacuguggccagugccgcucagaggagaggaagaauuggaaggaaccacaauaaggaaggugaucaguacauuuacaugggacagccuuuaaacaacgaugaagaucaugcucauuggacggaagcaaaaaugcuccuugauaauauaaacacaccagaagggauuaucccagcccucuucgagccggagagagaaaagagugcagcaauagauggggaauacagacugcggggugaagcaaggaaaacguuuguggagcucaugagaagaggagaucuaccugucuggcuauccuacaaaguugccucagaaggcuuccaguacucugauagaagaugguguuuugacggggaaaggaauaaccagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaacgccuuggacaaccugguuauguugcacaacuccgaacaaggaggaagagccuauagacaugcaauggaagaacugccagacaccauagaaacguuaaugcuccuagcuuugauagcuguguuaacugguggagugacgcuguucuuccuaucaggaaggggccuagggaaaacaucuaucggccuacucugcgugauggcuucaagcguacugcuauggauagccaguguagagccccauuggauagcggccuccaucauacuggaguucuuccugauggugcugcuuauuccagagccagauagacaacgcacuccgcaggacaaccagcuggcauauguggugauagguuuguuauucaugauacugacaguagcagccaaugagaugggauugcuggaaaccacaaagaaagacuuagggauuggccauguggccguugaaaaucaccaccaugccgcaauacuggacguagacuuacauccagcuucagccuggacccucuaugcgguggccacaacaaucaucacucccaugaugaggcacacaaucgaaaacacaacggcaaacauuucccugacagccauugcaaaccaggcagcgauauugaugggacuugacaaaggauggccaauaucaaaaauggacauaggaguuccacuucucgccuuagggugcuauucccagguaaauccacugacgcugacagcggcgguacugaugcuaguggcucauuacgcuauaauuggaccuggacugcaagcaaaagcuacuagagaagcucaaaaaaggacagcggccggaauaaugaaaaauccaaccguugauggaaucguugcaauagauuuggacccugugguuuaugaugcgaaauuugagaaacaacuaggccaaauaauguuguugauacuaugcacaucacagauccucuugaugcggacuacaugggccuugugcgaauccaucacacuggccacuggaccucugaccacgcucugggagggaucuccagggaaauuuuggaacaccacgauagcaguuuccauggcaaacauuuucaggggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacaccuauaaaaggagugggaucauggaaguggacagauccgaagccaaagagggacugaaaaggggagaaacaaccaaacaugcagugucgaggggaaccgcuaaauugaggugguuuguggagaggaaccuugugaaaccagaagggaaagucauagaccucgguuguggaagagguggcuggucauacuauugcgcugggcugaagaaagucacagaagugaaaggauacacaaaaggaggaccuggacaugaagaaccaaucccaauggcgaccuauggauggaaccuaguaaagcuguacuccgggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaauguuagugcgaaauccacugucaagaaauucuacucaugaaauguacuggauuucauguggaacaggaaacauugugucagcaguaaacaugacauccagaauguugcuaaaucgauucacaauggcucacaggaaaccaacauaugaaagagauguggaccuaggcgccggaacaagacauguggcaguggaaccagagguagccaaccuagauaucauuggccagaggauagagaacauaaaacaugaacacaaaucaacauggcauuaugaugaggacaauccauauaaaacaugggccuaucauggaucauacgaggucaagccaucaggaucagccucauccauggucaauggcguggugaaacugcucaccaaaccaugggaugucauccccauggucacacagauagccaugacugacacuacacccuuuggacaacagaggguguucaaagagaaaguugacacacgcacaccaaaagcaaaacgaggcacagcacaaaucauggaggugacagccaggugguuaugggguuuucuuucuagaaacaagaagccaagaauuugcacaagagaggaguucacaagaaaaguuaggucaaacgcagccaucggagcaguguucguugacgaaaaucaauggaacucagcaaaagaagcaguggaagaugagcgguucugggaccuugugcauagagagagggagcuucacaaacagggaaaaugugccacguguguuuacaacaugauggggaagagagagaaaaagcuaggagaguuuggaaaggcaaaaggaagucgugcaauaugguacaugugguugggagcacgcuuucuagaguucgaagcucuuggcuucaugaacgaagaccacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccaaaauuacugacaucauggaacccgaacaugcccuacuggcuaaggcaaucuucaagcuaaccuaccaaaacaaagugguaaggguacagagaccagcaaaaaauggaaccgugauggaugucauauccagacgugaccagagaggaaguggccaggucggaacuuauggcuuaaacacuuucaccaacauggaagcccagcugauaagacaaauggagucugagggaaucuuuucacccagugaauuagagaccccaaauuuagccgagagaguucucgacuggcuggaaaaauauggcgucgaaaggcuaaaaagaauggcaauuaguggagaugacugcguagugaaaccaauugaugauagguuugcaacagccuuaacagcucugaaugauaugggaaaaguaagaaaagauauaccacaaugggaacccucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaaccgcaugccuaggcaaaucauaugcacaaauguggcagcugauguacuuccacaggagagacuugagacuagccgcuaaugcuaucuguucagccguuccaguugauugggucccaaccagccgcaccaccuggucgauccaugcccaucaucaauggaugacaacagaagacaugcugucaguguggaauagaguuuggauagaggaaaacccauggauggaggacaaaacccauauauccaguugggaagauguuccauauuuagggaaaagggaagaucaaugguguggaucccugauaggcuuaacagcaagagccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6223 - RNA, 9879 nt, Artificial Sequence
  derived and/or modified CDS sequence (wt) from DENV-1__KJ438296__SS-prME
ucugugaccaugcuccuuaugcugaugcccacagccuuggcguuccauuugacuacacgagggggagagccgcacaugaugguuagcaagcaggaaagaggaaagucacuucuguuuaagaccucagcaggugucaacaugugcacccuuauagcgauggauuugggagaguuaugugaggacacaaugacuuacaaaugcccucgaaucacugaggcggaaccagaugauguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccuccgaaggcgcuuggaaacagauacaaagaguggagacuugggcccugagacauccaggauuuacggugauagcccucuuucuagcacaugccauaggaacauccaucacccagaaagggauuaucuucauuuuguuaaugcugguuacaccauccauggccaugcgaugcgugggaauaggcagcagggacuucguggaaggacugucaggagcaacuuggguagauguggugcuggaacauggaaguugcgucacuaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacugguggaagaacaagacgcgaauuuugugugucgacgaacguuuguggauagaggcuggggcaauggcugugggcucuucggaaaaggaagccuuauaacgugugcuaaguucaagugugugacaaaauuggaaggaaaaauaguucaauaugaaaacuugaaauauucaguaauugucaccguccacacuggagaccagcaccaagugggaaaugaaagcacagaacaugggacaacugcaacuauaacaccucaagcucccacgacggaaauacagcugaccgacuacggagcucuuacacuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagaaacuuggaacagacaagauuugcuggugacauucaagacagcucaugcaaagaagcaggaaguagucguacuaggaucacaagaaggagcaaugcacacugcguugaccggagcgacagaaauccaaacaucuggaacgacaacaauuuuugcaggacauuugaaauguagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagauuccuuuuucgacccaagaugaaaaaggaguaacccagaaugggagauugauaacagccaaccccauaguuacugacaaagaaaagccagucaacauugaggcggaaccgccuuuuggugagaguuacauugugauaggagcaggugaaaaagcuuugaaacuaagcugguucaagaaaggaaguagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcaguuggccuaguaacgcuauacuuaggagucaugguucaggcggauucaggauguguaauuaauuggaaagguagagaacucaaauguggaaguggcauuuuugucaccaaugaaguccacacuuggacagagcaauacaaauuucaagcugacuccccaaagagacuaucagcagccauugggaaggcaugggaggaggguguguguggaauucgaucagcaacucgucucgagaacaucauguggaagcaaauaucaaaugaauugaaccauaucuuacuugaaaaugacaugaaauucacagugguuguaggagauguugcugggaucuuggcucagggaaaaaaaaugauuaggccacaacccauggaauacaaauacucguggaaaagcuggggaaaggcuaaaaucauaggggcagauguacagaacaccaccuucaucaucgacggcccaaacaccccagaaugcccugaugaucaaagagcguggaacauuugggaaguugaggauuauggauuuggaauuuucacgacaaacauauggcugaaauugcgugacuccuacacccaagugugugaccaccggcuuaugucagcugccaucaaggacagcaaggcaguucacgcugacaugggguacuggauagaaagugaaaagaacgagaccuggaagcuggcaagagccucuuucauagaagucaaaacauguauuuggccaaaaucccacacucuauggaguaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauccaugaaugguguugcagaucuuguacgcuaccacccuuacguuucagaggagaagaugggugcugguacgguauggaaaucagaccagucaaggaaaaggaagagaaucuagucaaaucaauggucucugcagggucaggggaaguggacagcuuuucacugggacugcuaugcauaucaauaaugaucgaagaggugaugagauccagauggaguagaaaaaugcugaugauuggaacauuggcuguguucuuccuucucauaaugggacaguugacauggaaugaucugaucagauuaugcaucaugguuggagccaacgcuuccgacaggauggggaugggaacgacguaccuagcucugauggccacuuuuaaaaugagaccaauguuugcuguagggcuacuauuccgcagacuaacauccagagaaguucuucuucuaacaaucggauugagucuaguggcaucugcggaguuaccaaauuccuuggaggagcugggggacggacuugcaaugggcauuaugauuuuaaaauuauugacugacuuucaaucacaucagcugugggcuacuuugcuguccuugacauuuaucaaaacaacguuuuccuugcacuaugcauggaagacaauggcuaugguacugucaauuguaucucucauccccuuaugccuguccacgaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuaugucauaucuggaaguucagccgaccuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguucccauuaucaauaccagcgacccuuuuugugugguacuuuuggcagaaaaagaaacagagaucuggaguguuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacgggagaagaagugcaggugauugcuguugaaccagggaaaaaccccaaaaauguacaaacagcgccgggcaccuuuaagaccccugaaggcgaaguuggagccauugcccuagauuuuaaacccggcacaucuggaucucccaucgugaacagagaagggaaaauaguaggucuuuauggaaauggaguagugacaacaaguggaaccuacgucagugccauagcucaagcuaaagcaucacaagaagggcccuuaccagagauugaagacgagguguuuaggaaaagaaacuuaacaauaauggaccuacauccaggaucggggaaaacaagaagauaccuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuucugucucccgugagaguucccaauuauaacaugauuaucauggaugaagcacauuucaccgauccauccagcauagcggcuagaggguacaucucaacccgagugggcaugggugaagcagcugcgaucuucaugacagccacucccccaggaucaguggaggccuuuccacagagcaacgcaguuauccaagaugaggaaagagacauuccugagagaucauggaacucaggcuaugaguggaucacugacuucccaggcaaaacaguuugguuuguuccaagcauuaaaucaggaaaugauauugccaacugcuuaagaaagaaugggaaacgggugauucaauugagcaggaaaaccuuugacacagaguaccaaaaaacaaaaaauaaugacugggacuaugucgucacaacagacaucuccgaaaugggagcaaauuuccgggccgacagggugauagacccaagacggugucugaaaccgguaauacuaaaagaugguccagagcgcgucaucuuagcaggaccgaugccagugacuguggccagugcugcccagaggagaggaagaauuggaaggaaccacaauaaggaaggugaucaguacaucuacaugggacagccuuuaaacaacgaugaagaucacgcucacuggacggaagcaaaaaugcuccuugauaauauaaacacaccagaagggauuaucccagcccucuucgagccggagagagaaaagagugcagcaauagacggagaauacagacugcggggugaagcaaggaaaacguuuguggagcucaugagaagaggagaucuaccugucuggcuauccuacaaaguugccucggaaggcuuccaguacucugauagaagauggugcuuugacggggaaaggaacaaccagguguuggaggagaacauggauguggagaucuggacaaaagaaggagaaagaaagaaacuacgaccccgcuggcuggaugccagaacauacucagacccacuggcuuugcgcgaguuuaaagaguuugcagcaggaagaagaagcgucucaggugaucuaauauuagaaauagggaaacuuccacaacacuugacgcaaagggcccagaaugccuuggacaaccuggucauguugcacaacuccgaacaaggaggaagagccuauagacaugcaauggaagaacugccagacaccauagaaacguugaugcuccuagcuuugauagcuguguuaacugguggagugacgcuguucuuccuaucaggaaggggccuagggaaaacauccaucggccuacucugcgugauggcuucaagcguacugcuauggauggccaguguagagccccauuggauagcggccucuaucauacuggaguucuuccugauggugcugcuuauuccagagccagacagacaacgcacuccgcaggacaaccagcuggcauauguggugauagguuuguuauucaugauacugacaguagcagcuaaugagaugggacugcuggaaaccacaaagaaagacuuagggauuggccauguggcuguugaaaaccaccaccaugccgcaaugcuggacguggacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucaaagauggacauaggaguuccacuucucgccuuggggugcuauucccaggugaauccacugacgcugacagcggcgguauugaugcuaguggcucauuacgcuauaauuggaccuggacugcaagcaaaagcuacuagagaagcucaaaaaaggacagcggccggaauaaugaaaaauccaaccguugauggaaucguugcaauagauuuggacccugugguuuaugaugcgaaauuugagaaacaacuaggccaaauaauguugcugauacuaugcacaucacagauccucuugaugcggacuacaugggccuugugcgaauccaucacguuggccacuggaccucugaccacgcucugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacggcugaaccaacugagcaagucagaauuuaacaccuauaaaaggagugggauuauggaaguggacagauccgaagccaaagagggacugaaaagaggagaaacaaccaaacaugcagugucgagaggaaccgcuaaauugaggugguuuguggagaggaaccuugugaaaccagaagggaaagucauagaccucgguuguggaagagguggcuggucauauuauugcgcugggcugaagaaagucacagaagugaagggauauacaaaaggaggaccuggacaugaagaaccaaucccaauggcgaccuauggauggaaccuaguaaagcugcauuccgggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggagggaugcuagugcgaaauccacuuucaagaaauuccacucaugaaauguauuggguuucauguggaacaggaaacauugugucagcaguaaacaugacauccagaauguugcuaaaucgauucacaauggcucacaggaaaccaacauaugaaagagacguggaccuaggcgccggaacaagacacguggcaguggaaccagagguagccaaccuagauaucauuggccagaggauagagaacauaaaacaugaacacaagucaacauggcauuaugaugaggacaauccauacaaaacaugggccuaucauggaucauaugaggucaagccaucaggaucagccucauccauggucaauggcguggugaaacugcucaccaaaccaugggaugucauccccauggucacacaaauagccaugacugacacuacacccuuuggacaacagaggguguuuaaggagaaaguugauacacgcacaccaaaagcaaaacgagguacagcacaaaucauggaggugacagccaggugguuaugggguuuucuuucuagaaacaagaagccaagaauuuguacaagagaggaguucacaagaaaaguuaggucaaacgcagccaucggagcaguguucauugacgaaaaucaauggaacucagcaaaagaagcaguggaagaugagcgguucugggaccuugugcacagagagagagagcuucacaaacagggaaaaugugccacguguguuuauaacaugauggggaagagagagaaaaaguuaggagaguuuggaaaggcaaaaggaagucgugcaauaugguacaugugguugggagcacgcuuucuagaguucgaagcucuuggauucaugaacgaagaccacugguucagcagagagaauucacucaguggaguggaaggagaaggacuccacaaacuuggauacauacucagagacauaucaaagauuccagggggaaacauguaugcagaugacacagccggaugggauacaaggauaacagaggaugaccuucagaaugaggccaaaauuacugacaucauggaacccgaacaugcccuacuggcuaaggcaaucuucaagcuaaccuaccaaaauaaagugguaaggguacagagaccagcaaaaaauggaaccgugauggaugucauauccagacgugaccagagaggaaguggccaggucggaacuuauggcuuaaacacuuuuaccaacauggaagcccaguugauaagacaaauggagucugagggaaucuuuucacccagugaauuagagaccccaaauuuagccgagagaguucuagacuggcugggaaaauauggcgucgaaaggcuaaaaagaauggcaaucaguggagaugacugcguagugaaaccaauugaugauagguuugcaacagccuuaacagcucugaaugauaugggaaaaguaagaaaagauauaccacaaugggaacccucaaaaggauggaaugauuggcaacaagugccuuuuuguucacaccacuuccaccagcugaucaugaaggaugggagggaaauaguggugccaugccgcaaccaagaugaacuuguggguagggcuagaguaucacaaggugcuggguggagccugagagaaaccgcaugccuaggcaaaucauaugcacaaauguggcagcugauguacuuccacaggagagaccugagacuagccgcuaaugccaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccauauauccaauugggaagauguuccauauuuagggaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6224 - RNA, 9879 nt, Artificial Sequence
  derived and/or modified CDS sequence (wt) from DENV-1__KC692495__SS-prME
uccgugaccaugcuccucaugcugcugcccacagcccuggcguuucauuugaccacacgagggggagagccacacaugauaguuaguaagcaggaaagaggaaagucacucuuguuuaagaccucugcgggcgucaauaugugcacccucauugcgauggacuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagagaaacguuccguggcacuggccccacacgugggacuuggucuagaaacaagaaccgaaacauggauguccucugaaggcgccuggaaacaaauacaaagaguggaaacuugggcuuugagacacccaggauucacggugauagccuuuuuuuuagcgcaugcuauaggaacauccaucacucaaaaagggaucauuuucaucuugcugaugcuggugacaccaucaauggccaugcgaugcgugggaauaggcaacagagacuucguugaaggacugucaggagcaacguggguggacgugguauuggagcauggaagcugcgucaccaccauggcaaaaaauaaaccaacauuggacauugaacucuugaagacggaggucacgaacccugccgucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcugggguaauggcuguggacuauucggaaagggaagucuauugacgugugccaaguucaagugugugacaaaacuagagggaaagauaguucaauaugaaaacuuaaaauauucagugauagucacuguccacacuggggaccagcaccaggugggaaacgagaccacagaacauggaacaauugcaaccauaacaccucaagcucccacgucggaaauacagcugacugacuacggagcccucacauuggacugcucaccuagaacagggcuggacuuuaaugagauggugcuauugacaaugaaagaaaaaucauggcuuguccacaaacaaugguuucuagacuuaccacugccauggacuucgggggcuucaacaucucaagagaccuggaacagacaagauuugcuggucacauucaagacagcucaugcaaagaaacaggaaguagucguacugggaucacaggaaggagcaaugcacacagcguugacuggggcgacagaaauccagacgucaggaacgacaacaaucuucgcaggacaccugaaaugcagacuaaaaauggauaaacugaccuuaaaggggaugucauaugugaugugcacaggcucauuuaagcuagagaaggaaguggcugagacccagcauggaacuguccuagugcaggucaaauaugaaggaacagacgcgccaugcaagauccccuucucgacccaagaugagaaaggagugacccagaaugggagauugauaacagccaaucccauaguuacugacaaagaaaaaccagucaacauugagacagaaccaccuuuuggugagagcuacaucgugguaggggcaggcgaaaaagcuuugaaacuaagcugguucaagagaggaagcagcauagggaaaauguucgaagcaaccgcccgaggagcacgaaggauggcuauccugggagacaccgcaugggacuucgguucuauaggaggaguguuuacaucugugggaaaauugguacaccagguuuuuggaaccgcauaugggguucuguuuagcgguguuucuuggaccaugaaaauaggaauagggauucugcugacaugguugggauuaaauucaaggagcacgucacuuucgaugacgugcauugcaguuggcauggucacacuguaccuaggagucaugguucaagcggauucgggauguguaaucaacuggaagggcagagaacuuaaauguggaaguggcauuuuugucacuaaugaaguccacacuuggacagagcaauacaaauuccaggcugacuccccaaaaagacugucagcagccauuggaaaggcaugggaggagggcguauguggaauucgaucagccacacgucuugagaacaucauguggaagcaaauaucaaaugaauugaaccacauucuacuugagaaugacaugaaauucacagugguuguaggagaugccaacggaauuuuggcccaagggaaaaaaaugauuaggccacaaccuauggaacacaaauacucauggaaaagcuggggaaaagcuaaaaucauaggagcagacauacaaaauaccaccuuuaucaucgacggcccagacaccccagaaugucccgauggccaaagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaaugaaaccuggaagcuggcgagagccuccuucauagaagucaagacaugcaccuggccgaaaucucacacucuauggagcaauggagucuuggaaagugaaaugauaaucccaaagauauuuggaggaccaauaucucagcacaacuacagaccaggguauuucacacaaacagcagggccauggcaccuagguaaguuggaacuggauuuugacuugugugaagguaccacaguuguuguggaugaacauuguggaaaucgagguccaucucucagaaccacaacagucacaggaaagauaauccaugaaugguguugcagauccugcacgcuaccccccuuacguuucagaggagaagacggguguugguauggcauggaaaucagaccaguaaaggagaaggaggagaaucuagucaggucaauggucucugcagggucaggagaaguggauaguuuuucauuaggaauacuaugcgugucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuccgcagacuaacauccagagaaguucuucuccucacgauuggauuaagccugguggcauccguggagcuaccaaauucuuuggaggagcuaggggauggacuugcaauggguaucaugauguuaaaauuguugacugaauuucagccacaccaguuauggaccaccuuauugucucugacauuugucaaaacaacucucucacuggauuaugcauggaaaacaacggcuaugguacugucuaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaagcucacuccucaaaaaugaugugccguuggccgggccacuaauagcuggaggcaugcuaauagcauguuaugucauauccggaagcucagccgauuuaucauuggagaaagcggcugaaguauccugggaacaagaagcagaacacuccggugccucacacaacauauuaguagagguccaagaugauggaacuaugaaaauaaaagaugaagaaagggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccagcccuccggaaguggaaagagcaguucuugaugauggcaucuauagaaucuugcaaagaggacuguuggggaggucccaaguaggagugggagucuuucaagacggcguguuccacacaauguggcacguuaccaggggagcuguccuuauguaccaagggaagagacuggaaccaagcugggccagugucaaaaaggacuugaucucauauggaggagguuggagguuccaaggaucauggaacacaggagaagaagugcaggugauagcuguugaaccaggaaaaaaccccaaaaauguacagacaacgccgggcaccuucaagacuccugaaggcgaaguuggagccauagcucuagauuucaaacccggcacaucuggaucucccauugugaacagagagggaaaaauaguaggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcacccaggaucagggaaaacaagaagauaucuuccagccauaguccgugaggccauaaaaaggaaacugcguacguuaaucuuggcucccacaagaguugucgccucugaaauggcagaggcacucaagggaaugccaauaagauaccagacaacagcagugaagagugaacacacaggaagggagauaguugaccucaugugccacgcuacuuuuaccaugcgucucuuauccccagugagaguucccaauuacaacaugauuauuauggaugaagcacauuuuaccgauccagcuagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggauuacugacuuuccagguaaaacagucugguuuguuccaagcauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuucugaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccuuuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcgaccucgcugguuggacgccagaacauacucugauccauuggcccugcgcgaguuuaaagaguucgcagcaggaagaagaagugucucaggugaccuaauauuggaaauagggaaacuuccacaacauuugacgcuaagagcccagaaugcucuggacaacuuggucauguugcacaauuccgaacaaggaggaaaagccuacagacaugcuauggaggaacuaccagacaccauagaaacauugaugcuucuagcuuugauagcuguguugacugguggagugacgcuguucuuccuaucaggaaaaggucuagggaaaacauccauuggcuugcucugugugacggccucaagcgcacugcuauggauggccaguguggagccccauuggauagcggccuccaucauacuagaguucuuuuugauggugcugcucauuccagaaccagacagacagcgcacuccacaggacaaccagcuagcauauguggugauagguuuguuauucaugauacugacaguggcagccaaugagaugggauuauuggaaaccacaaagaaagaccuggggauuggcuauguagccgccgaaaaccaccaacaugcuacaaugcuggacguagaccuacacccagcuucagccuggacccucuaugcaguagccacaacaguuaucacucccaugaugagacacacaauugaaaauacaacggcaaacauuucccugacagccauugcaaaucaggcagccauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggcuacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacaauagcaguguccauggcaaacaucuucaggggaaguuaucuagcaggagcaggucuggcuuucucauuaaugaaaucuuuaggaggagguaggagagguacgggagcucaaggggaaacauugggagagaaauggaaaagacaguuaaaccaacugagcaagucagaauucaacaccuacaaaaggagugggauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaaguuacugaagugaagggauacacaaaaggaggaccuggacaugaggaaccuaucccaauggcgaccuauggauggaaccuaguaaagcuacacucuggaaaggauguauuuuuuaugccaccugagaaaugugacacccuucugugugauauuggugaguccucuccgaauccaacuauagaagaaggaagaacguuacguguucuaaaaaugguggaaccauggcucagaggaaaccaauucugcauaaaaauccuaaauccuuacaugccaagugugguagaaacucuggagcaaaugcaaagaaaacauggagggaugcuagugcgaaacccacucucaagaaauucuacccaugaaauguauuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugacugauaccacacccuuuggacaacagagaguguuuaaagagaaaguugacacgcgcacaccaagagcaaaacgaggcacaacacagauuauggaggugacagccaagugguuaugggguuuccuuuccagaaacaaaaaacccagaaucugcacaagagaggaguucacaagaaagguuaggucaaacgcggcaauaggagcaguguucguugaugaaaaccaauggaacucagcaaaagaagcaguggaagacgaaagguuuugggaucuugugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaagcccuugguuucaugaaugaagaucacugguuuaguagagagaauucacucaguggaguggaaggagaaggacugcacaaacuuggauacauacucagagacauaucaaagauuccggggggaaauauguaugcagaugauacagccggaugggacacaagaauaacagaggaugaucuucagaaugaggcuaaaaucacugacaucauggagccugaacaugcucuauuggcuacgucaauuuuuaagcugacuuaucaaaacaagguggugagggugcaaagaccagcaaaaaauggaaccgugauggauguuauauccagacgugaucagagaggaaguggacaggucggaacuuauggcuuaaauacuuucaccaauauggagguccaacuaauaagacaaauggaaucugaaggaaucuuuuuacccagcgaauuggaaacccccaaccuagcugagagggcucuugacugguuagaaaaacauggcgccgaaaggcugaaacgaauggcaaucagcggagaugauugcguggugaaaccaauugacgacagguucgcaacagccuuaacagcucugaaugacaugggaaaaguaagaaaagacauaccgcagugggaaccuucgaaaggauggaaugauuggcagcaagugccuuuuuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuagcggcuaacgcuaucugcucagccgucccaguugauugggucccagccagccgcacaaccuggucaauccaugcccaccaccaauggaugacaacagaagacauguuaucaguguggaauagaguuuggauagaggaaaacccauggauggaggacaaaacucauguauccaguugggaagaaguuccauaccuaggaaaaagggaagaccaaugguguggaucccugauaggcuugacagcgagggccaccugggccaccaacauacaaguagccauaaaccaagugagaaggcucaucgggaaugagaauuauuuagauuacaugacaucaaugaagagauucaagaaugagagugaucccgaaggagcacucugguaa

SEQ ID NO: 6225 - RNA, 9879 nt, Artificial Sequence
  derived and/or modified CDS sequence (wt) from DENV-1__KC692496__SS-prME
uccgugaccaugcuccucaugcugcugcccacagcccuggcguuucauuugaccacacgagggggagagccacacaugauaguuaguaagcaggaaagaggaaagucacucuuguuuaagaccucugcgggcgucaauaugugcacccucauugcgauggacuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagagaaacguuccguggcacuagccccacacgugggacuuggucuagaaacaagaaccgaaacauggauguccucugaaggcgccuggagacaaauacaaagaguggaaacuugggcuuugagacacccaggauucacggugauagccuuuuuuuuagcgcaugcuauaggaacauccaucacucaaaaagggaucauuuucaucuugcugaugcuggugacaccaucaauggccaugcgaugcgugggaauaggcaacagagacuuuguugaaggacugucaggagcaacguggguggacgugguauuggagcauggaagcugcgucaccaccauggcaaaaaauaaaccaacauuggacauugaacucuugaagacggaggucacgaacccugccgucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcugggguaauggcuguggacuauucggaaagggaagucuauugacgugugccaaguucaagugugugacaaaacuagagggaaagauaguucaauaugaaaacuuaaaauacucagugauagucacuguccacacuggggaccagcaccaggugggaaacgagaccacagaacauggaacaauugcaaccauaacaccucaagcucccacgucggaaauacagcugacugacuacggagcccucacauuggacugcucaccuagaacagggcuggacuuuaaugagauggugcuauugacaaugaaagaaaaaucauggcuuguccacaaacaaugguuucuagacuuaccacugccauggacuucgggggcuucaacaucucaagagaccuggaacagacaagauuugcuggucacauucaagacagcucaugcaaagaaacaggaaguagucguacugggaucacaggaaggagcaaugcacacagcguugacuggggcgacagaaauccagacgucaggaacgacaacaaucuucgcaggacaccugaaaugcagacuaaaaauggauaaacugaccuuaaaggggaugucauaugugaugugcacaggcucauuuaagcuagagaaggaaguggcugagacccagcauggaacuguccuagugcaggucaaauaugaaggaacagacgcgccaugcaagauccccuucucgacccaagaugagaaaggagugacccagaaugggagauugauaacagccaaucccauaguuacugacaaagaaaaaccagucaacauugagacagaaccaccuuuuggugagagcuacaucgugguaggggcaggcgaaaaagcuuugaaacuaagcugguucaagagaggaagcagcauagggaaaauguucgaagcaaccgcccgaggagcacgaaggauggcuauccugggagacaccgcaugggacuucgguucuauaggaggaguguuuacaucugugggaaaauugguacaccagguuuuuggaaccgcauaugggguucuguuuagcgguguuucuuggaccaugaaaauaggaauagggauucugcugacaugguugggauuaaauucaaggagcacgucacuuucgaugacgugcauugcaguuggcauggucacacuguaccuaggagucaugguucaagcggauucgggauguguaaucaacuggaagggcagagaacuuaaauguggaaguggcauuuuugucacuaaugaaguccacacuuggacagagcaauacaaauuccaggcugacuccccaaaaagacugucagcagccauuggaaaggcaugggaggagggcguauguggaauucgaucagccacgcgucuugagaacaucauguggaagcaaauaucaaaugaauugaaccacauucuacuugagaaugacaugaaauucacagugguuguaggagaugccaacggaauuuuggcccaaggaaaaaaaaugauuaggccacaaccuauggaacacaaauacucauggaaaagcuggggaaaagcuaaaaucauaggagcagacauacaaaauaccaccuucaucaucgacggcccagacaccccagaaugucccgauggccaaagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaaugaaaccuggaagcuggcgagagccuccuucauagaagucaagacaugcaccuggccgaaaucucacacucuauggagcaauggagucuuggaaagugaaaugauaaucccaaagauauuuggaggaccaauaucucagcacaacuacagaccaggguauuucacacaaacagcagggccauggcaccuagguaaguuggaacuggauuuugacuugugugaagguaccacaguuguuguggaugaacauuguggaaaucgagguccaucucucagaaccacaacagucacaggaaagauaauccaugaaugguguugcagauccugcacgcuaccccccuuacguuucagaggagaagacggguguugguauggcauggaaaucagaccaguaaaggagaaggaggagaaucuagucaggucaauggucucugcagggucaggagaaguggauaguuuuucauuaggaauacuaugcgugucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuccgcagacuaacauccagagaaguucuucuccucacgauuggauuaagccugguggcauccguggagcuaccaaauucuuuggaggagcuaggggauggacuugcaauggguaucaugauguuaaaauuguugacugaauuucagccacaccaguuauggaccaccuuauugucucugacauuugucaaaacaacucucucacuggauuaugcauggaaaacaacggcuaugguacugucuaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaagcucacuccuaaaaaaugacgugccguuggccgggccacuacuagcuggaggcaugcuaauagcauguuaugucauauccggaagcucagccgauuuaucauuggagaaagcggcugaaguauccugggaacaagaagcagaacacuccggugccucacacaacauauuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccagcccuccggaaguggaaagagcaguucuugaugauggcaucuauagaaucuugcaaagaggacuguuggggaggucccaaguaggagugggagucuuccaagacggcguguuccacacaauguggcacguuaccaggggagcuguccuuauguaccaagggaagagacuggaaccaagcugggccagugucaaaaaggacuugaucucauauggaggagguuggagguuccaaggaucauggaacacaggagaagaagugcaggugauagcuguugaaccaggaaaaaaccccaaaaauguacagacaacgccgggcaccuucaagacuccugaaggcgaaguuggagccauagcucuagauuucaaacccggcacaucuggaucucccauugugaacagagagggaaaaauagugggucuguauggaaauggaguggugacaacaaguggaaccuacgucagugccauugcccaagcuaaagcaucacaggaagggccucuaccagagauugaggacgagguguuuaagaaaagaaacuuaacaauaauggaccugcacccaggaucagggaaaacaagaagauaucuuccagccauaguccgugaggccauaaaaaggaaacugcgcacguuaaucuuggcucccacaagaguugucgccucugaaauggcagaggcacucaagggaaugccaauaagauaucagacaacagcagugaagagugaacacacaggaagggagauaguugaccucaugugccacgcuacuuuuaccaugcgucucuuauccccagugagaguucccaauuacaacaugauuauuauggaugaagcacauuuuaccgauccagcuagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggauuacugacuuuccagguaaaacagucugguuuguuccaagcauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuucugaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccuuuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcgaccucgcugguuggacgccagaacauacucugauccauuggcccugcgcgaguuuaaagaguucgcagcaggaagaagaagugucucaggugaccuaauauuggaaauagggaaacuuccacaacauuugacgcuaagagcccagaaugcucuggacaacuuggucauguugcacaauuccgaacaaggaggaaaagccuacagacaugcuauggaggaacuaccagacaccauagaaacauugaugcuucuagcuuugauagcuguguugacugguggagugacgcuguucuuccuaucaggaaaaggucuagggaaaacauccauuggcuugcucugugugacggccucaagcgcacuguuauggauggccaguguggagccccauuggauagcggccuccaucauacuagaguucuuuuugauggugcugcucauuccagaaccagacagacagcgcacuccacaggacaaccagcuagcauauguggugauagguuuguuauucaugauacugacaguggcagccaaugagaugggauuauuggaaaccacaaagaaagaccuggggauuggcuauguagccgccgaaaaccaccaacaugcuacaaugcuggacguagaccuacacccagcuucagccuggacccucuaugcaguagccacaacaguuaucacucccaugaugagacacacaauugaaaauacaacggcaaacauuucccugacagccauugcaaaucaggcagccauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacaauagcaguguccauggcaaacaucuucaggggaaguuaucuagcaggagcaggucuggcuuucucauuaaugaaaucuuuaggaggagguaggagagguacgggagcucaaggggagacauugggagagaaauggaaaagacaguuaaaccaacugagcaagucagaauucaacaccuacaaaaggagugggauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaaguuacugaagugaagggauacacaaaaggaggaccuggacaugaggaaccuaucccaauggcgaccuauggauggaaccuaguaaagcuacacucuggaaaggauguauuuuuuaugccaccugagaaaugugacacccuucugugugauauuggugaguccucuccgaauccaacuauagaagaaggaagaacguuacguguucuaaaaaugguggaaccauggcucagaggaaaccaauucugcauaaaaauccuaaauccuuacaugccaagugugguagaaacucuggagcaaaugcaaagaaaacauggagggaugcuagugcgaaacccacucucaagaaauucuacccaugaaauguauuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugacugauaccacacccuuuggacaacagagaguguuuaaagagaaaguugacacgcgcacaccaagagcaaaacgaggcacaacacagauuauggaggugacagccaagugguuaugggguuuccuuuccagaaacaaaaaacccagaaucugcacaagagaggaguucacaagaaagguuaggucaaacgcggcaauaggagcaguguucguugaugaaaaccaauggaacucagcaaaagaagcaguggaagacgaaagguuuugggaucuugugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaagcccuugguuucaugaaugaagaucacugguuuaguagagagaauucacucaguggaguggaaggagaaggacugcacaaacuuggauacauacucagagacauaucaaagauuccggggggaaauauguaugcagaugauacagccggaugggacacaagaauaacagaggaugaucuucagaaugaggcuaaaaucacugacaucauggagccugaacaugcucuauuggcuacgucaauuuuuaagcugacuuaucaaaacaagguggugagggugcaaagaccagcaaaaaauggaaccgugauggauguuauauccagacgugaucagagaggaaguggacaggucggaacuuauggcuuaaacacuuucaccaauauggagguccaacuaauaagacaaauggaaucugaaggaaucuuuuuacccagcgaauuggaaacccccaaccuagcugagagggcucuugacugguuagaaaaacauggcgccgaaaggcugaaacgaauggcaaucagcggagaugauugcguggugaaaccaauugacgacagguucgcaacagccuuaacagcucugaaugacaugggaaaaguaagaaaagacauaccgcagugggaaccuucgaaaggauggaaugauuggcagcaagugccuuuuuguucacaccauuuccaccagcugauuaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuagcggcuaacgcuaucugcucagccgucccaguugauugggucccagccagccgcacaaccuggucaauccaugcccaccaccaauggaugacaacagaagacauguuaucaguguggaauagaguuuggauagaggaaaacccauggauggaggacaaaacucauguauccaguugggaagaaguuccauaccuaggaaaaagggaagaccaaugguguggaucccugauaggcuugacagcgagggccaccugggcuaccaacauacaaguagccauaaaccaagugagaaggcucaucgggaaugagaauuauuuagauuacaugacaucaaugaagagauucaagaaugagagugaucccgaaggagcacucugguaa

SEQ ID NO: 6226 - RNA, 9879 nt, Artificial Sequence
  derived and/or modified CDS sequence (wt) from DENV-1__KC692497__SS-prME
uccgugaccaugcuccucaugcugcugcccacagcccuggcguuucauuugaccacacgagggggagagccacacaugauaguuaguaagcaggaaagaggaaagucacucuuguuuaagaccucugcgggcgucaauaugugcacccucauugcgauggacuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagagaaacguuccguggcacuggccccacacgugggacuuggucuagaaacaagaaccgaaacauggauguccucugaaggcgccuggaaacaaauacaaagaguggaaacuugggcuuugagacacccaggauucacggugauagcccuuuuuuuagcgcaugcuauaggaacauccaucacucaaaaagggaucauuuucaucuugcugaugcuggugacaccaucaauggccaugcgaugcgugggaauaggcaacagagacuucguugaaggacugucaggagcaacguggguggacgugguauuggagcauggaagcugcgucaccaccauggcaaaaaauaaaccaacauuggacauugaacucuugaagacggaggucacgaacccugccgucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcugggguaauggcuguggacuauucggaaagggaagucuauugacgugugccaaguucaagugugugacaaaacuagagggaaagauaguucaauaugaaaacuuaaaauauucagugauagucacuguccacacuggggaccagcaccaggugggaaacgagaccacagaacauggaacaauugcaaccauaacaccucaagcucccacgucggaaauacagcugacugacuacggagcccucacauuggacugcucaccuagaacagggcuggacuuuaaugagauggugcuauugacaaugaaagaaaaaucauggcuuguccacaaacaaugguuucuagacuuaccacugccauggacuucgggggcuucaacaucucaagagaccuggaacagacaagauuugcuggucacauucaagacagcucaugcaaagaaacaggaaguagucguacugggaucacaagaaggagcaaugcacacugcguugaccggggcgacagaaauccagacgucaggaacgacaacaaucuuugcaggacaccugaaaugcagauuaaaaauggauaaacugaccuuaaaggggaugucauaugugaugugcacaggcucauuuaagcuagagaaggaaguggcugagacccagcauggaacuguccuagugcaggucaaauaugaaggaacagacgcgccaugcaagauccccuucucgacccaagaugagaaaggagugacccagaaugggagauugauaacagccaaucccauaguuacugacaaagaaaaaccagucaacauugagacagaaccaccuuuuggugagagcuacaucgugguaggggcaggcgaaaaagcuuugaaacuaagcugguucaagagaggaagcagcauagggaaaauguucgaagcaaccgcccgaggagcacgaaggauggcuauccugggagacaccgcaugggacuucgguucuauaggaggaguguuuacaucugugggaaaauugguacaccagguuuuuggaaccgcauaugggguucuguuuagcgguguuucuuggaccaugaaaauaggaauagggauucugcugacaugguugggauuaaauucaaggagcacgucacuuucgaugacgugcauugcaguuggcauggucacacuguaccuaggagucaugguucaagcggauucgggauguguaaucaacuggaagggcagagaacuuaaauguggaaguggcauuuuugucacuaaugaaguccacacuuggacagagcaauacaaauuccaggcugacuccccaaaaagacugucagcagccauuggaaaggcaugggaggagggcguauguggaauucgaucagccacgcgucuugagaacaucauguggaagcaaauaucaaaugaauugaaccacauucuacuugagaaugacaugaaauucacagugguuguaggagaugccaacggaauuuuggcccaaggaaaaaaaaugauuaggccacaaccuauggaacacaaauacucauggaaaagcuggggaaaagcuaaaaucauaggagcagacauacaaaauaccaccuucaucaucgacggcccagacaccccagaaugucccgauggccaaagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaaugaaaccuggaagcuggcgagagccuccuucauagaagucaagacaugcaccuggccgaaaucucacacucuauggagcaauggagucuuggaaagugaaaugauaaucccaaagauauuuggaggaccaauaucucagcacaacuacagaccaggguauuucacacaaacagcagggccauggcaccuagguaaguuggaacuggauuuugacuugugugaagguaccacaguuguuguggaugaacauuguggaaaucgagguccaucucucagaaccacaacagucacaggaaagauaauccaugaaugguguugcagauccugcacgcuaccccccuuacguuucagaggagaagacggguguugguauggcauggaaaucagaccaguaaaggagaaggaggagaaucuagucaggucaauggucucugcagggucaggagaaguggauaguuuuucauuaggaauacuaugcgugucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggacgggaacaacguaccuagccuugauggcuacuuuuaaaaugagaccaauguucgcuguugggcuauuauuccgcagacuaacauccagagaaguucuucuccucacgauuggauuaagccugguggcauccguggagcuaccaaauucuuuggaggagcuaggggauggacuugcaauggguaucaugauguuaaaauuguugacugaauuucagccacaccaguuauggaccaccuuauugucucugacauuugucaaaacaacucucucacuggauuaugcauggaaaacaacggcuaugguacugucuaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaagcucacuccucaaaaaugaugugccguuggccgggccacuaauagcuggaggcaugcuaauagcauguuaugucauauccggaagcucagccgauuuaucauuggagaaagcggcugaaguauccugggaacaagaagcagaacacuccggugccucacacaacauauuaguagagguccaagaugauggaacuaugaaaauaaaagaugaagagagggaugacacacuuacuauacuccuuaaagcaacuuugcuggcagucucaggaguguacccaaugucaauaccagcaacucuuuuugugugguacuuuuggcagaaaaagaaacagagaucaggaguguuaugggacacacccagcccuccggaaguggaaagagcaguucuugaugauggcaucuauagaaucuugcaaagaggacuguuggggaggucccaaguaggagugggagucuuccaagacggcguguuccacacaauguggcacguuaccaggggagcuguccuuauguaccaagggaagagacuggaaccaagcugggccagugucaaaaaggacuugaucucauauggaggagguuggagguuccaaggaucauggaacacaggagaagaagugcaggugauagcuguugaaccaggaaaaaaccccaaaaauguacagacaacgccgggcaccuucaagacuccugaaggcgaaguuggagccauagcucuagauuucaaacccggcacaucuggaucucccauugugaacagagagggaaaaauagugggucuguauggaaauggaguggugacaacaaguggaaccuacgucagugccauugcccaagcuaaagcaucacaggaagggccucuaccagagauugaggacgagguguuuaagaaaagaaacuuaacaauaauggaccugcacccaggaucagggaaaacaagaagauaucuuccagccauaguccgugaggccauaaaaaggaaacugcguacguuaaucuuggcucccacaagaguugucgccucugaaauggcagaggcacucaagggaaugccaauaagauaucagacaacagcagugaagagugaacacacaggaagggagauaguugaccucaugugccacgcuacuuuuaccaugcgucucuuauccccagugagaguucccaauuacaacaugauuauuauggaugaagcacauuuuaccgauccagcuagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggauuacugacuuuccagguaaaacagucugguuuguuccaagcauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuucugaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccuuuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcgaccucgcugguuggacgccagaacauacucugauccauuggcccugcgcgaguuuaaagaguucgcagcaggaagaagaagugucucaggugaccuaauauuggaaauagggaaacuuccacaacauuugacgcuaagagcccagaaugcucuggacaacuuggucauguugcacaauuccgaacaaggaggaaaagccuacagacaugcuauggaggaacuaccagacaccauagaaacauugaugcuucuagcuuugauagcuguguugacugguggagugacgcuguucuuccuaucaggaaaaggucuagggaaaacauccauuggcuugcucugugugacggccucaagcgcacuguuauggauggccaguguggagccccauuggauagcggccuccaucauacuagaguucuuuuugauggugcugcucauuccagaaccagacagacagcgcacuccacaggacaaccagcuagcauauguggugauagguuuguuauucaugauacugacaguggcagccaaugagaugggauuauuggaaaccacaaagaaagaccuggggauuggcuauguagccgccgaaaaccaccaacaugcuacaaugcuggacguagaccuacacccagcuucagccuggacccucuaugcaguagccacaacaguuaucacucccaugaugagacacacaauugaaaauacaacggcaaacauuucccugacagccauugcaaaucaggcagccauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacaauagcaguguccauggcaaacaucuucaggggaaguuauuuagcaggagcaggucuggcuuucucauuaaugaaaucuuuaggaggagguaggagagguaccggagcucaaggggaaacauugggagagaaauggaaaagacaguuaaaccaacugagcaagucagaauucaacaccuacaaaaggagugggauuauggagguggacagauccgaagccaaagagggacugaaaagaggagaaacaaccaaacaugcagugucgagaggaacagccaaacugaggugguuuguggagaggaaucucgugaaaccagaagggaaagucauagaccucgguuguggaagagguggcuggucauauuauugugcugggcugaagaaaguuacugaagugaagggauacacaaaaggaggaccuggacaugaggaaccuaucccaauggcgaccuauggauggaaccuaguaaagcuacacucuggaaaggauguauuuuuuaugccaccugagaaaugugacacccuucugugugauauuggugaguccucuccgaauccaacuauagaagaaggaagaacguuacguguucuaaaaaugguggaaccauggcucagaggaaaccaauucugcauaaaaauccuaaauccuuacaugccaagugugguagaaacucuggagcaaaugcaaagaaaacauggagggaugcuagugcgaaacccacucucaagaaauucuacccaugaaauguauuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguagccaaccuagaugucauuggccagaggauagagaauauaaaaaaugaacacaagucaacauggcauuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugacugauaccacacccuuuggacaacagagaguguuuaaagagaaaguugacacgcgcacaccaagagcaaaacgaggcacaacacagauuauggaggugacagccaagugguuaugggguuuccuuuccagaaacaaaaaacccagaaucugcacaagagaggaguucacaagaaagguuaggucaaacgcggcaauaggagcaguguucguugaugaaaaccaauggaacucagcaaaagaagcaguggaagacgaaagguuuugggaccuugugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaagcccuugguuucaugaaugaagaucacugguuuaguagagagaauucacucaguggaguggaaggagaaggacugcacaaacuuggauacauacucagagacauaucaaagauuccggggggaaauauguaugcagaugauacagccggaugggacacaagaauaacagaggaugaucuucagaaugaggcuaaaaucacugacaucauggagccugaacaugcucuauuggcuacgucaauuuuuaagcugacuuaucaaaacaagguggugagggugcaaagaccagcaaaaaauggaaccgugauggauguuauauccagacgugaucagagaggaaguggacaggucggaacuuauggcuuaaauacuuucaccaauauggagguccaacuaauaagacaaauggaaucugaaggaaucuuuuuacccagcgaauuggaaacccccaaccuagcugagagggcucuugacugguuagaaaaacauggcgccgaaaggcugaaacgaauggcaaucagcggagaugauugcguggugaaaccaauugacgacagguucgcaacagccuuaacagcucugaaugacaugggaaaaguaagaaaagacauaccgcagugggaaccuucgaaaggauggaaugauuggcagcaagugccuuuuuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuagcggcuaacgcuaucugcucagccgucccaguugauugggucccagccagccgcacaaccuggucaauccaugcccaccaccaauggaugacaacagaagacauguuaucaguguggaauagaguuuggauagaggaaaacccauggauggaggacaaaacucauguauccaguugggaagaaguuccauaccuaggaaaaagggaagaccaaugguguggaucccugauaggcuugacagcgagggccaccugggccaccaacauacaaguagccauaaaccaagugagaaggcucaucgggaaugagaauuauuuagauuacaugacaucaaugaagagauucaagaaugagagugaucccgaaggagcacucugguaa

SEQ ID NO: 6227 - RNA, 9879 nt, Artificial Sequence
  derived and/or modified CDS sequence (wt) from DENV-1__KC692498__SS-prME
uccgugaccaugcuccucaugcugcugcccacagcccuggcguuucauuugaccacacgagggggagagccacacaugauaguuaguaagcaggaaagaggaaagucacucuuguuuaagaccucugcgggcgucaauaugugcacccucauugcgauggacuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagagaaacguuccguggcacuggccccacacgugggacuuggucuagaaacaagaaccgaaacauggauguccucugaaggcgccuggaaacaaauacaaagaguggaaacuugggcuuugagacacccaggauucacggugauagcccuuuuuuuagcgcaugcuauaggaacauccaucacucaaaaagggaucauuuucaucuugcugaugcuggugacaccaucaauggccaugcgaugcgugggaauaggcaacagagacuucguugaaggacugucaggagcaacguggguggacgugguauuggagcauggaagcugcgucaccaccauggcaaaaaauaaaccaacauuggacauugaacucuugaagacggaggucacgaacccugccgucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcugggguaauggcuguggacuauucggaaagggaagucuauugacgugugccaaguucaagugugugacaaaacuagagggaaagauaguucaauaugaaaacuuaaaauauucagugauagucacuguccacacuggggaccagcaccaggugggaaacgagaccacagaacauggaacaauugcaaccauaacaccucaagcucccacgucggaaauacagcugacugacuacggagcccucacauuggacugcucaccuagaacagggcuggacuuuaaugagauggugcuauugacaaugaaagaaaaaucauggcuuguccacaaacaaugguuucuagacuuaccacugccauggacuucgggggcuucaacaucucaagagaccuggaacagacaagauuugcuggucacauucaagacagcucaugcaaagaaacaggaaguagucguacugggaucacaggaaggagcaaugcacacagcguugacuggagcgacagaaauccagacgucaggaacgacaacaaucuucgcaggacaccugaaaugcagacuaaaaauggauaaacugaccuuaaaggggaugucauaugugaugugcacaggcucauuuaagcuagagaaggaaguggcugagacccagcauggaacuguccuagugcaggucaaauaugaaggaacagacgcgccaugcaagauccccuucucgacccaagaugagaaaggagugacccagaaugggagauugauaacagccaaucccauaguuacugacaaagaaaaaccagucaacauugagacagaaccaccuuuuggugagagcuacaucgugguaggggcaggcgaaaaagcuuugaaacuaagcugguucaagagaggaagcagcauagggaaaauguucgaagcaaccgcccgaggagcacgaaggauggcuauccugggagacaccgcaugggacuucgguucuauaggaggaguguuuacaucugugggaaaauugguacaccagguuuuuggaaccgcauaugggguucuguuuagcgguguuucuuggaccaugaaaauaggaauagggauucugcugacaugguugggauuaaauucaaggagcacgucacuuucgaugacgugcauugcaguuggcauggucacacuguaccuaggagucaugguucaagcggauucgggauguguaaucaacuggaagggcagagaacuuaaauguggaaguggcauuuuugucacuaaugaaguccacacuuggacagagcaauacaaauuccaggcugacuccccaaaaagacugucagcagccauuggaaaggcaugggaggagggcguauguggaauucgaucagccacgcgucuugagaacaucauguggaagcaaauaucaaaugaauugaaccacauucuacuugagaaugacaugaaauucacagugguuguaggagaugccaacggaauuuuggcccaaggaaaaaaaaugauuaggccacaaccuauggaacacaaauacucauggaaaagcuggggaaaagcuaaaaucauaggagcagacauacaaaauaccaccuucaucaucgacggcccagacaccccagaaugucccgauggccaaagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaaugaaaccuggaagcuggcgagagccuccuucauagaagucaagacaugcaccuggccgaaaucucacacucuauggagcaauggagucuuggaaagugaaaugauaaucccaaagauauuuggaggaccaauaucucagcacaacuacagaccaggguauuucacacaaacagcagggccauggcaccuagguaaguuggaacuggauuuugacuugugugaagguaccacaguuguuguggaugaacauuguggaaaucgagguccaucucucagaaccacaacagucacaggaaagauaauccaugaaugguguugcagauccugcacgcuaccccccuuacguuucagaggagaagacggguguugguauggcauggaaaucagaccaguaaaggagaaggaggagaaucuagucaggucaauggucucugcagggucaggagaaguggauaguuuuucauuaggaauacuaugcgugucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggacgggaacaacguaccuagccuugauggcuacuuucaaaaugagaccaauguucgcuguugggcuauuauuccgcagacuaacauccagagaaguucuucuccucacgauuggauuaagccugguggcauccguggagcuaccaaauucuuuggaggagcuaggggauggacuugcaauggguaucaugauguuaaaauuguugacugaauuucagccacaccaguuauggaccaccuuauugucucugacauuugucaaaacaacucucucacuggauuaugcauggaaaacaacggcuaugguacugucuaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaagcucacuccucaaaaaugaugugccguuggccgggccacuaauagcuggaggcaugcuaauagcauguuaugucauauccggaagcucagccgauuuaucauuggagaaagcggcugaaguauccugggaacaagaagcagaacacuccggugccucacacaacauauuaguagagguccaagaugauggaacuaugaaaauaaaagaugaagagagggaugacacacuuacuauacuccuuaaagcaacuuugcuggcagucucaggaguguacccaaugucaauaccagcaacucuuuuugugugguacuuuuggcagaaaaagaaacagagaucaggaguguuaugggacacacccagcccuccggaaguggaaagagcaguucuugaugauggcaucuauagaaucuugcaaagaggacuguuggggaggucccaaguaggagugggagucuuccaagacggcguguuccacacaauguggcacguuaccaggggagcuguccuuauguaccaagggaagagacuggaaccaagcugggccagugucaaaaaggacuugaucucauauggaggagguuggagguuccaaggaucauggaacacaggagaagaagugcaggugauagcuguugaaccaggaaaaaaccccaaaaauguacagacaacgccgggcaccuucaagacuccugaaggcgaaguuggagccauagcucuagauuucaaacccggcacaucuggaucucccauugugaacagagaggggaaaauagugggucuguauggaaauggaguggugacaacaaguggaaccuacgucagugccauugcccaagcuaaagcaucacaggaagggccucuaccagagauugaggacgagguguuuaagaaaagaaacuuaacaauaauggaccugcacccaggaucagggaaaacaagaagauaucuuccagccauaguccgugaggccauaaaaaggaaacugcguacguuaaucuuggcucccacaagaguugucgccucugaaauggcagaggcacucaagggaaugccaauaagauaucagacaacagcagugaagagugaacacacaggaagggagauaguugaccucaugugccacgcuacuuuuaccaugcgucucuuauccccagugagaguucccaauuacaacaugauuauuauggaugaagcacauuuuaccgauccagcuagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggauuacugacuuuucagguaaaacagucugguuuguuccaagcauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuucugaaaugggagcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccuuuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcgaccucgcugguuggacgccagaacauacucugauccauuggcccugcgcgaguuuaaagaguucgcagcaggaagaagaagugucucaggugaccuaauauuggaaauagggaaacuuccacaacauuugacgcuaagagcccagaaugcucuggacaacuuggucauguugcacaauuccgaacaaggaggaaaagccuacagacaugcuauggaggaacuaccagacaccauagaaacauugaugcuucuagcuuugauagcuguguugacugguggagugacgcuguucuuccuaucaggaaaaggucuagggaaaacauccauuggcuugcucugugugacggccucaagcgcacuguuauggauggccaguguggagccccauuggauagcggccuccaucauacuagaguucuuuuugauggugcugcucauuccagaaccagacagacagcgcacuccacaggacaaccagcuagcauauguggugauagguuuguuauucaugauacugacaguggcagccaaugagaugggauuauuggaaaccacaaagaaagaccuggggauuggcuauguagccgccgaaaaccaccaacaugcuacaaugcuggacguagaccuacacccagcuucagccuggacccucuaugcaguagccacaacaguuaucacucccaugaugagacacacaauugaaaauacaacggcaaacauuucccugacagccauugcaaaucaggcagccauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacaauagcaguguccauggcaaacaucuucaggggaaguuauuuagcaggagcaggucuggcuuucucauuaaugaaaucuuuaggaggagguaggagagguaccggagcucaaggggaaacauugggagagaaauggaaaagacaguuaaaccaacugagcaagucagaauucaacaccuacaaaaggagugggauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaaguuacugaagugaagggauacacaaaaggaggaccuggacaugaggaaccuaucccaauggcgaccuauggauggaaccuaguaaagcuacacucuggaaaggauguauuuuuuaugccaccugagaaaugugacacccuucugugugauauuggugaguccucuccgaauccaacuauagaagaaggaagaacguuacguguucuaaaaaugguggaaccauggcucagaggaaaccaauucugcauaaaaauccuaaauccuuacaugccaagugugguagaaacucuggagcaaaugcaaagaaaacauggagggaugcuagugcgaaacccacucucaagaaauucuacccaugaaauguauuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguagccaaccuagaugucauuggccagaggauagagaauauaaaaaaugaacacaagucaacauggcauuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugacugauaccacacccuuuggacaacagagaguguuuaaagagaaaguugacacgcgcacaccaagagcaaaacgaggcacaacacagauuauggaggugacagccaagugguuaugggguuuccuuuccagaaacaaaaaacccagaaucugcacaagagaggaguucacaagaaagguuaggucaaacgcggcaauaggagcaguguucguugaugaaaaccaauggaacucagcaaaagaagcaguggaagacgaaagguuuugggaccuugugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaagcccuugguuucaugaaugaagaucacugguuuaguagagagaauucacucaguggaguggaaggagaaggacugcacaaacuuggauacauacucagagacauaucaaagauuccggggggaaauauguaugcagaugauacagccggaugggacacaagaauaacagaggaugaucuucagaaugaggcuaaaaucacugacaucauggagccugaacaugcucuauuggcuacgucaauuuuuaagcugacuuaucaaaacaagguggugagggugcaaagaccagcaaaaaauggaaccgugauggauguuauauccagacgugaucagagaggaaguggacaggucggaacuuauggcuuaaauacuuucaccaauauggagguccaacuaauaagacaaauggaaucugaaggaaucuuuuuacccagcgaauuggaaacccccaaccuagcugagagggcucuugacugguuagaaaaacauggcgccgaaaggcugaaacgaauggcaaucagcggagaugauugcguggugaaaccaauugacgacagguucgcaacagccuuaacagcucugaaugacaugggaaaaguaagaaaagacauaccgcagugggaaccuucgaaaggauggaaugauuggcagcaagugccuuuuuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuagcggcuaacgcuaucugcucagccgucccaguugauugggucccagccagccgcacaaccuggucaauccaugcccaccaccaauggaugacaacagaagacauguuaucaguguggaauagaguuuggauagaggaaaacccauggauggaggacaaaacucauguauccaguugggaagaaguuccauaccuaggaaaaagggaagaccaaugguguggaucccugauaggcuugacagcgagggccaccugggccaccaacauacaaguagccauaaaccaagugagaaggcucaucgggaaugagaauuauuuagauuacaugacaucaaugaagagauucaagaaugagagugaucccgaaggagcacucugguaa

SEQ ID NO: 6228 - RNA, 9879 nt, Artificial Sequence
  derived and/or modified CDS sequence (wt) from DENV-1__KC692499__SS-prME
uccgugaccaugcuccucaugcugcugcccacagcccuggcguuucauuugaccacacgagggggagagccacacaugauaguuaguaagcaggaaagaggaaagucacucuuguuuaagaccucugcgggcgucaauaugugcacccucauugcgauggacuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagagaaacguuccguggcacuggccccacacgugggacuuggucuagaaacaagaaccgaaacauggauguccucugaaggcgccuggaaacaaauacaaagaguggaaacuugggcuuugagacacccaggauucacggugauagccuuuuuuuuagcgcaugcuauaggaacauccaucacucaaaaagggaucauuuucaucuugcugaugcuggugacaccaucaauggccaugcgaugcgugggaauaggcaacagagacuucguugaaggacugucaggagcaacguggguggacgugguauuggagcauggaagcugcgucaccaccauggcaaaaaauaaaccaacauuggacauugaacucuugaagacggaggucacgaacccugccgucuugcgcaaacugugcauugaagcuaaaauaucaaacaccaccaccgauucaagauguccaacacaaggagaggcuacacugguggaagaacaagacgugaacuuugugugucgccgaacguuuguggacagaggcugggguaauggcuguggacuauucggaaagggaagucuauugacgugugccaaguucaagugugugacaaaacuagagggaaagauaguucaauaugaaaacuuaaaauauucagugauagucacuguccacacuggggaccagcaccaggugggaaacgagaccacagaacauggaacaauugcaaccauaacaccucaagcucccacgucggaaauacagcugacugacuacggagcccucacauuggacugcucaccuagaacagggcuggacuuuaaugagauggugcuauugacaaugaaagaaaaaucauggcuuguccacaaacaaugguuucuagacuuaccacugccauggacuucgggggcuucaacaucucaagagaccuggaacagacaagauuugcuggucacauucaagacagcucaugcaaagaaacaggaaguagucguacugggaucacaggaaggagcaaugcacacagcguugacuggggcgacagaaauccagacgucaggaacgacaacaaucuucgcaggacaccugaaaugcagacuaaaaauggauaaacugaccuuaaaggggaugucauaugugaugugcacaggcucauuuaagcuagagaaggaaguggcugagacccagcauggaacuguccuagugcaggucaaauaugaaggaacagacgcgccaugcaagauccccuucucgacccaagaugagaaaggagugacccagaaugggagauugauaacagccaaucccauaguuacugacaaagaaaaaccagucaacauugagacagaaccaccuuuuggugagagcuacaucgugguaggggcaggcgaaaaagcuuugaaacuaagcugguucaagagaggaagcagcauagggaaaauguucgaagcaaccgcccgaggagcacgaaggauggcuauccugggagacaccgcaugggacuucgguucuauaggaggaguguuuacaucugugggaaaauugguacaccagguuuuuggaaccgcauaugggguucuguuuagcgguguuucuuggaccaugaaaauaggaauagggauucugcugacaugguugggauuaaauucaaggagcacgucacuuucgaugacgugcauugcaguuggcauggucacacuguaccuaggagucaugguucaagcggauucgggauguguaaucaacuggaagggcagagaacuuaaauguggaaguggcauuuuugucacuaaugaaguccacacuuggacagagcaauacaaauuccaggcugacuccccaaaaagacugucagcagccauuggaaaggcaugggaggagggcguauguggaauucgaucagccacgcgucuugagaacaucauguggaagcaaauaucaaaugaauugaaccacauucuacuugagaaugacaugaaauucacagugguuguaggagaugccaacggaauuuuggcccaaggaaaaaaaaugauuaggccacaaccuauggaauacaaauacucauggaaaagcuggggaaaagcuaaaaucauaggagcagacauacaaaauaccaccuucaucaucgacggcccagacaccccagaaugucccgauggccaaagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaaugaaaccuggaagcuggcgagagccuccuucauagaagucaagacaugcaccuggccgaaaucucacacucuauggagcaauggagucuuggaaagugaaaugauaaucccaaagauauuuggaggaccaauaucucagcacaacuacagaccaggguauuucacacaaacagcagggccauggcaccuagguaaguuggaacuggauuuugacuugugugaagguaccacaguuguuguggaugaacauuguggaaaucgagguccaucucucagaaccacaacagucacaggaaagauaauccaugaaugguguugcagauccugcacgcuaccccccuuacguuucagaggagaagacggguguugguauggcauggaaaucagaccaguaaaagagaaggaggagaaucuagucagaucaauggucucugcagggucaggagaaguggauaguuuuucauuaggaauacuaugcgugucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuccgcagacuaacauccagagaaguucuucuccucacgauuggauuaagccugguggcauccguggagcuaccaaauucuuuggaggagcuaggggauggacuugcaauggguaucaugauguuaaaauuguugacugaauuucagccacaccaguuauggaccaccuuauugucucugacauuugucaaaacaacucucucacuggauuaugcauggaaaacaacggcuaugguacugucuaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaagcucacuccucaaaaaugaugugccguuggccgggccacuaauagcuggaggcaugcuaauagcauguuaugucauauccggaagcucagccgauuuaucauuggagaaagcggcugaaguauccugggaacaagaagcagaacacuccggugccucacacaacauauuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccagcccuccggaaguggaaagagcaguucuugaugauggcaucuacagaaucuugcaaagaggacuguuggggaggucccaaguaggagugggagucuuccaagacggcguguuccacacaauguggcacguuaccaggggagcuguccuuauguaccaagggaagagauuggaaccaagcugggccagugucaaaaaggacuugaucucauauggaggagguuggagguuccaaggaucauggaacacaggagaagaagugcaggugauagcuguugaaccaggaaaaaaccccaaaaauguacagacaacgccgggcaccuucaagacuccugaaggcgaaguuggagccauagcucuagauuucaaacccggcacaucuggaucucccauugugaacagagagggaaaaauagugggucuguauggaaauggaguggugacaacaaguggaaccuacgucagugccauugcccaagcuaaagcaucacaggaagggccucuaccagagauugaggacgagguguuuaagaaaagaaacuuaacaauaauggaccugcacccaggaucagggaaaacaagaagauaucuuccagccauaguccgugaggccauaaaaaggaaacugcguacguuaaucuuggcucccacaagaguugucgccucugaaauggcagaggcacucaagggaaugccaauaagauaucagacaacagcagugaagagugaacacacaggaagggagauaguugaccucaugugccacgcuacuuuuaccaugcgucucuuauccccagugagaguucccaauuacaacaugauuauuauggaugaagcacauuuuaccgauccagcuagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggauugcugacuuuccagguaaaacagucugguuuguuccaagcauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuucugaaaugggggcgaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccuuuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcgaccucgcugguuggacgccagaacauacucugauccauuggcccugcgcgaguuuaaagaguucgcagcaggaagaagaagugucucaggugaccuaauauuggaaauagggaaacuuccacaacauuugacgcuaagagcccagaaugcucuggacaacuuggucauguugcacaauuccgaacaaggaggaaaagccuacagacaugcuauggaggaacuaccagacaccauagaaacauugaugcuucuagcuuugauagcuguguugacugguggagugacgcuguucuuccuaucaggaaaaggucuagggaaaacauccauuggcuugcucugugugacggccucaagcgcacuguuauggauggccaguguggagccccauuggauagcggccuccaucauacuagaguucuuuuugauggugcugcucauuccagaaccagacagacagcgcacuccacaggacaaccagcuagcauauguggugauagguuuguuauucaugauacugacaguggcagccaaugagaugggauuauuggaaaccacaaagaaagaccuggggauuggcuauguagccgccgaaaaccaccaacaugcuacaaugcuggacguagaccuacacccagcuucagccuggacccucuaugcaguagccacaacaguuaucacucccaugaugagacacacaauugaaaauacaacggcaaacauuucccugacagccauugcaaaucaggcagccauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacaauagcaguguccauggcaaacaucuucaggggaaguuaucuagcaggagcaggucuggcuuucucauuaaugaaaucuuuaggaggagguaggagagguacgggagcucaaggggaaacauugggagagaaauggaaaagacaguuaaaccaacugagcaagucagaauucaacaccuacaaaaggagugggauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaaguuacugaagugaagggauacacaaaaggaggaccuggacaugaggaaccuaucccaauggcgaccuauggauggaaccuaguaaagcuacacucuggaaaggauguauuuuuuaugccaccugagaaaugugacacccuucugugugauauuggugaguccucuccgaauccaacuauagaagaaggaagaacguuacguguucuaaaaaugguggaaccauggcucagaggaaaccaauucugcauaaaaauucuaaauccuuacaugccaagugugguagaaacucuggagcaaaugcaaagaaaacauggagggaugcuagugcgaaacccacucucaagaaauucuacccaugaaauguauuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugacugacaccacacccuuuggacaacagagaguguuuaaagagaaaguugacacgcgcacaccaagagcaaaacgaggcacaacacagauuauggaggugacagccaagugguuaugggguuuccuuuccagaaacaaaaaacccagaaucugcacaagagaggaguucacaagaaaggucaggucaaacgcggcaauaggagcaguguucguugaugaaaaccaauggaacucagcaaaagaagcaguggaagacgaaagguuuugggaucuugugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaagcccuugguuucaugaaugaagaucacugguuuaguagagagaauucacucaguggaguggaaggagaaggacugcacaaacuuggauacauacucagagacauaucaaagauuccggggggaaauauguaugcagaugauacagccggaugggacacaagaauaacagaggaugaucuucagaaugaggcuaaaaucacugacaucauggagccugaacaugcucuauuggcuacgucaauuuuuaagcugacuuaucaaaacaagguggugagggugcaaagaccagcaaaaaauggaaccgugauggauguuauauccagacgugaucagagaggaaguggacaggucggaacuuauggcuuaaauacuuucaccaauauggagguccaacuaauaagacaaauggaaucugaaggaaucuuuuuacccagcgaauuggaaacccccaaccuagcugagagggcucuugacugguuagaaaaacauggcgccgaaaggcugaaacgaauggcaaucagcggagaugauugcguggugaaaccaauugacgacagguucgcaacagccuuaacagcucugaaugacaugggaaaaguaagaaaagacauaccgcagugggaaccuucgaaaggauggaaugauuggcagcaagugccuuuuuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuagcggcuaacgcuaucugcucagccgucccaguugauugggucccagccagccgcacaaccuggucaauccaugcccaccaccaauggaugacaacagaagacauguuaucaguguggaauagaguuuggauagaggaaaacccauggauggaggacaaaacucauguauccaguugggaagaaguuccauaccuaggaaaaagggaagaccaaugguguggaucccugauaggcuugacagcgagggccaccugggccaccaacauacaaguagccauaaaccaagugagaaggcucaucgggaaugagaauuauuuagauuacaugacaucaaugaagagauucaagaaugagagugaucccgaaggagcacucugguaa

SEQ ID NO: 6229 - RNA, 9879 nt, Artificial Sequence
  derived and/or modified CDS sequence (wt) from DENV-1__KC692500__SS-prME
uccgugaccaugcuccucaugcugcugcccacagcccuggcguuucauuugaccacucgagggggagagccacacaugauaguuaguaagcaggaaagaggaaagucacucuuguuuaagaccucugcgggcgucaauaugugcacccucauugcgauggacuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagagaaacguuccguggcacuggccccacacgugggacuuggucuagaaacaagaaccgaaacauggauguccucugaaggcgccuggaaacaaauacaaagaguggaaacuugggcuuugagacacccaggauucacggugauagccuuuuuuuuagcgcaugcuauaggaacauccaucacucaaaaagggaucauuuucaucuugcugaugcuggugacaccaucaauggccaugcgaugcgugggaauaggcaacagagacuucguugaaggacugucaggagcaacguggguggacgugguauuggagcauggaagcugcgucaccaccauggcaaaaaauaaaccaacauuggacauugaacucuugaagacggaggucacgaacccugccgucuugcgcaaacugugcauugaagcuaaaauaucaaacaccaccaccgauucaagauguccaacacaaggagaggcuacauugguggaagaacaagacgcgaacuuugugugucgccgaacguuuguggacagaggcugggguaauggcuguggacuauucggaaagggaagucuauugacgugugccaaguucaagugugugacaaaacuagagggaaagauaguucaauaugaaaacuuaaaauauucagugauagucacuguccacacuggggaccagcaccaggugggaaacgagaccacagaacauggaacaauugcaaccauaacaccucaagcucccacgucggaaauacagcugacugacuacggagcccucacauuggacugcucaccuagaacagggcuggacuuuaaugagauggugcuauugacaaugaaaggaaaaucauggcuuguccacaaacaaugguuucuagacuuaccacugccauggacuucgggggcuucaacaucucaagagaccuggaacagacaagauuugcuggucacauucaagacagcucaugcaaagaaacaggaaguagucguacugggaucacaggaaggagcaaugcacacagcguugacuggggcgacagaaauccagacgucaggaacgacaacaaucuucgcaggacaccugaaaugcagacuaaaaauggauaaacugaccuuaaaggggaugucauaugugaugugcacaggcucauuuaagcuagagaaggaaguggcugagacccagcauggaacuguccuagugcaggucaaauaugaaggaacagacgcgccaugcaagauccccuucucgacccaagaugagaaaggagugacccagaaugggagauugauaacagccaaucccauaguuacugacaaagaaaaaccagucaacauugagacagaaccaccuuuuggugagagcuacaucgugguaggggcaggcgaaaaagcuuugaaacuaagcugguucaagagaggaagcagcauagggaaaauguucgaagcaaccgcccgaggagcacgaaggauggcuauccugggagacaccgcaugggacuucgguucuauaggaggaguguuuacaucugugggaaaauugguacaccagguuuuuggaaccgcauaugggguucuguuuagcgguguuucuuggaccaugaaaauaggaauagggauucugcugacaugguugggauuaaauucaaggagcacgucacuuucgaugacgugcauugcaguuggcauggucacacuguaccuaggagucaugguucaagcggauucgggauguguaaucaacuggaagggcagagaacuuaaauguggaaguggcauuuuugucacuaaugaaguccacacuuggacagagcaauacaaauuccaggcugacuccccaaaaagacugucagcagccauuggaaaggcaugggaggagggcguauguggaauucgaucagccacgcgucuugagaacaucauguggaagcaaauaucaaaugaauugaaccacauucuacuugagaaugacaugaaauucacagugguuguaggagaugccaacggaauuuuggcccaaggaaaaaaaaugauuaggccacaaccuauggaacacaaauacucauggaaaagcuggggaaaagcuaaaaucauaggagcagacauacaaaauaccaccuucaucaucgacggcccagacaccccagaaugucccgauggccaaagagcauggaacauuugggaaguugaggacuauggguuuggaguuuucacgacaaacauaugguugaaauugcgugacuccuacacccaaaugugugaccaccggcuaaugucagcugccaucaaggacagcaaggcaguccaugcugacaugggguacuggauagaaagugaaaagaaugaaaccuggaagcuggcgagagccuccuucauagaagucaagacaugcaccuggccgaaaucucacacucuauggagcaauggagucuuggaaagugaaaugauaaucccaaagauauuuggaggaccaauaucucagcacaacuacagaccaggguauuucacacaaacagcagggccauggcaccuagguaaguuggaacuggauuuugacuugugugaagguaccacaguuguuguggaugaacauuguggaaaucgagguccaucucucagaaccacaacagucacaggaaagauaauccaugaaugguguugcagauccugcacgcuaccccccuuacguuucagaggagaagacggguguugguauggcauggaaaucagaccaguaaaggagaaggaggagaaucuagucaggucaauggucucugcagggucaggagaaguggauaguuuuucauuaggaauacuaugcgugucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuccgcagacuaacauccagagaaguucuucuccucacgauuggauuaagccugguggcauccguggagcuaccaaauucuuuggaggagcuaggggauggacuugcaauggguaucaugauguuaaaauuguugacugaauuucagccacaccaguuauggaccaccuuauugucucugacauuugucaaaacaacucucucacuggauuaugcauggaaaacaacggcuaugguacugucuaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaagcucacuccucaaaaaugaugugccguuggccgggccacuaauagcuggaggcaugcuaauagcauguuaugucauauccggaagcucagccgauuuaucauuggagaaagcggcugaaguauccugggaacaagaagcagaacacuccggugccucacacaacauauuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccagcccuccggaaguggaaagagcaguucuugaugauggcaucuauagaaucuugcaaagaggacuguuggggaggucccaaguaggagugggagucuuccaagacggcguguuccacacaauguggcacguuaccaggggagcuguccuuauguaccaagggaagagacuggaaccaagcugggccagugucaaaaaggacuugaucucauauggaggagguuggagguucaaaggaucauggaacacaggagaagaagugcaggugauagcuguugaaccaggaaaaaaccccaaaaauguacagacaacgccgggcaccuucaagacuccugaaggcgaaguuggagccauagcucuagauuucaaacccggcacaucuggaucucccauugugaacagagagggaaaaauagugggucuguauggaaauggaguggugacaacaaguggaaccuacgucagugccauugcccaagcuaaagcaucacaggaagggccucuaccagagauugaggacgagguguuuaagaaaagaaacuuaacaauaauggaccugcacccaggaucagggaaaacaagaagauaucuuccagccauaguccgugaggccauaaaaaggaaacugcguacguuaaucuuggcucccacaagaguugucgccucugaaauggcagaggcacucaagggaaugccaauaagauaucagacaacagcagugaagagugaacacacaggaagggagauaguugaccucaugugccacgcuacuuuuaccaugcgucucuuauccccagugagaguucccaauuacaacaugauuauuauggaugaagcacauuuuaccgauccagcuagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggauuacugacuuuccagguaaaacagucugguuuguuccaagcauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuucugaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccuuuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcgaccucgcugguuggacgccagaacauacucugauccauuggcccugcgcgaguucaaagaguucgcagcaggaagaagaagugucucaggugaccuaauauuggaaauagggaaacuuccacaacauuugacgcuaagagcccagaaugcucuggacaacuuggucauguugcacaauuccgaacaaggaggaaaagccuacagacaugcuauggaggaacuaccagacaccauagaaacauugaugcuucuagcuuugauagcuguguugacugguggagugacgcuguucuuccuaucaggaaaaggucuagggaaaacauccauuggcuugcucugugugacggccucaagcgcacuguuauggauggccaguguggagccccauuggauagcggccuccaucauacuagaguucuuuuugauggugcugcuuauuccagaaccagacagacagcgcacuccacaggacaaccagcuagcauauguggugauagguuuguuauucaugauacugacaguggcagccaaugagaugggauuauuggaaaccacaaagaaagaccuggggauuggcuauguagccgccgaaaaccaccaacaugcuacaaugcuggacguagaccuacacccagcuucagccuggacccucuaugcaguagccacaacaguuaucacucccaugaugagacacacaauugaaaauacaacggcaaacauuucccugacagccauugcaaaucaggcagccauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacaauagcaguguccauggcaaacaucuucaggggaaguuaucuagcaggagcaggucuggcuuucucauuaaugaaaucuuuaggaggagguaggagagguacgggagcucaaggggaaacauugggagagaaauggaaaagacaguuaaaccaacugagcaagucagaauucaacaccuacaaaaggagugggauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaaguuacugaagugaagggauauacaaaaggaggaccuggacaugaggaaccuaucccaauggcgaccuauggauggaaccuaguaaagcuacacucuggaaaggauguauuuuuuaugccaccugagaaaugugacacccuucugugugauauuggugaguccucuccgaauccaacuauagaagaaggaagaacguuacguguucuaaaaaugguggaaccauggcucagaggaaaccaauucugcauaaaaauccuaaauccuuacaugccaagugugguagaaacucuggagcaaaugcaaagaaaacauggagggaugcuagugcgaaacccacucucaagaaauucuacccaugaaauguauuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugacugauaccacacccuuuggacaacagagaguguuuaaagagaaaguugacacgcgcacaccaagagcaaaacgaggcacaacacagauuauggaggugacagccaagugguuaugggguuuccuuuccagaaacaaaaaacccagaaucugcacaagagaggaguucacaagaaagguuaggucaaacgcggcaauaggagcaguguucguugaugaaaaccaauggaacucagcaaaagaagcaguggaagacgaaagguuuugggaucuugugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaagcccuugguuucaugaaugaagaucacugguuuaguagagagaauucacucaguggaguggaaggagaaggacugcacaaacuuggauacauacucagagacauaucaaagauuccggggggaaauauguaugcagaugauacagccggaugggacacaagaauaacagaggaugaucuucagaaugaggcuaaaaucacugacaucauggagccugaacaugcucuauuggcuacgucaauuuuuaagcugacuuaucaaaacaagguggugagggugcaaagaccagcaaaaaauggaaccgugauggauguuauauccagacgugaucagagaggaaguggacaggucggaacuuauggguuaaauacuuucaccaauauggagguccaacuaauaagacaaauggaaucugaaggaaucuuuuuacccagcgaauuggaaacccccaaccuagcugagagggcucuugacugguuagaaaaacauggcgccgaaaggcugaaacgaauggcaaucagcggagaugauugcguggugaaaccaauugacgacagguucgcaacagccuuaacagcucugaaugacaugggaaaaguaagaaaagacauaccgcagugggaaccuucgaaaggauggaaugauuggcagcaagugccuuuuuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuagcggcuaacgcuaucugcucagccgucccaguugauugggucccagccagccgcacaaccuggucaauccaugcccaccaccaauggaugacaacagaagacauguuaucaguguggaauagaguuuggauagaggaaaacccauggauggaggacaaaacucauguauccaguugggaagaaguuccauaccuaggaaaaagggaagaccaaugguguggaucccugauaggcuugacagcgagggccaccugggccaccaacauacaaguagccauaaaccaagugagaaggcucaucgggaaugagaauuauuuagauuacaugacaucaaugaagagauucaagaaugagagugaucccgaaggagcacucugguaa

SEQ ID NO: 6230 - RNA, 9879 nt, Artificial Sequence
  derived and/or modified CDS sequence (wt) from DENV-1__KC692501__SS-prME
uccgugaccaugcuccucaugcugcugcccacagcccuggcguuucauuugaccacacgagggggagagccacacaugauaguuaguaagcaggaaagaggaaagucacucuuguuuaagaccucugcgggcgucaauaugugcacccucauugcgauggacuugggagaguuaugugaggacacaaugaccuacaaaugcccccggaucacugaggcggaaccagaugacguugacugcuggugcaaugccacagacacaugggugaccuaugggacgugcucucaaaccggcgaacaccgacgagagaaacguuccguggcacuggccccacacgugggacuuggucuagaaacaagaaccgaaacauggauguccucugaaggcgccuggaaacaaauacaaagaguggaaacuugggcuuugagacacccaggauucacggugauagccuuuuuuuuagcgcaugcuauaggaacauccaucacucaaaaagggaucauuuucaucuugcugaugcuggugacaccaucaauggccaugcgaugcgugggaauaggcaacagagacuucguugaaggacugucaggagcaacguggguggacgugguauuggagcauggaagcugcgucaccaccauggcaaaaaauaaaccaacauuggacauugaacucuugaagacggaggucacgaacccugccgucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcugggguaauggcuguggacuauucggaaagggaagucuauugacgugugccaaguucaagugugugacaaaacuagagggaaagauaguucaauaugaaaacuuaaaauauucagugauugucacuguccacacuggggaccagcaccaggugggaaacgagaccacagaacauggaacaauugcaaccauaacaccucaagcucccacgucggaaauacagcugacugacuacggagcccucacauuggacugcucaccuagaacagggcuggacuuuaaugagauggugcuauugacaaugaaagaaaaaucauggcuuguccacaaacaaugguuucuagacuuaccacugccauggacuucgggggcuucaacaucucaagagaccuggaacagacaagauuugcuggucacauucaagacagcucaugcaaagaaacaggaaguagucguacugggaucacaggaaggagcaaugcacacagcguugacuggggcgacagaaauccagacgucaggaacgacaacaaucuucgcaggacaccugaaaugcagacuaaaaauggauaaacugaccuuaaaggggaugucauaugugaugugcacaggcucauuuaagcuagagaaggaaguggcugagacccagcauggaacuguccuagugcaggucaaauaugaaggaacagacgcgccaugcaagauccccuucucgacccaagaugagaaaggagugacccagaaugggagauugauaacagccaaucccauaguuacugacaaagaaaaaccagucaacauugagacagaaccaccuuuuggugagagcuacaucgugguaggggcaggcgaaaaagcuuugaaacuaagcugguucaagagaggaagcagcauagggaaaauguucgaagcaaccgcccgaggagcacgaaggauggcuauccugggagacaccgcaugggacuucgguucuauaggaggaguguuuacaucugugggaaaauugguacaccagguuuuuggaaccgcauaugggguucuguuuagcgguguuucuuggaccaugaaaauaggaauagggauucugcugacaugguugggauuaaauucaaggagcacgucacuuucgaugacgugcauugcaguuggcauggucacacuguaccuaggagucaugguucaagcggauucgggauguguaaucaacuggaagggcagagaacuuaaauguggaaguggcauuuuugucacuaaugaaguccacacuuggacagagcaauacaaauuccaggcugacuccccaaaaagacugucagcagccauuggaaaggcaugggaggagggcguauguggaauucgaucagccacgcgucuugagaacaucauguggaagcaaauaucaaaugaauugaaccacauucuacuugagaaugacaugaaauucacagugguuguaggagaugccaacggaauuuuggcccaaggaaaaaaaaugauuaggccacaaccuauggaacacaaauacucauggaaaagcuggggaaaagcuaaaaucauaggagcagacauacaaaauaccaccuucaucaucgacggcccagacaccccagaaugucccgauggccaaagagcauggaacauuugggaaguugaggacuauggguuuggaguuuucacgacaaacauaugguugaaauugcgugacuccuacacccaaaugugugaccaccggcuaaugucagcugccaucaaggacagcaaggcaguccaugcugacaugggguacuggauagaaagugaaaagaaugaaaccuggaagcuggcgagagccuccuuuauagaagucaagacaugcaccuggccgaaaucucacacucuauggagcaauggagucuuggaaagugaaaugauaaucccaaagauauuuggaggaccaauaucucagcacaacuacagaccaggguauuucacacaaacagcagggccauggcaccuagguaaguuggaacuggauuuugacuugugugaagguaccacaguuguuguggaugaacauuguggaaaucgagguccaucucucagaaccacaacagucacaggaaagauaauccaugaaugguguugcagauccugcacgcuaccccccuuacguuucagaggagaagacggguguugguauggcauggaaaucagaccaguaaaggagaaggaggagaaucuagucaggucaauggucucugcagggucaggagaaguggauaguuuuucauuaggaauacuaugcgugucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuccgcagacuaacauccagagaaguucuucuccucacgauuggauuaagccugguggcauccguggagcuaccaaauucuuuggaggagcuaggggauggacuugcaauggguaucaugauguuaaaauuguugacugaauuucagccacaccaguuauggaccaccuuauugucucugacauuugucaaaacaacucucucacuggauuaugcauggaaaacaacggcuaugguacugucuaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaagcucacuccucaaaaaugaugugccguuggccgggccacuaauagcuggaggcaugcuaauagcauguuaugucauauccggaagcucagccgauuuaucauuggagaaagcggcugaaguauccugggaacaagaagcagaacacuccggugccucacacaacauauuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccagcccuccggaaguggaaagagcaguucuugaugauggcaucuauagaaucuugcaaagaggacuguuggggaggucccaaguaggagugggagucuuccaagacggcguguuccacacaauguggcacguuaccaggggagcuguccuuauguaccaagggaagagacuggaaccaagcugggccagugucaaaaaggacuugaucucauauggaggagguuggagguuccaaggaucauggaacacaggagaagaagugcaggugauagcuguugaaccaggaaaaaaccccaaaaauguacagacaacgccgggcaccuucaagacuccugaaggcgaaguuggagccauagcucuagauuucaaacccggcacaucuggaucucccauugugaacagagaggaaaaaauagugggucuguauggaaauggaguggugacaacaaguggaaccuacgucagugccauugcccaagcuaaagcaucacaggaagggccucuaccagagauugaggacgagguguuuaagaaaagaaacuuaacaauaauggaccugcacccaggaucagggaaaacaagaagauaucuuccagccauaguccgugaggccauaaaaaggaaacugcguacguuaaucuuggcucccacaagaguugucgccucugaaauggcagaggcacucaagggaaugccaauaagauaucagacaacagcagugaagagugaacacacaggaagggagauaguugaccucaugugccacgcuacuuuuaccaugcgucucuuauccccagugagaguucccaauuacaacaugauuauuauggaugaagcacauuuuaccgauccagcuagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggauuacugacuuuccagguaaaacagucugguuuguuccaagcauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuucugaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccuuuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcgaccucgcugguuggacgccagaacauacucugauccauuggcccugcgcgaguuuaaagaguucgcagcaggaagaagaagugucucaggugaccuaauauuggaaauagggaaacuuccacaacauuugacgcuaagagcccagaaugcucuggacaacuuggucauguugcacaauuccgaacaaggaggaaaagccuacagacaugcuauggaggaacugccagacaccauagaaacauugaugcuucuagcuuugauagcuguguugacugguggagugacgcuguucuuccuaucaggaaaaggucuagggaaaacauccauuggcuugcucugugugacggccucaagugcacuguuauggauggccaguguggagccccauuggauagcggccuccaucauacuagaguucuuuuugauggugcugcucauuccagaaccagacagacagcgcacuccacaggacaaccagcuagcauauguggugauagguuuguuauucaugauacugacaguggcagccaaugagaugggauuauuggaaaccacaaagaaagaccuggggauuggcuauguagccgccgaaaaccaccaacaugcuacaaugcuggacguagaccuacacccagcuucagccuggacccucuaugcaguagccacaacaguuaucacucccaugaugagacacacaauugaaaauacaacggcaaacauuucccugacagccauugcaaaucaggcagccauauugaugggacuugacaagggauggccaauaucgaagauggacauaggaguuccacuucucgccuuagggugcuauucccaggugaacccauugacacugacagcggcgguguugauguuaguggcucauuaugcuauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacaauagcaguguccauggcaaacaucuucaggggaaguuaucuagcaggagcaggucuggcuuucucauuaaugaaaucuuuaggaggagguaggagagguacgggagcucaaggggaaacauugggagagaaauggaaaagacaguuaaaccaacugagcaagucagaauucaacaccuacaaaaggagugggauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaaguuacugaagugaagggauacacaaaaggaggaccuggacaugaggaaccuaucccaauggcgaccuauggauggaaccuaguaaagcuacacucuggaaaggauguauuuuuuaugccaccugagaaaugugacacccuucugugugauauuggugaguccucuccgaauccaacuauagaagaaggaagaacguuacguguucuaaaaaugguggaaccauggcucagaggaaaccaauucugcauaaaaauccuaaauccuuacaugccaagugugguagaaacucuggagcaaaugcaaagaaaacauggagggaugcuagugcgaaacccacucucaagaaauucuacccaugaaauguauuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugacugauaccacacccuuuggacaacagagaguguuuaaagagaaaguugacacgcgcacaccaagagcaaaacgaggcacaacacagauuauggaggugacagccaagugguuaugggguuuccuuuccagaaacaaaaaacccagaaucugcacaagagaggaguucacaagaaagguuaggucaaacgcggcaauaggagcaguguucguugaugaaaaccaauggaacucagcaaaagaagcaguggaagacgaaagguuuugggaucuugugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaagcccuugguuucaugaaugaagaucacugguuuaguagagagaauucacucaguggaguggaaggagaaggacugcacaaacuuggauacauacucagagacauaucaaagauuccggggggaaacauguaugcagaugauacagccggaugggacacaagaauaacagaggaugaucuucagaaugaggcuaaaaucacugacaucauggagccugaacaugcccuauuggcuacgucaauuuuuaagcugacuuaucaaaacaagguggugagggugcaaagaccagcaaaaaauggaaccgugauggauguuauauccagacgugaucagagaggaaguggacaggucggaacuuauggcuuaaauacuuucaccaauauggagguccaacuaauaagacaaauggaaucugaaggaaucuuuuuacccagcgaauuggaaacccccaaccuagcugagagggcucuugacugguuagaaaaacauggcgccgaaaggcugaaacgaauggcaaucagcggagaugauugcguggugaaaccaauugacgacagguucgcaacagccuuaacagcucugaaugacaugggaaaaguaagaaaagacauaccgcagugggaaccuucgaaaggauggaaugauuggcagcaagugccuuuuuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuagcggcuaacgcuaucugcucagccgucccaguugauugggucccagccagccgcacaaccuggucaauccaugcccaccaccaauggaugacaacagaagacauguuaucaguguggaauagaguuuggauagaggaaaacccauggauggaggacaaaacucauguauccaguugggaagaaguuccauaccuaggaaaaagggaagaccaaugguguggaucccugauaggcuugacagcgagggccaccugggccaccaacauacaaguagccauaaaccaagugagaaggcucaucgggaaugagaauuauuuagauuacaugacaucaaugaagagauucaagaaugagagugaucccgaaggagcacucugguaa

SEQ ID NO: 6231 - RNA, 9879 nt, Artificial Sequence
  derived and/or modified CDS sequence (wt) from DENV-1__KC692502__SS-prME
uccgugaccaugcuccucaugcugcugcccacagcccuggcguuucauuugaccacacgagggggagagccacacaugauaguuaguaagcaggaaagaggaaagucacuccuguuuaagaccucugcgggcgucaauaugugcacccucauugcgauggacuugggagaguuaugugaggacacaaugaccuacaaaugcccccggaucacugaggcggaaccagaugacguugacugcuggugcaaugccacagacacaugggugaccuaugggacguguucucaaaccggggaacaccgacgagagaaacguuccguggcacuggccccacacgugggacuuggucuagaaacaagaaccgaaacauggauguccucugaaggcgccuggaaacaaauacaaagaguggaaacuugggcuuugagacacccaggauucacggugauagccuuuuuuuuagcgcaugcuauaggaacauccaucacccaaaaagggaucauuuucaucuugcugaugcuggugacaccaucaauggccaugcgaugcgugggaauaggcaacagagacuucguugaaggacugucaggagcaacguggguggacgugguauuggagcauggaagcugcgucaccaccauggcaaaaaauaaaccaacauuggacauugaacucuugaagacggaggucacgaacccugccgucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcugggguaauggcuguggacuauucggaaagggaagucuguugacgugugccaaguucaagugugugacaaaacuagagggaaagauaguucaauaugaaaacuuaaaauauucagugauagucacuguccacacuggggaccagcaccaggugggaaacgagaccacagaacauggaacaauugcaaccauaacaccucaagcucccacgucggaaauacagcugacugacuacggagcccucacauuggacugcucaccuagaacagggcuggacuuuaaugagauggugcuauugacaaugaaagaaaaaucauggcuuguccacaaacaaugguuucuagacuuaccacugccauggacuucgggggcuucaacaucucaagagaccuggaacagacaagauuugcuggucacauucaagacagcucaugcaaagaaacaggaaguagucguacugggaucacaggaaggagcaaugcacacagcguugacuggggcgacagaaauccagacgucaggaacgacaacaaucuucgcaggacaccugaaaugcagacuaaaaauggauaaacugaccuuaaagggggugucauaugugaugugcacaggcucauuuaagcuagagaaggaaguggcugagacccagcauggaacuguccuagugcaggucaaauaugaaggaacagacgcgccaugcaagauccccuucucgacccaagaugagaaaggagugacccagaaugggagauugauaacagccaaucccauaguuacugacaaagaaaaaccagucaacauugagacagaaccaccuuuuggugagagcuacaucgugguaggggcaggcgaaaaagcuuugaaacuaagcugguucaagagaggaagcagcauagggaaaauguucgaagcaaccgcccgaggagcacgaaggauggcuauccugggagacaccgcaugggacuucgguucuauaggaggaguguuuacaucugugggaaaauugguacaccagguuuuuggaaccgcauaugggguucuguuuagcgguguuucuuggaccaugaaaauaggaauagggauucugcugacaugguugggauuaaauucaaggagcacgucacuuucgaugacgugcauugcaguuggcauggucacacuguaccuaggagucaugguucaagcggauucgggauguguaaucaacuggaagggcagagaacuuaaauguggaaguggcauuuuugucacuaaugaaguccacacuuggacagagcaauacaaauuccaggcugacuccccaaaaagacugucagcagccauuggaaaggcaugggaggagggcguauguggaauucgaucagccacgcgucuugagaacaucauguggaagcaaauaucaaaugaauugaaccacauucuacuugagaaugacaugaaauucacagugguuguaggagaugccaacggaauuuuggcccaaggaaaaaaaaugauuaggccacaaccuauggaacacaaauacucauggaaaagcuggggaaaagcuaaaaucauaggagcagacauacaaaauaccaccuucaucaucgacggcccagacaccccagaaugucccgauggccaaagagcauggaacauuugggaaguugaggacuauggguuuggaguuuucacgacaaacauaugguugaaauugcgugacuccuacacccaaaugugugaccaccggcuaaugucagcugccaucaaggacagcaaggcaguccaugcugacaugggguacuggauagaaagugaaaagaaugagaccuggaagcuggcgagagccuccuucauagaagucaagacaugcaccuggccgaaaucucacacucuauggagcaauggagucuuggaaagugaaaugauaaucccaaagauauuuggaggaccaauaucucagcacaacuacagaccaggguauuucacacaaacagcagggccauggcaccuagguaaguuggaacuggauuuugacuugugugaagguaccacaguuguuguggaugaacauuguggaaaucgagguccaucucucagaaccacaacagucacaggaaagauaauccaugaaugguguugcagauccugcacgcuaccccccuuacguuucagaggagaagacggguguugguauggcauggaaaucagaccaguaaaggagaaggaggagaaucuagucaggucaauggucucugcagggucaggagaaguggauaguuuuucauuaggaauacuaugcgugucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuccgcagacuaacauccagagagguucuucuccucacgauuggguuaagccugguggcauccguggagcuaccaaauucuuuggaggagcuaggggauggacuugcaauggguaucaugauguuaaaauuguugacugaauuucagccacaccaguuauggaccaccuuauugucucugacauuugucagaacaacucucucacuggauuaugcauggaaaacaacggcuaugguacugucuaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaagcucacuccucaaaaaugaugugccguuggccgggccacuaauagcuggaggcaugcuaauagcauguuaugucauauccggaagcucagccgauuuaucauuggagaaagcggcugaaguauccugggaacaagaagcagaacacuccggugccucacacaacauauuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccagcccuccggaaauggaaagagcaguucuugaugauggcaucuauagaaucuugcaaagaggacuguuggggaggucccaaguaggagugggagucuuccaagacggcguguuccacacaauguggcacguuaccaggggagcuguccuuauguaccaagggaagagacuggaaccaagcugggccagugucaaaaaggacuugaucucauauggaggagguuggagguuccaaggaucauggaacacaggagaagaagugcaggugauagcuguugaaccaggaaaaaaccccaaaaauguacagacaacgccgggcaccuucaagacuccugaaggcgaaguuggagccauagcucuagauuucaaacccggcacaucuggaucucccauugugaacagagagggaaaaauagugggucuguauggaaauggaguggugacaacaaguggaaccuacgucagugccauugcccaagcuaaagcaucacaggaagggccucuaccagagauugaggacgagguguuuaagaaaagaaacuuaacaauaauggaccugcacccaggaucagggaaaacaagaagauaucuuccagccauaguccgugaggccauaaaaaggaaacugcguacguuaaucuuggcucccacaagaguuguugccucugaaauggcagaggcacucaagggaaugccaauaagauaucagacaacagcagugaagagugaacacacaggaagggagauaguugaccucaugugccacgcuacuuuuaccaugcgucucuuauccccagugagaguucccaauuacaacaugauuauuauggaugaagcacauuuuaccgauccagcuagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggauuacugacuuuccagguaaaacagucugguuuguuccaagcauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuucugaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccuuuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcgaccucgcugguuggacgccagaacauacucugauccauuggcccugcgcgaguuuaaagaguucgcagcaggaagaagaagugucucaggugaccuaauauuggaaauagggaaacuuccacaacauuugacgcuaagagcccagaaugcucuggacaacuuggucauguugcacaauuccgaacaaggaggaaaagccuacagacaugcuauggaggaacuaccagacaccauagaaacauugaugcuucuagcuuugauagcuguguugacugguggagugacgcuguucuuccuaucaggaaaaggucuagggaaaacauccauuggcuugcucugugugacggccucaagcgcacuguuauggauggccaguguggagccccauuggauagcggccuccaucauacuagaguucuuuuugauggugcugcucauuccagaaccagacagacagcgcacuccacaggacaaccagcuagcauauguggugauagguuuguuauucaugauacugacaguggcagccaaugagaugggauuauuggaaaccacaaagaaagaccuggggauuggcuauguagccgccgaaaaccaccaacaugcuacaaugcuggacguagaccuacacccagcuucagccuggacccucuaugcaguagccacaacaguuaucacucccaugaugagacacacaauugaaaauacaacggcaaacauuucccugacagccauugcaaaucaggcagccauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacaauagcaguguccauggcaaacaucuucaggggaaguuaucuagcaggagcaggucuggcuuucucauuaaugaaaucuuuaggaggagguaggagagguacgggagcucaaggggaaacauugggagagaaauggaaaagacaguuaaaccaacugagcaagucagaauucaacaccuacaaaaggagugggauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaaguuacugaagugaagggauacacaaaaggaggaccuggacaugaggaaccuaucccaauggcgaccuauggauggaaccuaguaaagcuacacucuggaaaggauguauuuuuuaugccaccugagaaaugugacacccuucugugugauauuggugaguccucuccgaauccaacuauagaagaaggaagaacguuacguguucuaaaaaugguggaaccauggcucagaggaaaccaauucugcauaaaaauccuaaauccuuacaugccaagugugguagaaacucuggagcaaaugcaaagaaaacauggagggaugcuagugcgaaacccacucucaagaaauucuacccaugaaauguauuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugacugauaccacacccuuuggacaacagagaguguuuaaagagaaaguugacacgcgcacaccaagagcaaaacgaggcacaacacagauuauggaggugacagccaagugguuaugggguuuccuuuccagaaacaaaaaacccagaaucugcacaagagaggaguucacaagaaagguuaggucaaacgcggcaauaggagcaguguucguugaugaaaaccaauggaacucagcaaaagaagcaguggaagacgaaagguuuugggaucuugugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaagcccuugguuucaugaaugaagaucacugguuuaguagagagaauucacucaguggaguggaaggagaaggacugcacaaacuuggauacauacucagagacauaucaaagauuccggggggaaauauguaugcagaugauacagccggaugggacacaagaauaacagaggaugaucuucagaaugaggcuaaaaucacugacaucauggagccugaacaugcucuauuggcuaugucaauuuuuaagcugacuuaucaaaacaagguggugagggugcaaagaccagcaaaaaauggaaccgugauggauguuauauccagacgugaucagagaggaaguggacaggucggaacuuauggcuuaaauacuuucaccaauauggagguccaacuaauaagacaaauggaaucugaaggaaucuuuuuacccagcgaauuggaaacccccaaccuagcugagagggcucuugacugguuagaaaaacauggcgccgaaaggcugaaacgaauggcaaucagcggagaugauugcguggugaaaccaauugacgacagguucgcaacagccuuaacagcuuugaaugacaugggaaaaguaagaaaagacauaccgcagugggaaccuucgaaaggauggaaugauuggcagcaagugccuuuuuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuagcggcuaacgcuaucugcucagccgucccaguugauugggucccagccagccgcacaaccuggucaauccaugcccaccaccaauggaugacaacagaagacauguuaucaguguggaauagaguuuggauagaggaaaacccauggauggaggacaaaacucauguauccaguugggaagaaguuccauaccuaggaaaaagggaagaccaaugguguggaucccugauaggcuugacagcgagggccaccugggccaccaacauacaaguagccauaagccaagugagaaggcucaucgggaaugagaauuauuuagauuacaugacaucaaugaagagauucaagaaugagagugaucccgaaggagcacucugguaa

SEQ ID NO: 6232 - RNA, 9879 nt, Artificial Sequence
  derived and/or modified CDS sequence (wt) from DENV-1__KC692503__SS-prME
uccgugaccaugcuccucaugcugcugcccacagcccuggcguuucauuugaccacacgagggggagagccacacaugauaguuaguaagcaggaaagaggaaagucacucuuguuuaagaccucugcgggcgucaauaugugcacccucauugcgauggacuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagagaaacguuccguggcacuggccccacacgugggacuuggucuagaaacaagaaccgaaacauggauguccucugaaggcgccuggaaacaaauacaaagaguggaaacuugggcuuugagacacccaggauucacggugauagccuuuuuuuuagcgcaugcuauaggaacauccaucacucaaaaagggaucauuuucaucuugcugaugcuggugacaccaucaauggccaugcgaugcgugggaauaggcaacagagacuucguugaaggacugucaggagcaacguggguggacgugguauuggagcauggaagcugcgucaccaccauggcaaaaaauaaaccaacauuggacauugaacucuugaagacggaggucacgaacccugccgucuugcgcaaacugugcauugaagcuaaaauaucaaacaccaccaccgauucaagauguccaacacaaggagaggccacacugguggaagaacaagacgcgaacuuugugugucgccgaacguuuguggacagaggcugggguaauggcuguggacuauucggaaagggaagucuauugacgugugccaaguucaagugugugacaaaacuagagggaaagauaguucaauaugaaaacuuaaaauauucagugauagucacuguccacacuggggaccagcaccaggugggaaacgagaccacagaacauggaacaauugcaaccauaacaccucaagcucccacgucggaaauacagcugacugacuacggagcccucacauuggacugcucaccuagaacagggcuggacuuuaaugagauggugcuauugacaaugaaagaaaaaucauggcuuguccacaaacaaugguuucuagacuuaccacugccauggacuucgggggcuucaacaucucaagagaccuggaacagacaagauuugcuggucacauucaagacagcucaugcaaagaaacaggaaguagucguacugggaucacaggaaggagcaaugcacacagcguugacuggggcgacagaaauccagacgucaggaacgacaacaaucuucgcaggacaccugaaaugcagacuaaaaauggauagacugaccuuaaaggggaugucauaugugaugugcacaggcucauuuaagcuagagaaggaaguggcugagacccagcauggaacuguccuagugcaggucaaauaugaaggaacagacgcgccaugcaagauccccuucucgacccaagaugagaaaggagugacccagaaugggagauugauaacagccaaucccauaguuacugacaaagaaaaaccagucaacauugagacagaaccaccuuuuggugagagcuacaucgugguaggggcaggcgaaaaagcuuugaaacuaagcugguucaagagaggaagcagcauagggaaaauguucgaagcaaccgcccgaggagcacgaaggauggcuauccugggagacaccgcaugggacuucgguucuauaggaggaguguuuacaucugugggaaaauugguacaccagguuuuuggaaccgcauaugggguucuguuuagcgguguuucuuggaccaugaaaauaggaauagggauucugcugacaugguugggauuaaauucaaggagcacgucacuuucgaugacgugcauugcaguuggcauggucacacuguaccuaggagucaugguucaagcggauucgggauguguaaucaacuggaagggcagagaacuuaaauguggaaguggcauuuuugucacuaaugaaguccacacuuggacagagcaauacaaauuccaggcugacuccccaaaaagacugucagcagccauuggaaaggcaugggaggagggcguauguggaauucgaucagccacgcgucuugagaacaucauguggaagcaaauaucaaaugaauugaaccacauucuacuugagaaugacaugaaauucacagugguuguaggagaugccaacggaauuuuggcccaaggaaaaaaaaugauuaggccacaaccuauggaacacaaauacucauggaaaagcuggggaaaagcuaaaaucauaggagcagacauacaaaauaccaccuucaucaucgacggcccagacaccccagaaugucccgauggccaaagagcauggaacauuugggaaguugaggacuauggguuuggaguuuucacgacaaacauauggcugaaauugcgugacuccuacacccaaauaugugaccaccggcuaaugucagcugccaucaaggacagcaaggcaguccaugcugacaugggguacuggauagaaagugaaaagaaugaaaccuggaagcuggcgagagccuccuucauagaagucaagacaugcaccuggccgaaaucucacacucuauggagcaauggagucuuggaaagugaaaugauaaucccaaagauauuuggaggaccaauaucucagcacaacuacagaccaggguauuucacacaaacagcagggccauggcaccuagguaaguuggaacuggauuuugacuugugugaagguaccacaguuguuguggaugaacauuguggaaaucgagguccaucucucagaaccacaacagucacaggaaagauaauccaugaaugguguugcagauccugcacgcuaccccccuuacguuucagaggagaagacggguguugguauggcauggaaaucagaccaguaaaggagaaggaggagaaucuagucaggucaauggucucugcagggucaggagaaguggauaguuuuucauuaggaauacuaugcgugucaauaaugauugaagaagugaugagauccagauggaguagaaagaugcugaugauuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuccgcagacuaacauccagagaaguucuucuccucacgauuggauuaagcuugguggcauccguggagcuaccaaauucuuuggaggagcuaggggauggacuugcaauggguaucaugauguuaaaauuguugacugaauuucagccacaccaguuauggaccaccuuauugucucugacauuugucaaaacaacucucucacuggauuaugcauggaaaacaacggcuaugguacugucuaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaagcucacuccucaaaaaugaugugccguuggccgggccacuaauagcuggaggcaugcuaauagcauguuaugucauauccggaagcucagccgauuuaucauuggagaaagcggcugaaguauccugggaacaagaagcagaacacuccggugccucacacaacauauuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccagcccuccggaaguggaaagagcaguucuugaugauggcaucuauagaaucuugcaaagaggacuguuggggaggucccaaguaggagugggagucuuccaagacggcguguuccacacaauguggcacguuaccaggggagcuguccuuauguaccaagggaagagacuggaaccaagcugggccaguguaaaaaaggacuugaucucauauggaggagguuggagguuccaaggaucauggaacacaggagaagaagugcaggugauagcuguugaaccaggaaaaaaccccaaaaauguacagacaacgccgggcaccuucaagacuccugaaggcgaaguuggagccauagcucuagauuucaaacccggcacaucuggaucucccauugugaacagagaggaaaaaauagugggucuguauggaaauggaguggugacaacaaguggaaccuacgucagugccauugcccaagcuaaagcaucacaggaagggccucuaccagagauugaggacgagguguuuaagaaaagaaacuuaacaauaauggaccugcacccaggaucagggaaaacaagaagauaccuuccagccauaguccgugaggccauaaaaaggaaacugcguacguuaaucuuggcucccacaagaguugucgccucugaaauggcagaggcacucaagggaaugccaauaagauaucagacaacagcagugaagagugaacacacaggaagggagauaguugaccucaugugccacgcuacuuuuaccaugcgucucuuauccccagugagaguucccaauuacaacaugauuauuauggaugaagcacauuuuaccgauccagcuagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggauuacugacuuuccagguaaaacagucugguuuguuccaagcauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuucugaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccuuuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcgaccucgcugguuggacgccagaacauacucugauccauuggcccugcgcgaguuuaaagaguucgcagcaggaagaagaagugucucaggugaccuaauauuggaaauagggaaacuuccacaacauuugacgcuaagagcccagaaugcucuggacaacuuggucauguugcacaauuccgaacaaggaggaaaagccuacagacaugcuauggaggaacuaccagacaccauagaaacauugaugcuucuagcuuugauagcuguguugacugguggagugacgcuguucuuccuaucaggaaaaggucuagggaaaacauccauuggcuugcucugugugacggccucaagcgcacuguuauggauggccaguguggagccccauuggauagcggccuccaucauacuagaguucuuuuugauggugcugcucauuccagaaccagacagacagcgcacuccacaggacaaccagcuagcauauguggugauagguuuguuauucaugauacugacaguggcagccaaugagaugggauuauuggaaaccacaaagaaagaccuggggauuggcuauguagccgccgaaaaccaccaacaugcuacaaugcuggacguagaccuacacccagcuucagccuggacccucuaugcaguagccacaacaguuaucacucccaugaugagacacacaauugaaaauacaacggcaaacauuucccugacagccauugcaaaucaggcagccauauugaugggacuugacaagggauggccaauaucgaagauggacauaggaguuccacuucucgccuuagggugcuauucccaggugaacccauugacacugacagcggcgguguugauguuaguggcucauuaugcuauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacaauagcaguguccauggcaaacaucuucaggggaaguuaucuagcaggagcaggucuggcuuucucauuaaugaaaucuuuaggaggagguaggagagguacgggagcucaaggggaaacauugggagagaaauggaaaagacaguuaaaccaacugagcaagucagaauucaacaccuacaaaaggagugggauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaaguuacugaagugaagggauacacaaaaggaggaccuggacaugaggaaccuaucccaauggcgaccuauggauggaaccuaguaaagcuacacucuggaaaggauguauuuuuuaugccaccugagaaaugugacacccuucugugugacauuggugaguccucuccgaauccaacuauagaagaaggaagaacguuacguguucuaaaaaugguggaaccauggcucagaggaaaccaauucugcauaaaaaucuuaaauccuuacaugccaagugugguagaaacucuggagcaaaugcaaagaaaacauggagggaugcuagugcgaaacccacucucaagaaauucuacccaugaaauguauuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugacugauaccacacccuuuggacaacagagaguguuuaaagagaaaguugacacgcgcacaccaagagcaaaacgaggcacaacacagauuauggaggugacagccaagugguuaugggguuuccuuuccagaaacaaaaaacccagaaucugcacaagagaggaguucacaagaaagguuaggucaaacgcggcaauaggagcaguguucguugaugaaaaccaauggaacucagcaaaagaagcaguggaagacgaaagguuuugggaucuugugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaagcccuugguuucaugaaugaagaucacugguuuaguagagagaauucacucaguggaguggaaggagaaggacugcacaaacuuggauacauacucagagacauaucaaagauuccggggggaaauauguaugcagaugauacagccggaugggacacaagaauaacagaggaugaucuucagaaugaggcuaaaaucacugacaucauggagccugaacaugcucuauuggcuacgucaauuuuuaagcugacuuaucaaaacaagguggugagggugcaaagaccagcaaaaaauggaaccgugauggauguuauauccagacgugaucagagaggaaguggacaggucggaacuuaugguuuaaauacuuucaccaauauggagguccaacuaauaagacaaauggaaucugaaggaaucuuuuuacccagcgaauuggaaacccccaaccuagcugagagggcucuugacugguuagaaaaacauggcgccgaaaggcugaaacgaauggcaaucagcggagaugauugcguggugaaaccaauugacgacagguucgcaacagccuuaacagcucugaaugacaugggaaaaguaagaaaagacauaccgcagugggaaccuucgaaaggauggaaugauuggcagcaagugccuuuuuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuagcggcuaacgcuaucugcucagccgucccaguugauugggucccagccagccgcacaaccuggucaauccaugcccaccaccaauggaugacaacagaagacauguuaucaguguggaauagaguuuggauagaggaaaacccauggauggaggacaaaacucauguauccaguugggaagaaguuccauaccuaggaaaaagggaagaccaaugguguggaucccugauaggcuugacagcgagggccaccugggccaccaacauacaaguagccauaaaccaagugagaaggcucaucgggaaugagaauuacuuagauuacaugacaucaaugaagagauucaagaaugagagugaucccgaaggagcacucugguaa

SEQ ID NO: 6233 - RNA, 9879 nt, Artificial Sequence
  derived and/or modified CDS sequence (wt) from DENV-1__KC692504__SS-prME
uccgugaccaugcuccucaugcugcugcccacagcccuggcguuucauuugaccacacgagggggagagccacacaugauaguuaguaagcaggaaagaggaaagucacucuuguuuaagaccucugcgggcgucaauaugugcacccucauugcgauggacuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagagaaacguuccguggcacuggccccacacgugggacuuggucuagaaacaagaaccgaaacauggauguccucugaaggcgccuggagacaaauacaaagaguggaaacuugggcuuugagacacccaggauucacggugauagccuuuuuuuuagcgcaugcuauaggaacauccaucacucaaaaagggaucauuuucaucuugcugaugcuggugacaccaucaauggccaugcgaugcgugggaauaggcaacagagacuucguugaaggacugucaggagcaacguggguggacgugguauuggagcauggaagcugcgucaccaccauggcaaaaaauaaaccaacauuggacauugaacucuugaagacggaggucaugaacccugccgucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcugggguaauggcuguggacuauucggaaagggaagucuauugacgugugccaaguucaagugugugacaaaacuagagggaaagauaguucaauaugaaaacuuaaaauauucagugauagucacuguccacacuggggaccagcaccaggugggaaacgagaccacagaacauggaacaauugcaaccauaacaccucaagcucccacgucggaaauacagcugacugacuacggagcucucacauuggacugcucaccuagaacagggcuggacuuuaaugagauggugcuauugacaaugaaagaaaaaucauggcuuguccacaaacaaugguuucuagacuuaccacugccauggacuucgggggcuucaacaucucaagagaccuggaacagacaagauuugcuggucacauucaagacagcucaugcaaagaaacaggaaguagucguacugggaucacaggaaggagcaaugcacacagcguugacuggggcgacagaaauccagacgucaggaacgacaacaaucuucgcaggacaccugaaaugcagacuaaaaauggauaaacugaccuuaaaggggaugucauaugugaugugcacaggcucauuuaagcuagagaaggaaguggcugagacccagcauggaacuguccuagugcaggucaaauaugaaggaacagacgcgccaugcaagauccccuucucgacccaagaugagaaaggagugacccagaaugggagauugauaacagccaaucccauaguuacugacaaagaaaaaccagucaacauugagacagaaccaccuuuuggugagagcuacaucgugguaggggcaggcgaaaaagcuuugaaacuaagcugguucaagagaggaagcagcauagggaaaauguucgaagcaaccgcccgaggagcacgaaggauggcuauccugggagacaccgcaugggacuucgguucuauaggaggaguguuuacaucugugggaaaauugguacaccagguauuuggaaccgcauaugggguucuguuuagcgguguuucuuggaccaugaaaauaggaauagggauucugcugacaugguugggauuaaauucaaggagcacgucacuuucgaugacgugcauugcaguuggcauggucacacuguaccuaggagucaugguucaagcggauucgggauguguaaucaacuggaagggcagagaacuuaaauguggaaguggcauuuuugucacuaaugaaguccacacuuggacagagcaauacaaauuccaggcugacuccccaaaaagacugucagcagccauuggaaaggcaugggaggagggcguauguggaauucgaucagccacgcgucuugagaacaucauguggaagcaaauaucaaaugaauugaaccacauucuacuugagaaugacaugaaauucacagugguuguaggagaugccaacggaauuuuggcccaaggaaaaaaaaugauuaggccacaaccuauggaacacaaauacucauggaaaagcuggggaaaagcuaaaaucauaggagcagacauacaaaauaccaccuucaucaucgacggcccagacacuccagaaugucccgauggccaaagagcauggaacauuugggaaguugaggacuauggguuuggaguuuucacgacaaacauauggcugaaauugcgugauuccuacacccaaaugugugaccaccggcuaaugucagcugccaucaaggacagcaaggcaguccaugcugacaugggguacuggauagaaagugaaaagaaugaaaccuggaagcuggcgagagccuccuucauagaagucaagacaugcaccuggccgaaaucucacacucuauggagcaauggagucuuggaaagugaaaugauaaucccaaagauauuuggaggaccaauaucucagcacaacuacagaccaggguauuucacacaaacagcagggccauggcaccuagguaaguuggaacuggauuuugacuugugugaagguaccacaguuguuguggaugaacauuguggaaaucgagguccaucucucagaaccacaacagucacaggaaagauaauccaugaaugguguugcagauccugcacgcuacccccuuuacguuucagaggagaagacggguguugguauggcauggaaaucagaccaguaaaggagaaggaggagaaucuagucaggucaauggucucugcagggucaggagaaguggauaguuuuucauuaggaauacuaugcgugucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuccgcagacuaacauccagagaaguucuucuccucacgauuggauuaagccugguggcauccguggagcuaccaaauucuuuggaggagcuaggggauggacuugcaauggguaucaugauguuaaaauuguugacugaauuucagccacaccaguuauggaccaccuuauugucucugacauuugucaaaacaacucucucacuggauuaugcauggaaaacaacggcuaugguacugucuaucguaucucucuuucccuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaagcucacuccucaaaaaugaugugccguuggccgggccacuaauagcuggaggcaugcuaauagcauguuaugucauauccggaagcucagccgauuuaucauuggagaaagcggcugaaguauccugggaacaagaagcagaacacuccggugccucacacaacauauuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccagcccuccggaaguggaaagagcaguucuugaugauggcaucuauagaaucuugcaaagaggacuguuggggaggucccaaguaggagugggagucuuccaagacggcguguuccacacaauguggcacguuaccaggggagcuguccuuauguaccaagggaagagacuggaaccaagcugggccagugucaaaaaggacuugaucucauauggaggagguuggagguuccaaggaucauggaacacaggagaagaagugcaggugauagcuguugaaccaggaaaaaaccccaaaaauguacagacaacgccgggcaccuucaagaccccugaaggcgaaguuggagccauagcucuagauuucaaaccuggcacaucuggaucucccauugugaacagagagggaaaaauagugggucuguauggaaauggaguggugacaacaaguggaaccuacgucagugccauugcccaagcuaaagcaucacaggaagggccucuaccagagauugaggacgagguguuuaagaaaagaaacuuaacaauaauggaccugcacccaggaucagggaaaacaagaagauaucuuccagccauaguccgugaggccauaaaaaggaaacugcguacguuaaucuuggcucccacaagaguugucgccucugaaauggcagaggcacucaagggaaugccaauaagauaucagacaacagcagugaagagugaacacacaggaagggagauaguugaccucaugugccacgcuacuuuuaccaugcgucucuuauccccagugagaguucccaauuacaacaugauuauuauggaugaagcacauuuuaccgauccagcuagcauagcggccagaggguacaucucaacccgaguagguaugggugaagcagcugcgaucuuuaugacagccacucccccaggaucgguggaggccuuuccacagagcaaugcaguuauccaagaugaggaaagagacauuccugagagaucauggaacucaggcuacgacuggauuacugacuuuccagguaaaacagucugguuuguuccaagcauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuucugaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccuuuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcgaccucgcugguuggacgccagaacauacucugauccauuggcccugcgcgaguuuaaagaguucgcagcaggaagaagaagugucucaggugaccuaauauuggaaauagggaaacuuccacaacauuugacguuaagagcccagaaugcucuggacaacuuggucauguugcacaauuccgaacaaggaggaaaagccuacagacaugcuauggaggaacuaccagacaccauagaaacauugaugcuucuagcuuugauagcuguguugacugguggagugacgcuguucuuccuaucaggaaaaggucuagggaaaacauccauuggcuugcucugugugacggccucaagcgcacuguuauggauggccaguguggagccccauuggauagcggccuccaucauacuagaguucuuuuugauggugcugcucaucccagaaccagacagacagcgcacuccacaggacaaccagcuagcauauguggugauagguuuguuauucaugauacugacaguggcagccaaugagaugggauuauuggaaaccacaaagaaagaccuggggauuggcuauguagccgccgaaaaccaccaacaugcuacaaugcuggacguagaccuacacccagcuucagccuggacccucuaugcaguagccacaacaguuaucacucccaugaugagacacacaauugaaaauacaacggcaaacauuucccugacagccauugcaaaucaggcagccauauugaugggacuugacaagggauggccaauaucgaagauggacauaggaguuccacuucucgccuuagggugcuauucccaggugaacccauugacacugacagcagcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacaauagcaguguccauggcaaacgucuucaggggaaguuaucuagcaggagcaggucuggcuuucucauuaaugaaaucuuuaggaggagguaggagagguacgggagcucaaggggaaacauugggagagaaauggaaaagacaguuaaaccaacugagcaagucagaauucaacaccuacaaaaggagugggauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaaguuacugaagugaagggauacacaaaaggaggaccuggacaugaggaaccuaucccaauggcgaccuauggauggaaccuaguaaagcuacacucuggaaaggauguauuuuuuaugccaccugagaaaugugacacccuucugugugauauuggugaguccucuccgaauccaacuauagaagaaggaagaacguuacguguucuaaaaaugguggaaccauggcucagaggaaaccaauucugcauaaaaauccuaaauccuuacaugccaagugugguagaaacucuggagcaaaugcaaagaaaacauggagggaugcuagugcgaaacccacucucaagaaauucuacccaugaaauguauuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugacugauaccacacccuuuggacaacagagaguguuuaaagagaaaguugacacgcgcacaccaagagcaaaacgaggcacaacacagauuauggaggugacagccaagugguuaugggguuuccuuuccagaaacaaaaaacccagaaucugcacaagagaggaguucacaagaaagguuaggucaaacgcggcaauaggagcaguguucguugaugaaaaccaauggaacucagcaaaagaagcaguggaagacgaaagguuuugggaucuugugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaagcccuugguuucaugaaugaagaucacugguuuaguagagagaauucacucaguggaguggaaggagaaggacugcacaaacuuggauacauacucagagacauaucaaagauuccggggggaaauauguaugcagaugauacagccggaugggacacaagaauaacagaggaugaucuucagaaugaggcuaaaaucacugacaucauggagccugaacaugcucuauuggcuacgucaauuuuuaagcugacuuaucaaaacaagguggugagggugcaaagaccagcaaaaaauggaaccgugauggauguuauauccagacgugaucagagaggaaguggacaggucggaacuuauggcuuaaauacuuucaccaauauggagguccaacuaauaagacaaauggaaucugaaggaaucuuuuuacccagcgaauuggaaacccccaaccuagcugagagggcucuugacuggcuagaaaaacauggcgccgaaaggcugaaacgaauggcaaucagcggagaugauugcguggugaaaccaauugacgacagguucgcaacagccuuaacagcucugaaugacaugggaaaaguaagaaaagacauaccgcagugggaaccuucgaaaggauggaaugauuggcagcaagugccuuuuuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuagcggcuaacgcuaucugcucagccgucccaguugauugggucccagccagccgcacaaccuggucaauccaugcccaccaccaauggaugacaacagaagacauguuaucaguguggaauagaguuuggauagaggaaaacccauggauggaggacaaaacucauguauccaguugggaagaaguuccauaccuaggaaaaagggaagaccaaugguguggaucccugauaggcuugacagcgagggccaccugggccaccaacauacaaguagccauaaaccaagugagaaggcucaucgggaaugagaauuauuuagauuacaugacaucaaugaagagauucaagaaugagagugaucccgaaggagcacucugguaa

SEQ ID NO: 6234 - RNA, 9879 nt, Artificial Sequence
  derived and/or modified CDS sequence (wt) from DENV-1__KC692508__SS-prME
uccgugaccaugcuccucaugcugcugcccacagcccuggcguuucauuugaccacacgagggggagagccacacaugauaguuagcaagcaggaaagaggaaagucacucuuguuuaagaccucugcgggcgucaauaugugcacccucauugcgauggacuugggagaguuaugugaggacacaaugaccuacaaaugcccccggaucacugaggcggaaccagaugacguugacugcuggugcaaugccacagacacaugggugaccuaugggacguguucucaaaccggggaacaccgacgagagaaacguuccguggcacuggccccacacgugggacuuggucuagaaacaagaaccgaaacauggauguccucugaaggcgccuggaaacaaauacaaagaguggaaacuugggcuuugagacacccaggauucacggugauagccuuuuuuuuagcgcaugcuauaggaacauccaucacucaaaaagggaucauuuucaucuugcugaugcuggugacaccaucaauggccaugcgaugcgugggaauaggcaacagagacuucguugaaggacugucaggagcaacguggguggacgugguauuggagcauggaagcugcgucaccaccauggcaaaaaauaaaccaacauuggacauugaacucuugaagacggaggucacgaacccugccgucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcugggguaauggcuguggacuauucggaaagggaagucuauugacgugugccaaguucaagugugugacaaaacuagagggaaagauaguucaauaugaaaacuuaaaauauucagugauagucacuguccacacuggggaccagcaccaggugggaaacgagaccacagaacauggaacaauugcaaccauaacaccucaagcucccacgucggaaauacagcugacugacuacggagcccucacauuggacugcucaccuagaacagggcuggacuuuaaugagauggugcuauugacaaugaaagaaaaaucauggcuuguccacaaacaaugguuucuagacuuaccacugccauggacuucgggggcuucaacaucucaagagaccuggaacagacaagauuugcuggucacauucaagacagcucaugcaaagaaacaggaaguagucguacugggaucacaggaaggagcaaugcacacagcguugacuggggcgacagaaauccagacgucaggaacgacaacaaucuucgcaggacaccugaaaugcagacuaaaaauggauaaacugaccuuaaaggggaugucauaugugaugugcacaggcucauuuaagcuagagaaggaaguggcugagacccagcauggaacuguccuagugcaggucaaauaugaaggaacagacgcgccaugcaagauccccuucucgacccaagaugagaaaggagugacccagaaugggagauugauaacagccaaucccauaguuacugacaaagaaaaaccagucaacauugagacagaaccaccuuuuggugagagcuacaucgugguaggggcaggcgaaaaagcuuugaaacuaagcugguucaagagaggaagcagcauagggaaaauguucgaagcaaccgcccgaggagcacgaaggauggcuauccugggagacaccgcaugggacuucgguucuauaggaggaguguuuacaucugugggaaaauugguacaccagguuuuuggaaccgcauaugggguucuguuuagcgguguuucuuggaccaugaaaauaggaauagggauucugcugacaugguugggauuaaauucaaggagcacgucacuuucgaugacgugcauugcaguuggcauggucacacuguaccuaggagucaugguucaagcggauucgggauguguaaucaacuggaagggcagagaacuuaaauguggaaguggcauuuuugucacuaaugaaguccacacuuggacagagcaauacaaauuccaggcugacuccccaaaaagacugucagcagccauuggaaaggcaugggaggagggcguauguggaauucgaucagccacgcgucuugagaacaucauguggaagcaaauaucaaaugaauugaaccacauucuacuugagaaugacaugaaauucacagugguuguaggagaugccaacggaauuuuggcccaagggaaaaaaaugauuaggccacaaccuauggaacacaaauauucauggaaaagcuggggaaaagcuaaaaucauaggagcagacauacaaaauaccaccuucaucaucgacggcccagacacuccagaaugucccgauggccaaagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaaugaaaccuggaagcuggcgagagccuccuucauagaagucaagacaugcaccuggccgaaaucucacacucuauggagcaauggagucuuggaaagugaaaugauaaucccaaagauauuuggaggaccaauaucucagcacaacuacagaccaggguauuucacacaaacagcagggccauggcaccuagguaaguuggaacuggauuuugacuugugugaagguaccacaguuguuguggaugaacauuguggaaaucgagguccaucucucagaaccacaacagucacaggaaagauaauccaugaaugguguugcagauccuguacgcuaccccccuuacguuucagaggagaagacggguguugguauggcauggaaaucagaccaguaaaggagaaggaggagaaucuagucaggucaauggucucugcagggucaggagaaguggauaguuuuucauuaggaauacuaugcgugucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagcccugauggcuacuuucaaaaugagaccaauguucgcuguugggcuauuauuccgcagacuaacauccagagaaguucuucuccucacgauuggauuaagccugguggcauccguggagcuaccaaauucuuuggaggagcuaggggauggacuugcaauggguaucaugauguuaaaauuguugacugaauuucagccacaccaguuauggaccaccuuauugucucugacauuugucaaaacaacucucucacuggauuaugcauggaaaacaacggcuaugguacugucuaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaagcucacuccucaaaaaugaugugccguuggccgggccacuaauagcuggaggcaugcuaauagcauguuaugucauauccggaagcucagccgauuuaucauuggagaaagcggcugaaguauccugggaacaagaagcagaacacuccggugccucacacaacauauuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccagcccuccggaaguggaaagagcaguucuugaugauggcaucuauagaauccugcaaagaggacuguuggggaggucccaaguaggagugggagucuuccaagacggcguguuccacacaauguggcacguuaccaggggagcuguccuuauguaccaagggaagagacuggaaccaagcugggccagugucaaaaaggacuugaucucauauggaggagguuggagguuccaaggaucauggaacacaggagaagaagugcaggugauagcuguugaaccaggaaaaaaccccaaaaauguacagacaacgccgggcaccuucaagacuccugaaggcgaaguuggagccauagcucuagauuucaaacccggcacaucuggaucucccauugugaacagagagggaaaaauagugggucuguauggaaauggaguggugacaacaaguggaaccuacgucagugccauugcccaagcuaaagcaucacaggaagggccucuaccagagauugaggacgagguguuuaagaaaagaaacuuaacaauaauggaccugcacccaggaucagggaaaacaagaagauaucuuccagccauaguccgugaggccauaaaaaggaaacugcguacguuaaucuuggcucccacaagaguugucgccucugaaauggcagaggcacucaagggaaugccaauaagauaucagacaacagcagugaagagugaacacacaggaagggagauaguugaccucaugugccacgcuacuuuuaccaugcgucucuuauccccagugagaguucccaauuacaacaugauuauuauggaugaagcacauuuuaccgauccagcuagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggauuacugacuuuccagguaaaacagucugguuuguuccaagcauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuucugaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguaugucuacaugggacagccuuuaaauaaugaugaggaacacgcucauuggacagaagcaaaaaugcuccuugacaacauaaacacaccagaagggaucaucccagcccuuuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcgaccucgcugguuggacgccagaacauacucugauccauuggcccugcgcgaguuuaaagaguucgcagcaggaagaagaagugucucaggugaccuaauauuggaaauagggaaacuuccacaacauuugacgcuaagagcccagaaugcucuggacaacuuggucauguugcacaauuccgaacaaggaggaaaagccuacagacaugcuauggaggaacuaccagacaccauagaaacauugaugcuucuagcuuugauagcuguguugacugguggagugacgcuguucuuccuaucaggaaaaggucuagggaaaacauccauuggcuugcucugugugacggccucaagcgcacuguuauggauggccaguguggagccccauuggauagcggccuccaucauacuagaguucuuuuugauggugcugcucauuccagaaccagacagacagcgcacuccacaggacaaccagcuagcauauguggugauagguuuguuauucaugauacugacaguggcagccaaugagaugggauuauuggaaaccacaaagaaagaccuggggauuggcuauguagccgccgaaaaccaccaacaugcuacaaugcuggacguagaccuacacccagcuucagccuggacccucuaugcaguagccacaacaguuaucacucccaugaugagacacacaauugaaaauacaacggcaaacauuucccugacagccauugcaaaucaggcagccauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacaauagcaguguccauggcaaacaucuucaggggaaguuaucuagcaggagcaggucuggcuuucucauuaaugaaaucuuuaggaggagguaggagagguacgggagcucaaggggaaacauugggagagaaauggaaaagacaguuaaaccaacugagcaagucagaauucaacaccuacaaaaggagugggauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaaguuacugaagugaagggauacacaaaaggaggaccuggacaugaggaaccuaucccaauggcgaccuauggauggaaccuaguaaagcuacacucuggaaaggauguauuuuuuaugccaccugaaaaaugugacacccuucugugugauauuggugaguccucuccgaauccaacuauagaagaaggaagaacguuacguguucuaaaaaugguggaaccauggcucagaggaaaccaauucugcauaaaaauccuaaauccuuacaugccaagugugguagaaacucuggagcaaaugcaaagaaaacauggagggaugcuagugcgaaacccacucucaagaaauucuacccaugaaauguauuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugacugauaccacacccuuuggacaacagagaguguuuaaagagaaaguugacacgcgcacaccaagagcaaaacgaggcacaacacagauuauggaggugacagccaagugguuauggaguuuccuuuccagaaacaaaaaacccagaaucugcacaagagaggaguuuacaagaaagguucggucaaacgcggcaauaggagcaguguucguugaugaaaaccaauggaacucagcaaaagaagcaguggaagacgaaagguuuugggaucuugugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaagcccuugguuucaugaaugaagaucacugguuuaguagagagaauucacucaguggaguggaaggagaaggacugcacaaacuuggauacauacucagagacauaucaaagauuccggggggaaauauguaugcagaugauacagccggaugggacacaagaauaacagaggaugaucuucagaacgaggcuaaaaucacugacaucauggagccugaacaugcucuauuggcuacgucaauuuuuaagcugacuuaucaaaacaagguggugagggugcaaagaccagcaaaaaauggaaccgugauggauguuauauccagacgugaccagagaggaaguggacaggucggaacuuauggcuuaaauacuuucaccaauauggagguccaacuaauaagacaaauggaaucugaaggaaucuuuuuacccagcgaauuggaaacccccaaccuagcugagagggcucuugacugguuagaaaaacauggcgccgaaaggcugaaacgaauggcaaucagcggagaugauugcguggugaaaccaauugacgacagguucgcaacagccuuaacagcucugaaugacaugggaaaaguaagaaaagacauaccgcagugggaaccuucgaaaggauggaaugauuggcagcaagugccuuuuuguucacaccauuuccaccagcugaucaugaaggaugggagggaaauaguggugccaugccgcaaccaagaugaacucgugggcagggcuagaguaucacaaggcgccggauggagccugagagaaacugcuugccuaggcaagucauaugcacaaauguggcagcugauguacuuccacaggagagaccugagacuagcggcuaacgcuaucugcucagccgucccaguugauugggucccagccagccgcacaaccuggucaauccaugcccaccaccaauggaugacaacagaagacauguuaucaguguggaauagaguuuggauagaggaaaacccauggauggaggacaaaacucauguauccaguugggaagaaguuccauaccuaggaaaaagggaagaccaaugguguggaucccugauaggcuugacagcgagggccaccugggccaccaacauacaaguagccauaaaccaagugagaaggcucaucgggaaugagaauuauuuagauuacaugacaucaaugaagagauucaagaaugagagugaucccgaaggagcacucugguaa

SEQ ID NO: 6235 - RNA, 9879 nt, Artificial Sequence
  derived and/or modified CDS sequence (wt) from DENV-1__KC692509__SS-prME
uccgugaccaugcuccucaugcugcugcccacagcccuggcguuucauuugaccacacgagggggagagccacacaugauaguuaguaagcaggaaagaggaaagucacuccuguuuaagaccucugcgggcgucaauaugugcacccucauugcgauggacuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagagaaacguuccguggcacuggccccacacgugggacuuggucuagaaacaagaaccgaaacauggauguccucugaaggcgccuggaaacaaauacaaagaguggaaacuugggcuuugagacacccaggauucacggugauagccuuuuuuuuagcgcaugcuauaggaacauccaucacccaaaaagggaucauuuucaucuugcugaugcuggugacaccaucaauggccaugcgaugcgugggaauaggcaacagagacuucguugaaggacugucaggagcaacguggguggacgugguauuggagcauggaagcugcgucaccaccauggcaaaaaauaaaccaacauuggacauugaacucuugaagacggaggucacgaacccugccgucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcugggguaauggcuguggacuauucggaaagggaagucuguugacgugugccaaguucaagugugugacaaaacuagagggaaagauaguucaauaugaaaacuuaaaauauucagugauagucacuguccacacuggggaccagcaccaggugggaaacgagaccacagaacauggaacaauugcaaccauaacaccucaagcucccacgucggaaauacagcugacugacuacggagcccucacauuggacugcucaccuagaacagggcuggacuuuaaugagauggugcuauugacaaugaaagaaaaaucauggcuuguccacaaacaaugguuucuagacuuaccacugccauggacuucgggggcuucaacaucucaagagaccuggaacagacaagauuugcuggucacauucaagacagcucaugcaaagaaacaggaaguagucguacugggaucacaggaaggagcaaugcacacagcguugacuggggcgacagaaauccagacgucaggaacgacaacaaucuucgcaggacaccugaaaugcagacuaaaaauggauaaacugaccuuaaagggggugucauaugugaugugcacaggcucauuuaagcuagagaaggaaguggcugagacccagcauggaacuguccuagugcaggucaaauaugaaggaacagacgcgccaugcaagauccccuucucgacccaagaugagaaaggagugacccagaaugggagauugauaacagccaaucccauaguuacugacaaagaaaaaccagucaacauugagacagaaccaccuuuuggugagagcuacaucgugguaggggcaggcgaaaaagcuuugaaacuaagcugguucaagagaggaagcagcauagggaaaauguucgaagcaaccgcccgaggagcacgaaggauggcuauccugggagacaccgcaugggacuucgguucuauaggaggaguguuuacaucugugggaaaauugguacaccagguuuuuggaaccgcauaugggguucuguuuagcgguguuucuuggaccaugaaaauaggaauagggauucugcugacaugguugggauuaaauucaaggagcacgucacuuucgaugacgugcauugcaguuggcauggucacacuguaccuaggagucaugguucaagcggauucgggauguguaaucaacuggaagggcagagaacuuaaauguggaaguggcauuuuugucacuaaugaaguccacacuuggacagagcaauacaaauuccaggcugacuccccaaaaagacugucagcagccauuggaaaggcaugggaggagggcguauguggaauucgaucagccacgcgucuugagaacaucauguggaagcaaauaucaaaugaauugaaccacauucuacuugagaaugacaugaaauucacagugguuguaggagaugccaacggaauuuuggcccaaggaaaaaaaaugauuaggccacaaccuauggaacacaaauacucauggaaaagcuggggaaaagcuaaaaucauaggagcagacauacaaaauaccaccuucaucaucgacggcccagacaccccagaaugucccgauggccaaagagcauggaacauuugggaaguugaggacuauggguuuggaguuuucacgacaaacauaugguugaaauugcgugacuccuacacccaaaugugugaccaccggcuaaugucagcugccaucaaggacagcaaggcaguccaugcugacaugggguacuggauagaaagugaaaagaaugaaaccuggaagcuggcgagagccuccuucauagaagucaagacaugcaccuggccgaaaucucacacucuauggagcaauggagucuuggaaagugaaaugauaaucccaaagauauuuggaggaccaauaucucagcacaacuacagaccaggguauuucacacaaacagcagggccauggcaccuagguaaguuggaacuggauuuugacuugugugaagguaccacaguuguuguggaugaacauuguggaaaucgagguccaucucucagaaccacaacagucacaggaaagauaauccaugaaugguguugcagauccugcacgcuaccccccuuacguuucagaggagaagacggguguugguauggcauggaaaucagaccaguaaaggagaaggaggagaaucuagucaggucaauggucucugcagggucaggagaaguggauaguuuuucauuaggaauacuaugcgugucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuccgcagacuaacauccagagaaguucuucuccucacgauuggguuaagccugguggcauccguggagcuaccaaauucuuuggaggagcuaggggauggacuugcaauggguaucaugauguuaaaauuguugacugaauuucagccacaccaguuauggaccaccuuauugucucugacauuugucagaacaacucucucacuggauuaugcauggaaaacaacggcuaugguacugucuaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaagcucacuccucaaaaaugaugugccguuggccgggccacuaauagcuggaggcaugcuaauagcauguuaugucauauccggaagcucagccgauuuaucauuggagaaagcggcugaaguauccugggaacaagaagcagaacacuccggugccucacacaacauauuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccagcccuccggaaauggaaagagcaguucuugaugauggcaucuauagaaucuugcaaagaggacuguuggggaggucccaaguaggagugggagucuuccaagacggcguguuccacacaauguggcacguuaccaggggagcuguccuuauguaccaagggaagagacuggaaccaagcugggccagugucaaaaaggacuugaucucauauggaggagguuggagguuccaaggaucauggaacacaggagaagaagugcaggugauagcuguugaaccaggaaaaaaccccaaaaauguacagacaacgccgggcaccuucaagacuccugaaggcgaaguuggagccauagcucuagauuucaaacccggcacaucuggaucucccauugugaacagagagggaaaaauagugggucuguauggaaauggaguggugacaacaaguggaaccuacgucagugccauugcccaagcuaaagcaucacaggaagggccucuaccagagauugaggacgagguguuuaagaaaagaaacuuaacaauaauggaccugcacccaggaucagggaaaacaagaagauaucuuccagccauaguccgugaggccauaaaaagaaaacugcguacguuaaucuuggcucccacaagaguuguugccucugaaauggcagaggcacucaagggaaugccaauaagauaucagacaacagcagugaagagugaacacacaggaagggagauaguugaccucaugugccacgcuacuuuuaccaugcgucucuuauccccagugagaguucccaauuacaacaugauuauuauggaugaagcacauuuuaccgauccagcuagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggauuacugacuuuccagguaaaacagucugguuuguuccaagcauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuucugaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccuuuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcgaccucgcugguuggacgccagaacauacucugauccauuggcccugcgcgaguuuaaagaguucgcagcaggaagaagaagugucucaggugaccuaauauuggaaauagggaaacuuccacaacauuugacgcuaagagcccagaaugcucuggacaacuuggucauguugcacaauuccgaacaaggaggaaaagccuacagacaugcuauggaggaacuaccagacaccauagaaacauugaugcuucuagcuuugauagcuguguugacugguggagugacgcuguucuuccuaucaggaaaaggucuagggaaaacauccauuggcuugcucugugugacggccucaagcgcacuguuauggauggccaguguggagccccauuggauagcggccuccaucauacuagaguucuuuuugauggugcugcucauuccagaaccagacagacagcgcacuccacaggacaaccagcuagcauauguggugauagguuuguuauucaugauacugacaguggcagccaaugagaugggauuauuggaaaccacaaagaaagaccuggggauuggcuauguagccgccgaaaaccaccaacaugcuacaaugcuggacguagaccuacacccagcuucagccuggacccucuaugcaguagccacaacaguuaucacucccaugaugagacacacaauugaaaauacaacggcaaacauuucccugacagccauugcaaaucaggcagccauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacaauagcaguguccauggcaaacaucuucaggggaaguuaucuagcaggagcaggucuggcuuucucauuaaugaaaucuuuaggaggagguaggagagguacgggagcucaaggggaaacauugggagagaaauggaaaagacaguuaaaccaacugagcaagucagaauucaacaccuacaaaaggagugggauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaaguuacugaagugaagggauacacaaaaggaggaccuggacaugaggaaccuaucccaauggcgaccuauggauggaaccuaguaaagcuacacucuggaaaggauguauuuuuuaugccaccugagaaaugugacacccuucugugugauauuggugaguccucuccgaauccaacuauagaagaaggaagaacguuacguguucuaaaaaugguggaaccauggcucagaggaaaccaauucugcauaaaaauccuaaauccuuacaugccaagugugguagaaacucuggagcaaaugcaaagaaaacauggagggaugcuagugcgaaacccacucucaagaaauucuacccaugaaauguauuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugacugauaccacacccuuuggacaacagagaguguuuaaagagaaaguugacacgcgcacaccaagagcaaaacgaggcacaacacagauuauggaggugacagccaagugguuaugggguuuccuuuccagaaacaaaaaacccagaaucugcacaagagaggaguucacaagaaagguuaggucaaacgcggcaauaggagcaguguucguugaugaaaaccaauggaacucagcaaaagaagcaguggaagacgaaagguuuugggaucuugugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaagcccuugguuucaugaaugaagaucacugguuuaguagagagaauucacucaguggaguggaaggagaaggacugcacaaacuuggauacauacucagagacauaucaaagauuccggggggaaauauguaugcagaugauacagccggaugggacacaagaauaacagaggaugaucuucagaaugaggcuaaaaucacugacaucauggagccugaacaugcucuauuggcuacgucaauuuuuaagcugacuuaucaaaacaagguggugagggugcaaagaccagcaaaaaauggaaccgugauggauguuauauccagacgugaucagagaggaaguggacaggucggaacuuauggcuuaaauacuuucaccaauauggagguccaacuaauaagacaaauggaaucugaaggaaucuuuuuacccagcgaauuggaaacccccaaccuagcugagagggcucuugacugguuagaaaaacauggcgccgaaaggcugaaacgaauggcaaucagcggagaugauugcguggugaaaccaauugacgacagguucgcaacagccuuaacagcuuugaaugacaugggaaaaguaagaaaagacauaccgcagugggaaccuucgaaaggauggaaugauuggcagcaagugccuuuuuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuagcggcuaacgcuaucugcucagccgucccaguugauugggucccagccagccgcacaaccuggucaauccaugcccaccaccaauggaugacaacagaagacauguuaucaguguggaauagaguuuggauagaggaaaacccauggauggaggacaaaacucauguauccaguugggaagaaguuccauaccuaggaaaaagggaagaccaaugguguggaucccugauaggcuugacagcgagggccaccugggccaccaacauacaaguagccauaagccaagugagaaggcucaucgggaaugagaauuauuuagauuacaugacaucaaugaagagauucaagaaugagagugaucccgaaggagcacucugguaa

SEQ ID NO: 6236 - RNA, 9879 nt, Artificial Sequence
  derived and/or modified CDS sequence (wt) from DENV-1__KC692510__SS-prME
uccgugaccaugcuccucaugcugcugcccacagcccuggcguuucauuugaccacacgagggggagagccacacaugauaguuaguaagcaggaaagaggaaagucacucuuguuuaagaccucugcgggcgucaauaugugcacccucauugcgauggacuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagagaaacguuccguggcacuggccccacacgugggacuuggucuagaaacaagaaccgaaacauggauguccucugaaggcgccuggagacaaauacaaagaguggaaacuugggcuuugagacacccaggauucacggugauagccuuuuuuuuagcgcaugcuauaggaacauccaucacucaaaaagggaucauuuucaucuugcugaugcuggugacaccaucaauggccaugcgaugcgugggaauaggcaacagagacuucguugaaggacugucaggagcaacguggguggacgugguauuggagcauggaagcugcgucaccaccauggcaaaaaauaaaccaacauuggacauugaacucuuaaagacggaggucacgaacccugccgucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcugggguaauggcuguggacuauucggaaagggaagucuauugacgugugccaaguucaagugugugacaaaacuagagggaaagauaguucaauaugaaaacuuaaaauauucagugauagucacuguccacacuggggaccagcaccaggugggaaacgagaccacagaacauggaacaauugcaaccauaacaccucaagcucccacgucggaaauacagcugacugacuacggagcccucacauuggacugcucaccuagaacagggcuggacuuuaaugagauggugcuauugacaaugaaagaaaaaucauggcuuguccacaaacaaugguuucuagacuuaccacugccauggacuucgggggcuucaacaucucaagagaccuggaacagacaagauuugcuggucacauucaagacagcucaugcaaagaaacaggaaguagucguacugggaucacaggaaggagcaaugcacacagcguugacuggggcgacagaaauccagacgucaggaacgacaacaaucuucgcaggacaccugaaaugcagacuaaaaauggauaaacugaccuuaaaggggaugucauaugugaugugcacaggcucauuuaagcuagagaaggaaguggcugagacccagcauggaacuguccuagugcaggucaaauaugaaggaacagacgcgccaugcaagauccccuucucgacccaagaugagaaaggagugacccagaaugggagauugauaacagccaaucccauaguuacugacaaagaaaaaccagucaacauugagacagaaccaccuuuuggugagagcuacaucgugguaggggcaggcgaaaaagcuuugaaacuaagcugguucaagagaggaagcagcauagggaaaauguucgaagcaaccgcccgaggagcacgaaggauggcuauccugggagacaccgcaugggacuucgguucuauaggaggaguguuuacaucugugggaaaauugguacaccagguuuuuggaaccgcauaugggguucuguuuagcgguguuucuuggaccaugaaaauaggaauagggauucugcugacaugguugggauuaaauucaaggagcacgucacuuucgaugacgugcauugcaguuggcauggucacacuguaccuaggagucaugguucaagcggauucgggauguguaaucaacuggaagggcagagaacuuaaauguggaaguggcauuuuugucacuaaugaaguccacacuuggacagagcaauacaaauuccaggcugacuccccaaaaagacugucagcagccauuggaaaggcaugggaggagggcguauguggaauucgaucagccacgcgucuugagaacaucauguggaagcaaauaucaaaugaauugaaccacauucuacuugagaaugacaugaaauucacagugguuguaggagaugccaacggaauuuuggcccaaggaaaaaaaaugauuaggccacaaccuauggaacacaaauacucauggaaaagcuggggaaaagcuaaaaucauaggagcagacauacaaaauaccaccuucaucaucgacggcccagacacuccagaaugucccgauggccaaagagcauggaacauuugggaaguugaggacuauggguuuggaguuuucacgacaaacauaugguugaaauugcgugacuccuacacccaaaugugugaccaccggcuaaugucagcugccaucaaggacagcaaggcaguccaugcugacaugggguacuggauagaaagugaaaagaaugaaaccuggaagcuggcgagagccuccuucauagaagucaagacaugcaccuggccgaaaucucacacucuauggagcaauggagucuuggaaagugaaaugauaaucccaaagauauuuggaggaccaauaucucagcacaacuacagaccaggguauuucacacaaacagcagggccauggcaccuagguaaguuggaacuggauuuugacuugugugaagguaccacaguuguuguggaugaacauuguggaaaucgagguccaucucucagaaccacaacagucacaggaaagauaauccaugaaugguguugcagauccugcacgcuaccacccuuacguuucagaggagaagacggguguugguauggcauggaaaucagaccaguaaaggagaaggaggagaaucuagucaggucaauggucucugcagggucaggagaaguggauaguuuuucauuaggaauacuaugcgugucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucugacaggauggggaugggaacaacguaccuagccuugauggcuacuuuuaaaaugagaccaauguucgcuguugggcuauuauuccgcagacuaacauccagagaaguucuucuccucacgauuggauuaagccugguggcauccguggagcuaccaaauucuuuggaggagcuaggggauggacuugcaauggguaucaugauguuaaaauuguugacugaauuucagccacaccaguuauggaccaccuuauugucucugacauuugucaaaacaacucucucacuggauuaugcauggaaaacaacggcuaugguacugucuaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaagaaaaaguuggccccucaaugaaggaauuauggcuauuggaauagucagcauucuacuaagcucacuccucaaaaaugaugugccguuggccgggccacuaauagcaggaggcaugcuaauagcauguuaugucauauccggaagcucagccgauuuaucauuggagaaagcggcugaaguauccugggaacaagaagcagaacacuccggugccucacacaacauauuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccagcccuccggaaguggaaagagcaguucuugaugauggcaucuauagaaucuugcaaagaggacuguuggggaggucccaaguaggagugggagucuuccaagacggcguguuccacacaauguggcacguuaccaggggagcuguccuuauguaccaagggaagagacuggaaccaagcugggccagugucaaaaaggacuugaucucauauggaggagguuggagguuccaaggaucauggaacacaggagaagaagugcaggugauagcuguugaaccaggaaaaaaccccaaaaauguacagacaacgccgggcaccuucaagacuccugaaggcgaaguuggagccauagcucuagauuucaaacccggcacaucuggaucucccauugugaacagagagggaaaaauagugggucuguauggaaauggaguggugacaacaaguggaaccuacgucagugccauugcccaagcuaaagcaucacaggaagggccucuaccagagauugaggacgagguguuuaagaaaagaaacuuaacaauaauggaccugcacccaggaucagggaaaacaagaagauaccuuccagccauaguccgugaggccauaaaaaggaaacugcguacguuaaucuuggcucccacaagaguugucgccucugaaauggcagaggcacucaagggaaugccaauaagauaucagacaacagcagugaagagugaacacacaggaagggagauaguugaccucaugugccacgcuacuuuuaccaugcgucucuuauccccagugagaguucccaauuacaacaugauuauuauggaugaagcacauuuuaccgauccagcuagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggauuacugacuuuccagguaaaacagucugguuuguuccaagcauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuucugaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccuuuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcgaccucgcugguuggacgccagaacauacucugauccauuggcccugcgcgaguuuaaagaguucgcagcaggaagaagaagugucucaggugaccuaauauuggaaauagggaaacuuccacaacauuugacgcuaagagcccagaaugcucuggacaacuuggucauguugcacaauuccgaacaaggaggaaaagccuacagacaugcuauggaggaacuaccagacaccauagaaacauugaugcuucuagcuuugauagcuguguugacugguggagugacgcuguucuuccuaucaggaaaaggucuagggaaaacauccauuggcuugcucugugugacggccucaagcgcacuguuauggauggccaguguggagccccauuggauagcggccuccaucauacuagaguucuuuuugauggugcugcucauuccagaaccagacagacagcgcacuccacaggacaaccagcuagcauauguggugauagguuuguuauucaugauacugacaguggcagccaaugagaugggauuauuggaaaccacaaagaaagaccuggggauuggcuauguagccgccgaaaaccaccaacaugcuacaaugcuggacguagaccuacacccagcuucagccuggacccucuaugcaguagccacaacaguuaucacucccaugaugagacacacaauugaaaauacaacggcaaacauuucccugacagccauugcaaaucaggcagccauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacaauagcaguguccauggcaaacaucuucaggggaaguuaucuagcaggagcaggucuggcuuucucauuaaugaaaucuuuaggaggagguaggagagguacgggagcucaaggggaaacauugggagagaaauggaaaagacaguuaaaccaacugagcaagucagaauucaacaccuacaaaaggagugggauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaaguuacugaagugaagggauacacaaaaggaggaccuggacaugaggaaccuaucccaauggcgaccuauggauggaaccuaguaaagcuacacucuggaaaggauguauuuuuuaugccaccugagaaaugugacacccuucugugugauauuggugaguccucuccgaauccaacuauagaagaaggaagaacguuacguguucuaaaaaugguggaaccauggcucagaggaaaccaauucugcauaaaaauccuaaauccuuacaugccaagugugguagaaacucuggagcaaaugcaaagaaaacauggagggaugcuagugcgaaacccacucucaagaaauucuacccaugaaauguauuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguagccaaccuagauaucauuggccagaggauagagaauauaaaaaacgaacacaagucaacauggcauuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugacugauaccacacccuuuggacaacagagaguguuuaaagagaaaguugacacgcgcacaccaagagcaaaacgaggcacaacacagauuauggaggugacagccaagugguuaugggguuuccuuuccagaaacaaaaaacccagaaucugcacaagagaggaguucacaagaaagguuaggucaaacgcggcaauaggagcaguguucguugaugaaaaccaauggaacucagcaaaagaagcaguggaagacgaaagguuuugggaucuugugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaagcccuugguuucaugaaugaagaucacugguuuaguagagagaauucacucaguggaguggaaggagaaggacugcacaaacuuggauacauacucagagacauaucaaagauuccggggggaaauauguaugcagaugauacagccggaugggacacaagaauaacagaggaugaucuucagaaugaggcuaaaaucacugacaucauggagccugaacaugcucuauuggcuacgucaauuuuuaagcugacuuaucaaaacaagguggugagggugcaaagaccagcaaaaaauggaaccgugauggauguuauauccagacgugaucagagaggaaguggacaggucggaacuuauggcuuaaauacuuucaccaauauggagguccaacuaauaagacaaauggaaucugaaggaaucuuuuuacccagcgaauuggaaacccccaaccuagcugagagggcucuugacugguuagaaaaacauggcgccgaaaggcugaaacgaauggcaaucagcggagaugauugcguggugaaaccaauugacgacagguucgcaacagccuuaacagcucugaaugacaugggaaaaguaagaaaagacauaccgcagugggaaccuucgaaaggauggaaugauuggcagcaagugccuuuuuguucacaccauuuccaccagcugaucaugaaggaugggagggaaauaguggugccaugccgcaaccaagaugaacuugugggcagggcuagaguaucacaaggcgccggauggagucugagagaaacugcuugccuaggcaagucauaugcacaaauguggcagcugauguacuuccacaggagagaccugagacuagcggcuaacgcuaucugcucagccgucccaguugauugggucccagccagccgcacaaccuggucaauccaugcccaccaccaauggaugacaacagaagacauguuaucaguguggaauagaguuuggauagaggaaaacccauggauggaggacaaaacucauguauccaguugggaagaaguuccauaccuaggaaaaagggaagaccaaugguguggaucccugauaggcuugacagcgagggccaccugggccaccaacauacaaguagccauaaaccaagugagaaggcucaucgggaaugagaauuauuuagauuacaugacaucaaugaagagauucaagaaugagagugaucccgaaggagcacucugguaa

SEQ ID NO: 6237 - RNA, 9879 nt, Artificial Sequence
  derived and/or modified CDS sequence (wt) from DENV-1__KC692511__SS-prME
uccgugaccaugcuccucaugcugcugcccacagcccuggccuuccauuugacuacacgagggggagagccacacaugauagucagcaagcaggaaagaggaaagucacucuuguuuaagaccucuguaggugucaacaugugcacucucauugcgauggauuugggagaguuaugugaggacacaaugaccuacaaaugcccccggaucacugaggcggaaccagacgauguugacugcuggugcaaugccacagacacaugggugaccuaugggacguguucucaaaccggcgaacaccgacgagacaaacguuccgucgcauuggccccacacgugggacuuggucuagaaacaagaacagaaacguggaugucaucugaaggcgccuggaaacaaauacaaaaaguggagaauugggcuuugcgacacccaggauucacggugauagcccuuuucuuggcacaugccauaggaacauccaucacccagaaagggaucauuuucauuuugcugaugcugguaacaccaucaauggccaugcgaugcgugggaauaggcaauagagacuucguugaaggacugucaggagcaacguggguggacgugguacuggagcauggaagcugcgucaccaccauggcaaaaaauaaaccaacauuggacauugaacucuugaaaacggaggucacgaacccugccguccugcgcaaacugugcauugaagcuaaaauaucaaacaccaccaccgauucaagauguccaacacaaggagaagcuacacugguggaagaacaagacgcgaacuuugugugucgacggacguucguggacagaggcugggguaauggcugcggacuauuuggaaaaggaagucuacugacgugugcuaaguucaagugugugacaaaacuagaaggaaagauaguucaauaugaaaacuuaaaauauucagugauagucacuguccacacuggggaccagcaccagguaggaaacgagacuacagaacauggaacaauugcaaccauaacaccucaagcuccuacgucggaaauacagcugaccgacuacggagcccucacauuggacugcucaccuagaacugggcuggacuuuaaugagauggugcuacugacaaugaaagaaaaaucauggcuuguccacaaacaaugguuucuagacuuaccacugccuuggacuucgggagcuucaacaucccaagagacuuggaacagacaagauuugcuggucacauucaagacagcucaugcaaagaaacaggaaguagucgugcugggaucacaggaaggagcaaugcacacugcgcugacuggggcgacagaaauccagacgucaggaacgacaacaauuuuugcgggacaccugaaauguagacuaaaaauggacaaacugacuuuaaaagggaugucauaugugaugugcacaggcucauuuaagcuagagaaggaaguggcugagacccagcauggaacuguuuuagugcagguuaaauacgaaggaacagaugcaccaugcaagaucccuuuuuugacccaagaugagaaaggagugacccagaaugggagauugauaacagcuaaucccauaguuacugauaaagaaaaaccagucaacauugagacagaaccaccuuuuggugagagcuacaucgugguaggggcaggugaaaaagcuuugaaacuaagcugguucaagaaaggaagcagcauagggaaaauguuugaagcaaccgcccgaggagcacgaaggauggccauccugggagacacugcaugggacuucggcucuauaggaggauuguucacgucugugggaaaauugauacaccagauuuuuggaacugcauaugggguucuguucagcgguguuucuuggaccaugaaaauaggaauagggauucuguugacaugguugggauuaaauucaaggagcacgucacuuucaaugacgugcauugcaguuggcauggucacacuguaccuaggagucaugguucaagcggacucgggaugugugaucaacuggaagggcagagaacucaaauguggaaguggcauuuuugucaccaaugaaguccacacuuggacagagcaauauaaauuccaggcugacuccccaaaaagacugucagcagccauugggaaggcaugggaggaaggcguguguggaauucgaucagccacgcgucuugagaacaucauguggaagcaaauaucaaaugaauugaacuacauccuacuugaaaaugacaugaaauucacagugguuguaggagacauuaauggaauuuuggcccaagggaaaaaaaugaucagaccacaacccauggaacacaaauacucauggaaaaguuggggaaaagccaagaucauaggagcagacauacagaacaccaccuuuaucauugacgguccagauacuccagaaugccccaaugaccaaagagcauggaacauuugggaaguugaggacuacggguucggaauuuucacgacaaacauauggcugaaauugcgugacucccacacccaaaugugugaccaucggcuaaugucagcugccaucaaggacagcaaagcaguccaugcugauaugggguacuggauagaaagugaaaagaacgagaccuggaagcuagcgagagccuccuuuauagaagucaagacaugcaucuggccgaaaucccacacucuauggaguaauggaguuuuggaaagugaaaugguaaucccaaagauauauggaggaccaauaucucagcacaacuacagaccaggguauuucacacaaacagcagggccauggcaccuaggcaaguuggaauuggauuuugacuugugugaagguaccacaguuguuguagaugaacauuguggauaucgaggcccaucucucagaacuacaacaguuacaggaaagauaauccaugaaugguguugcagauccugcacguuaccccccuuacgcuucagaggagaagacggauguugguauggcauggaaaucagaccaguuaaggagaaggaggagaaccuaguuaggucaauggucucugcagggucaggagaaguggacaguuuuucauuaggaauacuaugcguaucaauacugauugaagaaguaaugagauccagauggaguagaaagaugcugaugacuggaacacuggcuguuuuccuccuucucauaaugggacaacugacauggaaugaucugaucagguuaugcaucaugguuggagccaaugcuucagacaggauggggauggggacaacguaccuagccuugauggccacuuucaaaaugagaccaauguucgcuguugggcuauuauuucgcagacuaacauccagagaaguucuucuucucacgguuggauuaagccugguggcauccguggagcugccaaauucuuuagaggagcuaggggauggacuugcaaugggcaucaugauguuaaaauuauugacugacuuccagccacaccaguuauggaccacccuauugucucuaacauuuaucagaacaucucuuucauuggauuaugcauggaagacaauggcuauggcacugucaaucguaucucucuuuccuuugugucugucuacgaccucccaaaaaacaacauggcuuccggugcuguuaggaucuuuuggauguaaaccauuaaccauguuucucauaacagaaaacaaaaucuggggaaggaaaagcuggcccaucaaugaaggaauuauggcuguuggaauagucagcauucuacuaaguucacuccucaaaaaugaugugccgcuagccggcccacuaauagcuggaggcaugcuaauagcauguuaugucauaucuggaagcucagcugauuuaucauuggaaaaagcggcugagguauccugggaagaagaagcagaacacuccggcaccucacacaacauauuaguggagguccaagaugauggaacuaugaaaauaaaagaugaagagagggaugauacacucaccauacuccucaaagcaacucugcuggcagucucaggaguguacccaaugucaauaccggcaacucuuuuugugugguauuuuuggcagaaaaagaaacagagaucaggaguguuaugggacacacccagcccuccggaaguggaaagggcaguucuugaugauggcauuuauagaaucuugcaaagaggacuguugggcaggucccaagugggagugggaguuuuccaagacggcguguuccacacaauguggcacgucaccaggggagcuguccuuauguaccaagggaagaggcuggaaccaagcugggccagugucaaaaaagacuugaucucauacggaggagguuggagguuucaaggaucauggaacacgggagaagaagugcaggugauagcuguugaaccaggaaaaaaccccaaaaauguacagacaacgccggguaccuucaagacuccugaaggcgagguuggagccauagcucuagauuuuaaacccggcacaucuggaucucccaucgugaacagagagggaaaaauaguaggucuuuauggaaauggaguggugacaacaaguggaaccuacgucagugccaucgcucaagcuaaagcaacacaagaagggccucuaccagagauugaggacgaaguguuuaagaaaagaaacuuaacaauaauggaccugcauccaggaucagggaaaacaagaagauaucuuccagccauaguccgugaggccauaaaaaggaagcugcgcacgcuaaucuuggcucccacaagaguugucgccucugaaauggcagaggcgcucaagggaaugccaauaagauaccagacaacagcagugaagagugaacauacaggaagggagauaguugaccucaugugccaugccacuuuuaccaugcgucucuuaucuccagugagaguucccaauuacaacaugauuaucauggaugaagcacacuuuacugauccagccagcauagcagccagaggguacaucucaacccgaguggguaugggugaagcagcugcgaucuucaugacagccacucccccaggaucgguggaggccuuuccacagagcaaugcaguuauccaagaugaggaaagagacauuccugagagaucauggaacucaggcuacgacuggaucacugauuuuccagguaaaacaguuugguuuguuccaagcaucaaaucaggaaaugacauugcuaacuguuuaagaaagaacggaaaacgggugauucaacugagcaggaaaaccuuugacacugaguaccagaaaacaaaaaacaaugacugggacuacguugucacaacagacauuuccgaaaugggagcaaauuuccgggccgacaggguaauagauccaaggcggugcuugaaaccgguaauacuaaaggaagguccagagcgcguuauucuagccggaccgaugccagugacuguggccagugccgcccagaggagaggaagaauuggaaggaaccaaaacaaagaaggugaucaguacauuuacaugggacagccuuuaaacaaugaugaggaucacgcucauuggacagaagcaaaaaugcuccuugacaauauaaacacaccagaagggaucaucccagcccucuuugagccagagagagaaaaaagugcagcaauagacggggaguacagacugcggggagaagcaaggaaaacguucguggagcucaugagaagaggagaucuaccagucuggcuauccuacaaaguugccucagaagguuuccaauacuccgacagaagauggugcuuugauggggaaaggaauaaccagguguuggaggagaacauggacguggagaucuggacaaaggaaggagaaagaaagaaauugcgaccccgcugguuggaugcuagaacauacucugacccacuggcccugcgcgaguuuaaagaguuugcagcaggaagaagaagugucucaggugaccuaauauuggaaauaggaaaacuuccacaacauuugacgcuaagagcccagaaugcucuggacaacuuggucauguugcacaauuccgaacaaggaggaaaagccuacagacaugcuauggaagaacuaccagacaccauagaaacauugaugcuccuagcuuugauagcugugcugacugguggagugacgcuguucuuccuaucaggaaaaggucuagggaaaacauccauuggccuacucugugugauggccucaagcgcacuguuauggauggccaguguggagccccauuggauagcggccuccaucauauuagaguucuuucugauggugcugcucauuccagagccagacagacagcgcacuccacaggacaaccaguuagcauauguggugauagguuuguuauucaugauacugacaguggcagcuaaugagaugggauuguuggaaaccacaaagaaagaccuggggauuggccauguagccgucgaaaaccaccaccaugccacaaugcuggacguagaccuacguccagcuucagccuggacccucuaugcaguagccacaacaguuaucacccccaugaugagacacacaauugaaaauacaacggcaaauauuucccugacagccaucgcaaaccaggcugcuauauugauggggcuugacaagggauggccaauaucgaagauggauauaggaguuccacuucucgccuuagggugcuauucccaggugaacccauugacacuaacagcggcgguguugauguuaguggcucauuaugccauaauuggaccaggacugcaagcaaaggccacuagagaagcucaaaaaaggacagcggccggaauaaugaaaaauccaaccguagacgggauugucacaauagacuuggauccugugguuuaugaugcaaaauuugaaaaacagcuaggucaaauaauguuacugauacuuuguacaucacagauucucuugaugcggaccacaugggccuugugugaauccaucacacuggcuacuggacccuugaccacucuuugggagggaucuccaggaaaauucuggaacaccacgauagcaguguccauggcaaacaucuucaggggaaguuaucuagcaggagcaggucuggccuucucguugaugaaaucuuuaggaggagguaggagaggcacgggagcucaaggggaaacacugggagaaaaauggaaaagacagcuaaaccaacugagcaagucagaauuuaacaccuacaaaaagagugggauuauggagguggacagauccgaagcuaaagagggauugaaaagaggagaaacaaccaaacaugcagugucgagaggaacagccaaacugaggugguuuguggagagaaaccucgugaaaccagaagggaaagucauagaccucgguugugggagaggugguuggucauauuacugcgcugggcugaagaaagucacugaagugaagggauacacaaaaggaggaccuggacaugaggaacccaucccaauggcgaccuauggauggaacuugguaaagcuacacucugggaaagauguauucuucacaccaccugagaaaugugacacccuuuugugugacauuggugaguccucuccaaauccaacuauagaagaaggaagaacacuacguguucuaaagaugguggaaccauggcuuagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguagccaaccuagauaucauuggccagaggauagagaacauaaaaaaugaacauaagucaacauggcauuaugaugaagacaauccauacaaaacaugggccuaucauggaucauaugaggucaaaccaucaggaucagccucauccauggugaauggcguggugagauugcucaccaaaccaugggauguuauccccauggucacacaaauagcuaugacugauaccacacccuucggacaacagaggguguuuaaagagaaaguugacacgcgcacaccaagagcaaaaagaggcacagcacaaaucauggaggugacagccaagugguuaugggguuuccuauccagaaacaaaaaacccagaaucugcacaagagaggaguucacaagaaaaguuaggucaaacgcagcaauaggagcaguguuuguugaugaaaaccaauggaacucagcaaaagaagcaguggaagacgaaagguuuugggaucuugugcacagagagagggagcuucauaaacagggaaaaugugccacguguguuuacaauaugauggggaagagagaaaaaaaauuaggagaguucggaaaagcaaaaggaagucgugcaauaugguacauguggcugggagcacgcuuucuagaguuugaagcccuugguuucaugaaugaagaucacugguucaguagagagaauucacucaguggaguggaaggagaaggacugcacaaacuuggauacauacucagagacauaucaaagauuccggggggaaauauguaugcagaugacacagccggaugggacacaagaauaacagaggaugaucuucaaaaugaggcuaaaaucacugacaucauggagccugaacaugcucuauuggccacgucaauuuuuaaacugaccuaccaaaauaagguggugagggugcaaagaccagcaaaaagugggaccgugauggaugucauauccagacgugaccagagaggaaguggacaggucggaacuuauggcuuaaauacuuucaccaauauggaaguccaauuaauaagacaaauggagucugaaggaauuuucucacccagcgaauuggaaacccccaaucuagcuaagaaaguucuugacuggcuggaaaaacauggcgcugaaaggcugaaaagaauggcaauuagcggagaugauuguguggugaaaccaauugaugacagguucgcaacagccuuaacagcuuugaaugauaugggaaaaguaagaaaagacauaccgcagugggaaccuucaaaaggauggaaugacuggcagcaagucccuuucuguucacaccacuuccaccagcugaucaugaaagauggaagagaaauaguggugccaugccgcaaccaagaugaacuugugggcagggcuagaguaucacaaggcgcuggauggagccugagagaaacugcuugccuaggcaagucauaugcacaaauguggcagcugauguacuuucacaggagagaccugagacuagcggcuaaugcuaucuguucagccgucccaguugauugggucccaaccagccgcaccaccuggucgauccaugcccaccaccaauggaugacaacagaagacauguuaucaguguggaauaggguuuggauagaggaaaacccauggauggaagacaaaacucauguauccaguugggaagaaguuccauaccuagggaaaagggaagaucaaugguguggauccuugauagguuugacagcaagggccaccugggccacuaauauacaaguagccauaaaccaagugagaaggcucaucgggaaugagaauuaucuagauuauaugacaucaaugaagagauucaagaaugagagugaucccgaaggggcacucugguaa

SEQ ID NO: 6238 - RNA, 9879 nt, Artificial Sequence
  derived and/or modified CDS sequence (wt) from DENV-1__KC692512__SS-prME
uccgugaccaugcuccucaugcugcugcccacagcccuggcguuucauuugaccacacgagggggagagccacacaugauaguuaguaagcaggaaagaggaaagucacucuuguuuaagaccucugcgggcgucaauaugugcacccucauugcgauggacuugggagaguuaugugaggacacaaugaccuacaaaugcccccgaaucacugaggcggaaccagaugacguugacugcuggugcaaugccacagacacaugggugaccuaugggacgugcucucaaaccggcgaacaccgacgagagaaacguuccguggcacuggccccacacgugggacuuggucuagaaacaagaaccgaaacauggauguccucugaaggcgccuggaaacaaauacaaagaguggaaacuugggcuuugagacacccaggauucacggugauagcccuuuuuuuagcgcaugcuauaggaacauccaucacucaaaaagggaucauuuucaucuugcugaugcuggugacaccaucaauggccaugcgaugcgugggaauaggcaacagagacuucguugaaggacugucaggagcaacguggguggacgugguauuggagcauggaagcugcgucaccaccauggcaaaaaauaaaccaacauuggacauugaacucuugaagacggaggucacgaacccugccgucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcugggguaauggcuguggacuauucggaaagggaagucuauugacgugugccaaguucaagugcgugacaaaacuagagggaaagauaguucaauaugaaaacuuaaaauauucagugauagucacuguccacacuggggaccagcaccaggugggaaacgagaccacagaacauggaacaauugcaaccauaacaccucaagcucccacgucggaaauacagcugacugacuacggagcccucacauuggacugcucaccuagaacagggcuggacuuuaaugagauggugcuauugacaaugaaagaaaaaucauggcuuguccacaaacaaugguuucuagacuuaccacugccauggacuucgggggcuucaacaucucaagagaccuggaacagacaagauuugcuggucacauucaagacagcucaugcaaaaaaacaggaaguagucguacugggaucacaggaaggagcaaugcacacagcguugacuggggcgacagaaauccagacgucaggaacgacaacaaucuucgcaggacaccugaaaugcagacuaaaaauggauaaacugaccuuaaaggggaugucauaugugaugugcacaggcucauuuaaguuagagaaggaaguggcugagacccagcauggaacuguccuagugcaggucaaauaugaaggaacagacgcgccaugcaagauccccuucucgacccaagaugagaaaggagugacccagaaugggagauugauaacagccaaucccauaguuacugacaaagaaaaaccagucaacauugagacagaaccaccuuuuggugagagcuacaucgugguaggggcaggcgaaaaagcuuugaaacuaagcugguucaagagaggaagcagcauagggaaaauguucgaagcaaccgcccgaggagcacgaaggauggcuauccugggagacaccgcaugggacuucgguucuauaggaggaguguuuacaucugugggaaaauugguacaccagguuuuuggaaccgcauaugggguucuguuuagcgguguuucuuggaccaugaaaauaggaauagggauucugcugacaugguugggauuaaauucaaggagcacgucacuuucgaugacgugcauugcaguuggcauggucacacuguaccuaggagucaugguucaagcggauucgggauguguaaucaacuggaagggcagagaacuuaaauguggaaguggcauuuuugucacuaaugaaguccacacuuggacagagcaauacaaauuccaggcugacuccccaaaaagacugucagcagccauuggaaaggcaugggaggagggcguauguggaauucgaucagccacgcgucuugagaacaucauguggaagcaaauaucaaaugaauugaaccacauucuacuugagaaugacaugaaauucacagugguuguaggagaugccaacggaauuuuggcccaaggaaaaaaaaugauuaggccacaaccuauggaacacaaauacucauggaaaagcuggggaaaagcuaaaaucauaggagcagacauacaaaauaccaccuucaucaucgacggcccagacaccccagaaugucccgauggccaaagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaaugaaaccuggaagcuggcgagagccuccuucauagaagucaagacaugcaccuggccgaaaucucacacucuauggagcaauggagucuuggaaagugaaaugauaaucccaaagauauuuggaggaccaauaucucagcacaacuacagaccaggguauuucacacaaacagcagggccauggcaccuagguaaguuggaacuggauuuugacuugugugaagguaccacaguuguuguggaugaacauuguggaaaucgagguccaucucucagaaccacaacagucacaggaaagauaauccaugaaugguguugcagauccugcacgcuaccccccuuacguuucagaggagaagacggguguugguauggcauggaaaucagaccaguaaaggagaaggaggagaaucuagucaggucaauggucucugcagggucaggagaaguggauaguuuuucauuaggaauacuaugcgugucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuccgcagacuaacauccagagaaguucuucuccucacgauuggauuaagccugguggcauccguggagcuaccaaauucuuuggaggagcuaggggauggacuugcaauggguaucaugauguuaaaauuguugacugaauuucagccacaccaguuauggaccaccuuauugucucugacauuugucaaaacaacucucucacuggauuaugcauggaaaacaacggcuaugguacugucuaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaagcucacuccucaaaaaugaugugccguuggccgggccacuaauagcuggaggcaugcuaauagcauguuaugucauauccggaagcucagccgauuuaucauuggagaaagcggcugaaguauccugggaacaagaagcagaacacuccggugccucacacaacauauuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccagcccuccggaaguggaaagagcaguucuugaugauggcaucuauagaaucuugcaaagaggacuguuggggaggucccaaguaggagugggagucuuccaagacggcguguuccacacaauguggcacguuaccaggggagcuguccuuauguaccaagggaagagacuggaaccaagcugggccagugucaaaaaggacuugaucucauauggaggagguuggagguuccaaggaucauggaacacaggagaagaagugcaggugauagcuguugaaccaggaaaaaaccccaaaaauguacagacaacgccgggcaccuucaagacuccugaaggcgaaguuggagccauagcucuagauuucaaacccggcacaucuggaucucccauugugaacagagaggaaaaaauagugggucuguauggaaauggaguggugacaacaaguggaaccuacgucagugccauugcccaagcuaaagcaucacaggaagggccucuaccagaaauugaggacgagguguuuaagaaaagaaacuuaacaauaauggacuugcacccaggaucagggaaaacaagaagauaucuuccagccauaguccgugaggccauaaaaaggaaacugcguacguuaaucuuggcucccacaagaguugucgccucugaaauggcagaggcacucaagggaaugccaauaagauaucagacaacagcagugaagagugaacacacaggaagggagauaguugaccucaugugccacgcuacuuuuaccaugcgucucuuauccccagugagaguucccaauuacaacaugauuauuauggaugaagcacauuuuaccgauccagcuagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggauuacugacuuuccagguaaaacagucugguuuguuccaagcauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuucugaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccuuuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcgaccucgcugguuggacgccagaacauacucugauccauuggcccugcgcgaguuuaaagaguucgcagcaggaagaagaagugucucaggugaccuaauauuggaaauagggaaacuuccacaacauuugacgcuaagagcccagaaugcucuggacaacuuggucauguugcacaauuccgaacaaggaggaaaagccuacagacaugcuauggaggaacugccagacaccauagaaacguugaugcuucuagcuuugauagcuguguugacugguggagugacgcuguucuuccuaucaggaaaaggucuagggaaaacauccaucggcuugcucugugugacggccucaagugcacuguuauggauggccaguguggagccccauuggauagcggccuccaucauacuagaguucuuuuugauggugcugcucauuccagaaccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacauucuacaaugcuggacguagaccuacacccagcuucagccuggacccucuaugcaguagccacaacaguuaucacucccaugaugagacacacaauugaaaauacaacggcaaacauuucccugacagccauugcaaaucaggcagccauauugaugggacuugacaagggauggccaauaucgaagauggacauaggaguuccacuucucgccuuagggugcuauucccaggugaacccauugacacugacagcggcgguguugauguuaguggcucauuaugcuauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacaauagcaguguccauggcaaauaucuucaggggaaguuaucuagcaggagcaggucuggcuuucucauuaaugaaaucuuuaggaggagguaggagagguacgggagcucaaggggaaacauugggagagaaauggaaaagacaguuaaaccaacugagcaagucagaauucaacaccuacaaaaggagugggauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaaguuacugaagugaagggauacacaaaaggaggaccuggacaugaggaaccuaucccaauggcgaccuauggauggaaccuaguaaagcuacacucuggaaaggauguauuuuuuaugccaccugagaaaugugacacccuucugugugauauuggugaguccuccccgaauccaacuauagaagaaggaagaacguuacguguucuaaaaaugguggaaccauggcucagaggaaaccaauucugcauaaaaauccuaaauccuuacaugccaagugugguagaaacucuggagcaaaugcaaagaaaacauggagggaugcuagugcgaaacccacucucaagaaauucuacccaugaaauguauuggguuucauguggaacaggaaacauugugucggcagugaacaugacauccagaaugcuacugaaccgauucacaauggcucacaggaagccaacauaugaaagagacguggacuuaggcgcuggaacaagacauguggcaguggaaccagagguagccaaccuagauaucauuggccagaggauagagaauauaaaaaaugaacacaggucaacauggcauuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugacugauaccacacccuuuggacaacagagaguguuuaaagagaaaguugacacgcgcacaccaagagcaaaacgaggcacaacacagauuauggaggugacagccaagugguuaugggguuuccuuuccagaaacaaaaaacccagaaucugcacaagagaggaguucacaagaaagguuaggucaaacgcggcaauaggagcaguguucguugaugaaaaccaauggaacucagcaaaagaagcaguggaagacgaaagguuuugggaucuugugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaagcccuugguuucaugaaugaagaucacugguuuaguagagagaauucacucaguggaguggaaggagaaggacugcacaaacuuggauacauacucagagacauaucaaagauuccggggggaaacauguaugcagaugauacagccggaugggacacaagaauaacagaggaugaucuucagaaugaggcuaaaaucacugacaucauggagccugaacaugcucuauuggcuacgucaauuuuuaagcugacuuaucaaaacaagguggugagggugcaaagaccagcaaaaaauggaaccgugauggauguuauauccagacgugaucagagaggaaguggacaggucggaacuuauggcuuaaauacuuucaccaauauggagguccaacuaauaagacaaauggaaucugaaggaaucuuuuuacccagcgaauuggaaaccccaaaccuagcugagagggcucuugacugguuagaaaaacauggcgccgaaaggcugaaacgaauggcaaucagcggagaugauugcguggugaaaccaauugacgacagguucgcaacagccuuaacagcucugaaugacaugggaaaaguaagaaaagacauaccgcagugggaaccuucgaaaggauggaaugauuggcagcaagugccuuuuuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuagcggcuaacgcuaucugcucagccgucccaguugauugggucccagccagccgcacaaccuggucaauccaugcccaccaccaauggaugacaacagaagacauguuaucaguguggaauagaguuuggauagaggaaaacccauggauggaggacaaaacucauguauccaguugggaagaaguuccauaccuaggaaaaagggaagaccaaugguguggaucccugauaggcuugacagcgagggccaccugggccaccaacauacaaguagccauaaaccaagugagaaggcucaucgggaaugagaauuauuuagauuacaugacaucaaugaagagauucaagaaugagagugaucccgaaggagcacucugguaa

SEQ ID NO: 6239 - RNA, 9879 nt, Artificial Sequence
  derived and/or modified CDS sequence (wt) from DENV-1__KC692513__SS-prME
uccgugaccaugcuccucaugcugcugcccacagcccuggccuuccauuugacuacacgagggggagagccacacaugauagucagcaagcaggaaagaggaaagucacucuuguuuaagaccucuguaggugucaacaugugcacucucauugcgauggauuugggagaguuaugugaggacacaaugaccuacaaaugcccccggaucacugaggcggaaccagaugauguugacugcuggugcaaugccacagacacaugggugaccuaugggacguguucucaaaccggcgaacaccgacgagacaaacguuccgucgcacuggccccacacgugggacuuggucuagaaacaagaacugaaacguggaugucaucugaaggcgccuggaaacaaauacaaaaaguggagacuugggcuuugcgacacccaggauucacggugauagcccuuuucuuggcacaugccauaggaacauccaucacccagaaagggaucauuuucauuuugcugaugcugguaacaccaucaauggccaugcgaugcgugggaauaggcaauagagacuucguugaaggacugucaggagcaacguggguggacgugguacuggagcauggaagcugcgucaccaccauggcaaaaaacaaaccaacauuggacauugaacucuugaaaacggaggucacgaacccugccguccugcgcaaacugugcaucgaagcuaaaauaucaaacaccaccaccgauucaagguguccaacacaaggagaagcuacacugguggaagaacaagacgcgaacuuugugugucgacggacguucguggacagaggcugggguaaugguugcggacuauuuggaaaaggaagucuacugacgugugcuaaguucaagugugugacaaaacuagaaggaaagauaguucaauaugaaaacuuaaaauauucagugauagucacuguccacacuggggaccagcaccagguaggaaacgagaccacagaacauggaacaauugcaaccauaacaccucaagcuccuacgucggaaauacagcugaccgacuacggagcccucacauuggacugcucaccuagaacugggcuggacuuuaaugagauggugcuacugacaaugaaagaaaaaucauggcuuguccauaagcaaugguuucuagacuuaccacugccuuggacuucgggagcuucaacaccccaagagacuuggaacagacaagauuugcuggucacauucaagacagcucaugcaaagaaacaggaaguagucgugcugggaucacaggaaggagcaaugcacacugcgcugacuggggcgacagaaauccagacgucaggaacgacaacaauuuuugcgggacaccugaaauguagacuaaaaauggacaaacugacuuuaaaagggaugucauaugugaugugcacaggcucauuuaagcuagagaaggaaguggcugagacccagcauggaacuguuuuagugcagguuaaauacgaaggaacagaugcaccaugcaagaucccuuuuuugacccaagacgagaaaggagugacccagaaugggagauugauaacagcuaauccuauaguuacugauaaagaaaaaccagucaacauugagacagaaccaccuuuuggugagagcuacaucgugguaggggcaggugaaaaagcuuugaaacuaagcugguucaagaaaggaagcagcauagggaaaauguuugaagcaaccgcccgaggagcacgaaggauggccauccugggagacacugcaugggacuucggcucuauaggaggauuguucacgucugugggaaaauugauacaccagguuuuuggaacugcauaugggguucuguucagcgguguuucuuggaccaugaaaauaggaauagggauucugcugacaugguugggauuaaauucaaggagcacgucacuuucaaugacgugcauugcaguugguauggucacacuguaccuaggagucaugguucaagcggacucgggaugugugaucaacuggaagggcagagaacucaaauguggaaguggcaucuuugucacuaaugaaguccacacuuggacagagcaauauaaauuccaggcugacuccccaaaaagacugucagcagccauugggaaggcaugggaggaaggcguguguggaauucgaucagccacgcgucuugagaacaucauguggaagcaaauaucaaaugaauugaacuacauccuacuugaaaaugacaugaaauucacagugguuguaggagacauuaauggaauuuuggcccaagggaaaaaaaugaucagaccacaacccauggaacacaaauacucauggaaaaguuggggaaaagccaagaucauaggagcagacauacagaacaccaccuuuaucauugacgguccagauacuccagaaugccccgaugaccaaagagcauggaacaucugggaaguugaggacuacggguucggaauuuucacgacaaacauauggcugaaauugcgugacucccacacccaaaugugugaccaucggcuaaugucagcugccaucaaggacagcaaagcaguccaugcugauaugggguacuggauagaaagugaaaagaacgagaccuggaagcuagcgagagccuccuuuauagaagucaagacaugcaucuggccgaaaucccacacucuauggaguaauggaguuuuggaaagugaaaugguaaucccaaagauauauggaggaccaauaucucagcacaacuacagaccaggguauuucacacaaacagcagggccauggcaccuaggcaaguuggaauuggauuuugacuugugugaagguaccacaguuguuguagaugaacauuguggauaucgaggcccaucucucagaacuacaacaguuacaggaaagauaauccaugaaugguguugcagauccugcacguuaccccccuuacgcuucagaggagaagacggauguugguauggcauggaaaucagaccaguuaaggagaaggaggagaaccuaguuaggucaauggucucugcagggucaggagaaguggacaguuuuucauuaggaauacuaugcguaucaauacugauugaagaaguaaugagauccagauggaguagaaagaugcugaugacuggaacacuggcuguuuuccuccuucucauaaugggacaacugacauggaaugaucugaucagguuaugcaucaugguuggagccaaugcuucagacaggauggggauggggacaacguaccuagccuugauggccacuuucaaaaugagaccaauguucgcuguugggcuauuauuucgcagacuaacauccagagaaguucuucuucucacgguuggauuaagccugguggcauccguggagcugccaaauucuuuagaggagcuaggggauggacuugcaaugggcaucaugauguuaaaauuauugacugacuuccagccacaccaguuauggacuacccuauugucucuaacauuuaucagaacaucucuuucauuggauuaugcauggaagacaauggcuauggcacugucaaucguaucucucuuuccuuugugucugucuacgaccucccaaaaaacaacauggcuuccggugcuguuaggaucuuuuggauguaaaccauuaaccauguuucucauaacagaaaacaaaaucuggggaaggaaaagcuggcccaucaaugaaggaauuauggcuguuggaauagucagcauucuacuaaguucacuccucaaaaaugaugugccgcuagccggcccacuaauagcuggaggcaugcuaauagcauguuaugucauaucuggaagcucagcugauuuaucauuggaaaaagcggcugagguauccugggaagaagaagcagaacacuccggcaccucacacaacauauuaguggagguccaagaugauggaacuaugaaaauaaaagaugaagagagggaugauacacucaccauacuccucaaagcaacucugcuggcagucucaggaguguacccaaugucaauaccggcaacucuuuuugugugguauuuuuggcagaaaaagaaacagagaucaggaguguuaugggacacacccagcccuccggaaguggaaagggcaguucuugaugauggcauuuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaagacuugaucucauacggaggagguuggagguuucaaggaucauggaacacgggagaagaagugcaggugauagcuguugaaccaggaaaaaaccccaaaaauguacagacaacgccggguaccuucaagacuccugaaggcgaaguuggagccauagcucuagauuuuaaacccggcacaucuggaucucccaucgugaacagagagggaaaaauaguaggucuuuauggaaauggaguggugacaacaaguggaaccuacgucagugccaucgcucaagcuaaagcaacacaagaagggccucuaccagagauugaggacgagguguuuaagaaaagaaacuuaacaauaauggaccugcauccaggaucagggaaaacaagaagauaucuuccagccauaguccgugaggccauaaaaaggaagcugcgcacgcuaaucuuggcucccacaagaguugucgccucugaaauggcagaggcgcucaagggaaugccaauaagauaccagacaacagcagugaagagugaacauacaggaagggagauaguugaccucaugugccaugccacuuuuaccaugcgucucuuaucuccagugagaguucccaacuacaacaugauuaucauggaugaagcacacuuuacugauccagccagcauagcagccagaggguacaucucaacccgaguggguaugggugaagcagcugcgaucuucaugacagccacucccccaggaucgguggaggccuuuccacagagcaaugcaguuauccaagaugaggaaagagacauuccugagagaucauggaacucaggcuacgacuggaucacugauuuuccagguaaaacaguuugguuuguuccaagcaucaaaucaggaaaugacauugcuaacuguuuaagaaagaacggaaaacgggugauucaacugagcaggaaaaccuuugacacugaguaccagaaaacaaaaaacaaugacugggacuacguugucacaacagacauuuccgaaaugggagcaaauuuccgggccgacaggguaauagauccaaggcggugcuugaaaccgguaauacuaaaggaagguccagagcgcguuauucuagccggaccgaugccagugacuguggccagugccgcccaaaggagaggaagaauuggaaggaaccaaaacaaagaaggugaucaguacauuuacaugggacagccuuuaaauaaugaugaggaucacgcucauuggacagaagcaaaaaugcuccuugacaauauaaacacaccagaagggaucaucccagcccucuuugagccagagagagaaaaaagugcagcaauagacggggaguacagacugcggggagaagcaaggaaaacguucguggagcucaugagaagaggagaucuaccaguuuggcuauccuacaaaguugccucagaagguuuccaauacuccgacagaagauggugcuuugauggggaaaggaauaaccagguguuggaggagaacauggacguggagaucuggacaaaggaaggagaaagaaagaaauugcgaccccgcugguuggaugcuagaacauacucugacccacuggcccugcgcgaguuuaaagaguuugcagcaggaagaagaagugucucaggugaccuaauauuggaaauaggaaaacuuccacaacauuugacgcuaagagcccagaaugcucuggacaacuuggucauguugcacaauuccgaacaaggaggaaaagccuacagacaugcuauggaagaacuaccagacaccauagaaacauugaugcuccuggcuuugauagcugugcugacugguggagugacgcuguucuuccuaucaggaaaaggucuagggaaaacauccauuggccuacucugugugauggccucaagcgcacuguuauggauggccaguguggagccccauuggauagcggccuccaucauauuagaguucuuucugauggugcugcucauuccagagccagacagacagcgcacuccacaggacaaccaguuagcauauguggugauagguuuguuauucaugauacugacaguggcagcuaaugagaugggauuguuggaaaccacaaagaaagaccuggggauuggccauguagccgucgaaaaccaccaccaugccacaaugcuggacguagaccuacguccagcuucagccuggacccucuaugcaguagccacaacaguuaucacccccaugaugagacacacaauugaaaauacaacggcaaacauuucccugacagccaucgcaaaccaggcugcuauauugauggggcuugauaagggauggccaauaucgaagauggauauaggagucccacuucucgccuuagggugcuauucccaggugaacccauugacacuaacagcggcgguguugauguuaguggcucauuaugccauaauuggaccaggacugcaagcaaaggccacuagagaagcucaaaaaaggacagcggccggaauaaugaaaaauccaaccguagacgggauugucacaauagacuuggauccugugguuuaugaugcaaaauuugaaaaacagcuaggucaaauaauguuacugauacuuuguacaucacagauucucuugaugcggaccacaugggccuugugugaauccaucacacuggcuacuggacccuugaccacucuuugggagggaucuccaggaaaauucuggaacaccacgauagcaguguccauggcaaacaucuucaggggaaguuaucuagcaggagcaggucuggccuucucguugaugaaaucuuuaggaggagguaggagaggcacgggagcucaaggggaaacacugggagaaaaauggaaaagacagcuaaaccaacugagcaagucagaauuuaacaccuacaaaaagagugggauuauggagguggacagauccgaagcuaaagagggauugaaaagaggagaaacaaccaaacaugcagugucgagaggaacagccaaacugaggugguuuguggagagaaaccucgugaaaccagaagggaaagucauagaccucgguugugggagaggugguuggucauauuacugcgcugggcugaagaaagucacugaagugaagggauacacaaaaggaggaccuggacaugaggaacccaucccaauggcgaccuauggauggaacuugguaaagcuacacucugggaaagauguauucuucacaccaccugagaaaugugacacccuuuugugugacauuggugaguccucuccaaauccaacuauagaagaaggaagaacacuacguguucuaaagaugguggaaccauggcuuagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguagccaaccuagauaucauuggccagaggauagagaacauaaaaaaugaacauaagucaacauggcauuaugaugaagacaauccauacaaaacaugggccuaucauggaucauaugaggucaaaccaucaggaucagccucauccauggugaauggcguggugagauugcucaccaaaccaugggauguuauccccauggucacacaaauagcuaugacugauaccacacccuucggacaacagaggguguuuaaagagaaaguugacacgcgcacaccaagagcaaaaagaggcacagcacaaaucauggaggugacagccaagugguuaugggguuuccuauccagaaacaaaaaacccagaaucugcacaagagaggaguucacaagaaaaguuaggucaaacgcagcaauaggagcaguguuuguugaugaaaaccaauggaacucagcaaaagaagcaguggaagacgaaagguuuugggaucucgugcacagagagagggagcuucauaaacagggaaaaugugccacguguguuuacaauaugauggggaagagagaaaaaaaauugggagaguucggaaaagcaaaaggaagucgugcaauaugguacauguggcugggagcacgcuuucuagaguuugaagcccuugguuucaugaaugaagaucacugguucaguagagagaauucacucaguggaguggaaggagaaggacugcacaaacuuggauacauacucagagacauaucaaagauuccggggggaaauauguaugcagaugacacagccggaugggacacaagaauaacagaggaugaucuucagaaugaggcuaaaaucacugacaucauggagccugaacaugcucuauuggccacgucaauuuuuaaacugaccuaccaaaauaagguggugagggugcaaagaccagcaaaaagugggaccgugauggaugucauauccagacgugaccagagaggaaguggacaggucggaacuuauggcuuaaauacuuucaccaauauggagguccaauuaauaagacaaauggagucugaaggaauuuucucacccagcgaauuggaaaccccuaaucuagcuaagaaaguucuugacuggcuggaaaaacauggcgcugaaaggcugaaaagaauggcaauuagcggagaugauuguguggugaaaccaauugaugacagguucgcaacagccuuaacagcuuugaaugauaugggaaaaguaagaaaagacauaccgcagugggaaccuucaaaaggauggaaugacuggcagcaagucccuuucuguucacaccacuuccaucagcugaucaugaaagauggaagagaaauaguggugccaugccgcaaccaagaugaacuugugggcagggcuagaguaucacaaggcgcuggauggagccugagagaaacugcuugccuaggcaagucauaugcacaaauguggcagcugauguacuuucacaggagagaccugagacuagcggcuaaugcuaucuguucagccgucccaguugauugggucccaaccagccgcaccaccuggucgauccaugcccaccaccaauggaugacaacagaagacauguuaucaguguggaauaggguuuggauagaggaaaacccauggauggaagacaaaacucauguauccaguugggaagaaguuccauaccuagggaaaagggaagaucaaugguguggauccuugauagguuugacagcaagggccaccugggccacuaauauacaaguagccauaaaccaagugagaaggcucaucgggagugagaauuaucuagauuauaugacaucaaugaagagauucaagaaugagagugaucccgaaggggcacucugguaa

SEQ ID NO: 6240 - RNA, 9879 nt, Artificial Sequence
  derived and/or modified CDS sequence (wt) from DENV-1__KC692514__SS-prME
uccgugaccaugcuccucaugcugcugcccacagcccuggcguuucauuugaccacacgagggggagagccacacaugauaguuaguaagcaggaaagaggaaagucacucuuguuuaagaccucugcgggcgucaauaugugcacccucauugcgauggacuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagagaaacguuccguggcacuggccccacacgugggacuuggucuagaaacaagaaccgaaacauggauguccucugaaggcgccuggagacaaauacaaagaguggaaacuugggcuuugagacacccaggauucacggugauagcuuuuuuuuuagcgcaugcuauaggaacauccaucacucaaaaagggaucauuuucaucuugcugaugcuggugacaccaucaauggccaugcgaugcgugggaauaggcaacagagacuucguugaaggacugucaggagcaacguggguggacgugguauuggagcauggaagcugcgucaccaccauggcaaaaaauaaaccaacauuggacauugaacucuuaaagacggaggucacgaacccugccgucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcugggguaauggcuguggacuauucggaaagggaagucuauugacgugugccaaguucaagugugugacaaaacuagagggaaagauaguucaauaugaaaacuuaaaauauucagugauagucacuguccacacuggggaccagcaccaggugggaaacgagaccacagaacauggaacaauugcaaccauaacaccucaagcucccacgucggaaauacagcugacugacuacggagcccucacauuggacugcucaccuagaacagggcuggacuuuaaugagauggugcuauugacaaugaaagaaaaaucauggcuuguccacaaacaaugguuucuagacuuaccacugccauggacuucgggggcuucaacaucucaagagaccuggaacagacaagauuugcuggucacauucaagacagcucaugcaaagaaacaggaaguagucguacugggaucacaggaaggagcaaugcacacagcguugacuggggcgacagaaauccagacgucaggaacgacaacaaucuucgcaggacaccugaaaugcagacuaaaaauggauaaacugaccuuaaaggggaugucauaugugaugugcacaggcucauuuaagcuagagaaggaaguggcugagacccagcauggaacuguccuagugcaggucaaauaugaaggaacagacgcgccaugcaagauccccuucucgacccaagaugagaaaggagugacccagaaugggagauugauaacagccaaucccauaguuacugacaaagaaaaaccagucaacauugagacagaaccaccuuuuggugagagcuacaucgugguaggggcaggcgaaaaagcuuugaaacuaagcugguucaagagaggaagcagcauagggaaaauguucgaagcaaccgcccgaggagcacgaaggauggcuauccugggagacaccgcaugggacuucgguucuauaggaggaguguuuacauccgugggaaaauugguacaccagguuuuuggaaccgcauaugggguucuguuuagcgguguuucuuggaccaugaaaauaggaauagggauucugcugacaugguugggauuaaauucaaggagcacgucacuuucgaugacgugcauugcaguuggcauggucacacuguaccuaggagucaugguucaagcggauucgggauguguaaucaacuggaagggcagagaacuuaaauguggaaguggcauuuuugucacuaaugaaguccacacuuggacagagcaauacaaauuccaggcugacuccccaaaaagacugucagcagccauuggaaaggcaugggaggagggcguauguggaauucgaucagccacgcgucuugagaacaucauguggaagcaaauaucaaaugaauugaaccacauucuacuugagaaugacaugaaauucacagugguuguaggagaugccaacggaauuuuggcccaaggaaaaaaaaugauuaggccacaaccuauggaacacaaauacucauggaaaagcuggggaaaagcuaaaaucauaggagcagacauacaaaacaccaccuucaucaucgacggcccagacaccccagaaugucccgauggccaaagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaaugaaaccuggaagcuggcgagagccuccuucauagaagucaagacaugcaccuggccgaaaucucacacucuauggagcaauggagucuuggaaagugaaaugauaaucccaaagauauuuggaggaccaauaucccagcacaacuacagaccaggguauuucacacaaacagcagggccauggcaccuagguaaguuggaacuggauuuugacuugugugaagguaccacaguuguuguggaugaacauuguggaaaucgagguccaucucucagaaccacaacagucacaggaaagauaauccaugaaugguguugcagauccugcacgcuaccccccuuacguuucagaggagaagacggguguugguauggcauggaaaucagaccaguaaaggagaaggaggagaaucuagucaggucaauggucucugcagggucaggagaaguggauaguuuuucauuaggaauacuaugcgugucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuccgcagacuaacauccagagaaguucuucuccucacgauuggauuaagccugguggcauccguggagcuaccaaauucuuuggaggagcuaggggauggacuugcaauggguaucaugauguuaaaauuguugacugaauuucagccacaccaguuauggaccaccuuauugucucugacauuugucaaaacaacucucucacuggauuaugcauggaaaacaacggccaugguacugucuaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaagcuggccccucaaugaaggaauuauggcuauuggaauagucagcauucuacuaagcucacuccucaaaaaugaugugccguuggccgggccacuaauagcuggaggcaugcuaauagcauguuaugucauauccggaagcucagccgauuuaucauuggagaaagcggcugaaguauccugggaacaagaagcagaacacuccggugccucacacaacauauuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccagcccuccggaaguggaaagagcaguucuugaugauggcaucuauagaaucuugcaaagaggacuguuggggaggucccaaguaggagugggagucuuccaagacggcguguuccacacaauguggcacguuaccaggggagcuguccuuauguaccaagggaagagacuggaaccaagcugggccagugucaaaaaggacuugaucucauauggaggaggcuggagguuccaaggaucauggaacacaggagaagaagugcaggugauagcuguugaaccaggaaaaaaccccaaaaauguacagacaacgccgggcaccuucaagacuccugaaggcgaaguuggagccauagcucuagauuucaaacccggcacaucuggaucucccauugugaacagagagggaaagauagugggucuguauggaaauggaguggugacaacaaguggaaccuacgucagugccauugcccaagcuaaaacaucacaggaagggccucuaccagagauugaggacgagguguuuaagaaaagaaacuuaacaauaauggaccugcacccaggaucagggaaaacaagaagauaccuuccagccauaguccgugaggccauaaaaaggaaacugcguacguuaaucuuggcucccacaagaguugucgccucugaaauggcagaggcacucaagggaaugccaauaagauaucagacaacagcagugaagagugaacacacaggaagggagauaguugaccucaugugccacgcuacuuuuaccaugcgucucuuauccccagugagaguucccaauuacaacaugauuaucauggaugaagcacauuuuaccgauccagcuagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggauuacugacuuuccagguaaaacagucugguuuguuccaagcauuaaaucgggaaaugacauugccaacuguuuaagaaagaacggaaaacggguaauccaauugagcagaaaaaccuuugacacugaguaccagaaaacaaaaaacaaugacugggacuauguugucacaacagacauuucugaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccuuuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcgaccucgcugguuggacgccagaacauacucugauccauuggcccugcgcgaguuuaaagaguucgcagcaggaagaagaagugucucaggugaccuaauauuggaaauagggaaacuuccacaacauuugacgcuaagagcccagaaugcucuggacaacuuggucauguugcacaauuccgaacaaggaggaaaagccuacagacaugcuauggaggaacuaccagacaccauagaaacauugaugcuucuagcuuugauagcuguguugacugguggagugacgcuguucuuccuaucaggaaaaggucuagggaaaacauccauuggcuugcucugugugacggccucaagcgcacuguuauggauggccaguguggagccccauuggauagcggccuccaucauacuagaguucuuuuugauggugcugcucauuccagaaccagacagacagcgcacuccacaggacaaccaguuagcauauguggugauagguuuguuauucaugauacugacaguggcagccaaugagaugggauuauuggaaaccacaaaaaaagaccuggggauuggcuauguagccgccgaaaaccaccaacaugcuacaaugcuggacguagaccuacacccagcuucagccuggacccucuaugcaguagccacaacaguuaucacucccaugaugagacacacaauugaaaauacaacggcaaacauuucccugacagccauugcaaaucaggcagccauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacaauagcaguguccauggcaaacaucuucaggggaaguuaucuagcaggagcaggucuggcuuucucauuaaugaaaucuuuaggaggagguaggagagguacgggagcucaaggggaaacauugggagagaaauggaaaagacaguuaaaccaacugagcaagucagaauucaacaccuacaaaaggagugggauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaaguuacugaagugaagggauacacaaaaggaggaccuggacaugaggaaccuaucccaauggcgaccuauggauggaaccuagugaagcuacacucuggaaaggauguauuuuuuaugccaccugagaaaugugacacccuucugugugauauuggugaguccucuccgaauccaacuauagaagaaggaagaacguuacguguucuaaaaaugguggaaccauggcucagaggaaaccaauucugcauaaaaauccuaaauccuuacaugccaagugugguagaaacucuggagcaaaugcaaagaaaacacggagggaugcuagugcgaaacccacucucaagaaauucuacccaugaaauguauuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugacugauaccacacccuuuggacaacagagaguguuuaaagagaaaguugacacgcgcacaccaagagcaaaacgaggcacaacacagaucauggaggugacagccaagugguuaugggguuuccuuucuagaaacaaaaaacccagaaucugcacaagagaggaguucacaagaaagguuaggucaaacgcggcaauaggagcaguguucguugaugaaaaccaauggaacucagcaaaagaagcaguggaagacgaaagguuuugggaucuugugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaagcccuugguuucaugaaugaagaucacugguuuaguagagagaauucacucaguggaguggaaggagaaggacugcacaaacuuggauacauacucagagacauaucaaagauuccggggggaaauauguaugcagaugauacagccggaugggacacaagaauaacagaggaugaucuucagaaugaggcuaaaaucacugacaucauggagccugaacaugcucuauuggcuacgucaauuuuuaagcugacuuaucaaaacaagguggugagggugcaaagaccagcaaaaaauggaaccgugauggauguuauauccagacgugaucagagaggaaguggacaggucggaacuuauggcuuaaauacuuucaccaauauggagguccaacuaauaagacaaauggaaucugaaggaaucuuuuuacccagcgaauuggaaacccccaaccuagcugagagggcucuugacugguuagaaaaacauggcgccgaaaggcugaaacgaauggcaaucagcggagaugauugcguggugaaaccaauugacgacagguucgcaacagccuuaacagcucugaaugacaugggaaaaguaagaaaagacauaccgcagugggaaccuucgaaaggauggaaugauuggcagcaagugccuuuuuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuagcggcuaacgcuaucugcucagccgucccaguugauugggucccagccagccgcacaaccuggucaauccaugcccaccaccaauggaugacaacagaagacauguuaucaguguggaauagaguuuggauagaggaaaacccauggauggaggacaaaacucauguauccaguugggaagaaguuccauaccuaggaaaaagggaagaccaaugguguggaucccugauaggcuugacagcgagggccaccugggccaccaacauacaaguagccauaaaccaagugagaagacucaucgggaaugagaauuauuuagauuacaugacaucaaugaagagauucaagaaugagagugaucccgaaggagcacucugguaa

SEQ ID NO: 6241 - RNA, 9879 nt, Artificial Sequence
  derived and/or modified CDS sequence (wt) from DENV-1__KC692515__SS-prME
uccgugaccaugcuccucaugcugcugcccacagcccuggcguuucauuugaccacacgagggggagagccacacaugauaguuaguaagcaggaaagaggaaagucacucuuguuuaagaccucugcgggcgucaauaugugcacccucauugcgauggacuugggagaguuaugugaggacacaaugaccuacaaaugcccccgaaucacugaggcggaaccagaugacguugacugcuggugcaaugccacagacacaugggugaccuaugggacgugcucucaaaccggcgaacaccgacgagagaaacguuccguggcacuggccccacacgugggacuuggucuagaaacaagaaccgaaacauggauguccucugaaggcgccuggaaacaaauacaaagaguggaaacuugggcuuugagacacccaggauucacggugauagcccuuuuuuuagcgcaugcuauagggacauccaucacucaaaaagggaucauuuucaucuugcugaugcuggugacaccaucaauggccaugcgaugcgugggaauaggcaacagagacuucguugaaggacugucaggagcaacguggguggacgugguauuggagcauggaagcugcgucaccaccauggcaaaaaauaaaccaacauuggacauugaacucuugaagacggaggucacgaacccugccgucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcugggguaauggcuguggacuauucggaaagggaagucuauugacgugugccaaguucaagugcgugacaaaacuagagggaaagauaguucaauaugaaaacuuaaaauauucagugauagucacuguccacacuggggaccagcaccaggugggaaacgagaccacagaacauggaacaauugcaaccauaacaccucaagcucccacgucggaaauacagcugacugacuacggagcccucacauuggacugcucaccuagaacagggcuggacuuuaaugagauggugcuauugacaaugaaagaaaaaucauggcuuguccacaaacaaugguuucuagacuuaccacugccauggacuucgggggcuucaacaucucaagagaccuggaacagacaagauuugcuggucacauucaagacagcucaugcaaaaaaacaggaaguagucguacugggaucacaggaaggagcaaugcacacagcguugacuggggcgacagaaauccagacgucaggaacgacaacaaucuucgcaggacaccugaaaugcagacuaaaaauggauaaacugaccuuaaaggggaugucauaugugaugugcacuggcucauuuaaguuagagaaggaaguggcugagacccagcauggaacuguccuagugcaggucaaauaugaaggaacagacgcgccaugcaagauccccuucucgacccaagaugagaaaggagugacccagaaugggagauugauaacagccaaucccauaguuacugacaaagaaaaaccagucaacauugagacagaaccaccuuuuggugagagcuacaucgugguaggggcaggcggaaaagcuuugaaacuaagcugguucaagagaggaagcagcauagggaaaauguucgaagcaaccgcccgaggagcacgaaggauggcuauccugggagacaccgcaugggacuucgguucuauaggaggaguguuuacaucugugggaaaauugguacaccagguuuuuggaaccgcauaugggguucuguuuagcgguguuucuuggaccaugaaaauaggaauagggauucugcugacaugguugggauuaaauucaaggagcacgucacuuucgaugacgugcauugcaguuggcauggucacacuguaccuaggagucaugguucaagcggauucgggauguguaaucaacuggaagggcagagaacuuaaauguggaaguggcauuuuugucacuaaugaaguccacacuuggacagagcaauacaaauuccaggcugacuccccaaaaagacugucagcagccauuggaaaggcaugggaggagggcguauguggaauucgaucagccacgcgucuugagaacaucauguggaagcaaauaucaaaugaauugaaccacauucuacuugagaaugacaugaaauucacagugguuguaggagaugccaacggaauuuuggcccaaggaaaaaaaaugauuaggccacaaccuauggaacacaaauacucauggaaaagcuggggaaaagcuaaaaucauaggagcagacauacaaaauaccaccuucaucaucgacggcccagacaccccagaaugucccgauggccaaagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaaugaaaccuggaagcuggcgagagccuccuucauagaagucaagacaugcaccuggccgaaaucucacacucuauggagcaauggagucuuggaaagugaaaugauaaucccaaagauauuuggaggaccaauaucucagcacaacuacagaccaggguauuucacacaaacagcagggccauggcaccuagguaaguuggaacuggauuuugacuugugugaagguaccacaguuguuguggaugaacauuguggaaaucgagguccaucucucagaaccacaacagucacaggaaagauaauccaugaaugguguugcagauccugcacgcuaccccccuuacguuucagaggagaagacggguguugguauggcauggaaaucagaccaguaaaggagaaggaggagaaucuagucaggucaauggucucugcagggucaggagaaguggauaguuuuucauuaggaauacuaugcgugucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuccgcagacuaacauccagagaaguccuucuccucacgauuggauuaagccugguggcauccguggagcuaccaaauucuuuggaggagcuaggggauggacuugcaauggguaucaugauguuaaaauuguugacugaauuucagccacaccaguuauggaccaccuuauugucucugacauuugucaaaacaacucucucacuggauuaugcauggaaaacaacggcuaugguacugucuaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaagcucacuccucaaaaaugaugugccguuggccgggccacuaauagcuggaggcaugcuaauagcauguuaugucauauccggaagcucagccgauuuaucauuggagaaagcggcugaaguauccugggaacaagaagcagaacacuccggugccucacacaacauauuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccagcccuccggaaguggaaagagcaguucuugaugauggcaucuauagaaucuugcaaagaggacuguuggggaggucccaaguaggagugggagucuuccaagacggcguguuccacacaauguggcacguuaccaggggagcuguccuuauguaccaagggaagagacuggaaccaagcugggccagugucaaaaaggaccugaucucauauggaggagguuggagguuccaaggaucauggaacacaggagaagaagugcaggugauagcuguugaaccaggaaaaaaccccaaaaauguacagacaacgccgggcaccuucaagacuccugaaggcgaaguuggagccauagcucuagauuucaaacccggcacaucuggaucucccauugugaacagagaggaaaaaauagugggucuguauggaaauggaguggugacaacaaguggaaccuacgucagugccauugcccaagcuaaagcaucacaggaagggccucuaccagagauugaggacgagguguuuaagaaaagaaacuuaacaauaauggaccugcacccaggaucagggaaaacaagaagauaucuuccagccauaguccgugaggccauaaaaaggaaacugcguacguuaaucuuggcucccacaagaguugucgccucugaaauggcagaggcacucaagggaaugccaauaagauaucagacaacagcagugaagagugaacacacaggaagggagauaguugaccucaugugccacgcuacuuuuaccaugcgucucuuauccccagugagaguucccaauuacaacaugauuauuauggaugaagcacauuuuaccgauccagcuagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggauuacugacuuuccagguaaaacagucugguuuguuccaagcauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuucugaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccuuuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcgaccucgcugguuggacgccagaacauacucugauccauuggcccugcgcgaguuuaaagaguucgcagcaggaagaagaagugucucaggugaccuaauauuggaaauagggaaacuuccacaacauuugacgcuaagagcccagaaugcucuggacaacuuggucauguugcacaauuccgaacaaggaggaaaagccuacagacaugcuauggaggaacugccagacaccauagaaacguugaugcuucuagcuuugauagcuguguugacugguggagugacgcuguucuuccuaucaggaaaaggucuagggaaaacauccaucggcuugcucugugugacggccucaagugcacugcuauggauggccaguguggagccccauuggauagcggccuccaucauacuagaguucuuuuugauggugcugcucauuccagaaccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacauucuacaaugcuggacguagaccuacacccagcuucagccuggacccucuaugcaguagccacaacaguuaucacucccaugaugagacacacaauugaaaauacaacggcaaacauuucccugacagccauugcaaaucaggcagccauauugaugggacuugacaagggauggccaauaucgaagauggacauaggaguuccacuucucgccuuagggugcuauucccaggugaacccauugacacugacagcggcgguguugauguuaguggcucauuaugcuauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacaauagcaguguccauggcaaauaucuucaggggaaguuaucuagcaggagcaggucuggcuuucucauuaaugaaaucuuuaggaggagguaggagagguacgggagcucaaggggaaacauugggagagaaauggaaaagacaguuaaaccaacugagcaagucagaauucaacacuuacaaaaggagugggauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaaguuacugaagugaagggauacacaaaaggaggaccuggacaugaggaaccuaucccaauggcgaccuauggauggaaccuaguaaagcuacacucuggaaaggauguauuuuuuaugccaccugagaaaugugacacccuucugugugauauuggugaguccuccccgaauccaacuauagaagaaggaagaacguuacguguucuaaaaaugguggaaccauggcucagaggaaaccaauucugcauaaaaauccuaaauccuuacaugccaagugugguagaaacucuggagcaaaugcaaagaaaacauggagggaugcuagugcgaaacccacucucaagaaauucuacccaugaaauguauuggguuucauguggaacaggaaacauugugucggcagugaacaugacauccagaaugcuacugaaccgauucacaauggcucacaggaagccaacauaugaaagagacguggacuuaggcgcuggaacaagacauguggcaguggaaccagagguagccaaccuagauaucauuggccagaggauagagaauauaaaaaaugaacacaggucaacauggcauuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugacugauaccacacccuuuggacaacagagaguguuuaaagagaaaguugacacgcgcacaccaagagcaaaacgaggcacaacacagauuauggaggugacagccaagugguuaugggguuuccuuuccagaaacaaaaaacccagaaucugcacaagagaggaguucacaagaaagguuaggucaaacgcggcaauaggagcaguguucguugaugaaaaccaauggaacucagcaaaagaagcaguggaagacgaaagguuuugggaucuugugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaagcccuugguuucaugaaugaagaucacugguuuaguagagagaauucacucaguggaguggaaggagaaggacugcacaaacuuggauacauacucagagacauaucaaagauuccggggggaaacauguaugcagaugauacagccggaugggacacaagaauaacagaggaugaucuucagaaugaggcuaaaaucacugacaucauggagccugaacaugcucuauuggcuacgucaauuuuuaagcugacuuaucaaaacaagguggugagggugcaaagaccagcaaaaaauggaaccgugauggauguuauauccagacgugaucagagaggaaguggacaggucggaacuuauggcuuaaauacuuucaccaauauggagguccaacuaauaagacaaauggaaucugaaggaaucuuuuuacccagcgaauuggaaaccccaaaccuagcugagagggcucuugacugguuagaaaaacauggcgccgaaaggcugaaacgaauggcaaucagcggagaugauugcguggugaaaccaauugacgacagguucgcaacagccuuaacagcucugaaugacaugggaaaaguaagaaaagacauaccgcagugggaaccuucgaaaggauggaaugauuggcagcaagugccuuuuuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuagcggcuaacgcuaucugcucagccgucccaguugauugggucccagccagccgcacaaccuggucaauccaugcccaccaccaauggaugacaacagaagacauguuaucaguguggaauagaguuuggauagaggaaaacccauggauggaggacaaaacucauguauccaguugggaagaaguuccauaccuaggaaaaagggaagaccaaugguguggaucccugauaggcuugacagcgagggccaccugggccaccaacauacaaguagccauaaaccaagugagaaggcucaucgggaaugagaauuauuuagauuacaugacaucaaugaagagauucaagaaugagagugaucccgaaggagcacucugguaa

SEQ ID NO: 6242 - RNA, 9879 nt, Artificial Sequence
  derived and/or modified CDS sequence (wt) from DENV-1__KC692516__SS-prME
uccgugaccaugcuccucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagagaaacguuccguggcacuggccccacauguaggacuuggucuagaaacaagaaccgaaacauggauguccucugaaggcgccuggaaacaaauacaaagaguggagacuugggcuuugagacacccaggauucacggugauagcuuuuuuuuuagcacaugcuauaggaacauccaucacucagaaagggaucaucuucauccugcugaugcuggugacaccaucaauggccaugcgaugcgugggaauaggcaacagagacuucguugaaggacugucaggagcaacguggguggacgugguauuggagcauggaagcugcgucaccaccauggcaaaaaauaaaccaacauuggacauugaacucuugaagacggaggucacgaacccugccgucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcuggggcaauggcugcggacuauucggaaagggaagucuacugacgugugccaaguucaagugugugacaaaacuagaaggaaagauaguucaauaugaaaacuuaaaauacucagugauagucacuguccacacuggggaccagcaccaggugggaaacgagaccacagaacauggaacaauugcaaccauaacaccacaagcuccgacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccauggaccucgggggcuucaacaucucaggagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuucgcaggacaccugaaaugcagacuaaaaauggauaaacugaccuuaaaggggaugucauaugugaugugcacaggcucauucaagcuagagaaggaaguggcugagacccagcauggaacuguucuagugcaggucaaauacgaaggaacagacgcgccaugcaagauccccuuuucgacccaagaugagaaaggagugacccagaaugggagauugauaacagccaaucccauaguuacugacaaagaaaaaccagucaacauugagacagaaccaccuuuuggugagagcuacaucgugguaggggcaggcgaaaaagcuuugaaacuaagcugguucaagagaggaagcagcauagggaaaauguucgaagcaaccgcccgaggagcacgaaggauggcuauccugggagacaccgcaugggacuucgguucuauaggaggaguguuuacaucugugggaaaguugguacaccagguuuuuggaaccgcauaugggguucuguucagcgguguuucuuggaccaugaaaauaggaauagggauucugcugacaugguugggauuaaauucaaggagcacgucacuuucgaugacgugcauugcaguuggcauggucacacuguaccuaggagucaugguucaagcagacucgggauguguaaucaacuggaagggcagagaacuuaaauguggaaguggcauuuuugucacuaaugaaguucacacuuggacagagcaauacaaauuccaggcugacuccccaaaaagacugucagcagccauuggaaaggcaugggaggagggcguguguggaauucgaucagccacgcgucuugagaacaucauguggaagcaaauaucaaaugaacugaaccacauucuacuugaaaaugacaugaaauucacagugguuguaggagacgcuaacggaauuuuggcccaagggaaaaaaaugauuaggccacaacccauggaacacaaauacucauggaaaagcuggggaaaagcuaaaaucauaggagcagacauacaaaauaccaccuucaucaucgacggcccagacaccccagaaugucccgauggccaaagagcauggaacauuugggaaguugaggacuauggguuuggaauuuucacgacaaacauauggcugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuacagaccaggguauuucacacaaacagcagggccauggcaccuagguaaguuggaacuggauuuugacuugugugaagguaccacaguuguuguggaugaacauuguggaaaucgagguccaucucucagaacuacaacagucacaggaaagauaauccaugaaugguguugcagauccugcacgcuaccccccuuacguuucagaggagaagacggauguugguauggcauggaaaucagaccaguaaaggagaaggaggagaaucuaguuaggucaauggucucugcagggucaggagaaguggacaauuuuucauuaggaauacuaugcguaucaauaaugauugaagaagugaugagauccagauggaguagaaagaugcugaugacuggaacacuggcuguuuuccuccuucuuauaaugggacaacugacauggaaugaucugauuagguuaugcaucaugguuggagccaaugcuucagacaggauggggaugggaacaacguaccuagccuugauggcuacuuucaaaaugagaccaauguucgcuguugggcuauuauuccgcagacuaacauccagagaaguucuucuccucacgauuggauuaagccugguggcauccuuggagcuaccaaauucuuuggaggagcuaggggauggacuugcaauggguaucaugauguuaaaauuguugacugaauuucagccacaccaguuauggaccaccuuacugucucugacauuugucaaaacaacucucucauuggauuaugcauggaaaacaacggcuaugguacugucuaucguaucucucuuuccuuuaugccugucuacgaccucccaaaaaacaacauggcuuccggugcuguuaggaucuuuuggaugcaaaccauuaaccauguuucuuauaacagaaaacaaaauuuggggaaggaaaaguuggccccucaaugaaggaauuauggcuauuggaauagucagcauucuacuaaguucacuccucaaaaaugaugugccguuggccggcccacuaauagcuggaggcaugcuaauagcauguuaugucauauccggaagcucagcugauuuaucauuggagaaagcggcugaaguauccugggaacaagaagcagaacacuccggugccucacacaacauauuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcaguucuugaugauggcaucuauagaaucuugcaaagaggacuguugggcaggucccaaguaggagugggagucuuccaagacggcguguuccacacaauguggcacgucaccaggggagcuguccuuauguaccaagggaagaggcuggaaccaagcugggccugugucaaaaaggacuugaucucauauggaggagguuggagguuucaaggauuauggaacacgggagaagaagugcaggugauagcuguugaaccaggaaaaaaccccaaaaauguacagacaacgccggguaccuucaagacuccugaaggcgaaguuggagccauagcucuagauuucaaacccggcacaucuggaucucccauugugaacagagagggaaaaauagugggucuuuauggaaauggaguggugacaacaagcggaaccuacgucagugccauugcccaagcuaaagcaucacaggaagggccucuaccagagaucgaggacgagguguuuaagaaaagaaacuuaacaauaauggaccugcacccaggaucagggaaaacaagaagauaucuuccagccauaguccgugaggccauaaaaaggaaacugcguacguuaauccuggcucccacaagaguugucgccucugaaauggcagaggcacucaagggaaugccaauaagauaucagacgacagcagugaagagugaacacacaggaagggagauaguugaccucaugugccacgcuacuuuuaccaugcgucucuuauccccagugagaguucccaauuacaacaugauuauuauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggauuacugauuuuccaggcaaaacagucugguuuguuccaagcauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagauggcccagagcgugucauucuagccggaccgaugccagugacuguggccagugcugcccagaggagaggaagaauuggaaggaaccaaaacaaggaaggugaucaguauguuuauaugggacagccuuuaaauaaugaugaggaucacgcucauuggacagaagcaaaaaugcuccuugacaauauaaacacaccagaagggaucaucccagcccuuuuugagccagagagagaaaagagugcagcaauagauggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcgaccucgcugguuggaugccagaacauacucugauccacuggcccugcgcgaguuuaaagaguuugcagcaggaagaagaagugucucaggugaucugauauuggaaauagggaaacuuccacaacauuugacgcuaagagcccagaaugcccuggacaacuuggucauguugcacaauuccgaacaaggaggaaaagccuacagacaugcuauggaggaacuaccagacaccauagaaacauugaugcuucuagcuuugauagcuguguugacugguggagugacgcuguucuuccuaucaggaaaagguuuagggaaaacauccauuggcuugcucugugugacggccucaagugcacuguuauggauggccaguguggagccccauuggauagcggccuccaucauacuagaguucuuuuuaauggugcugcucauuccagagccagacagacagcgcacuccacaggacaaccagcuagcauauguggugauaggcuuguuauucaugauacuuacaguggcagccaaugagaugggauuauuggaaaccacaaagaaagaccuggggauuggccauguagccgccgaaaaccaccaacaugcuacaaugcuggacguagaccuacauccagcuucagccuggacccucuaugcaguagccacaacaguuaucacucccaugaugagacacacaauugaaaauacaacggcaaacauuucccugacagccauugcaaaucaggcagcuauauugaugggacuugacaaaggauggccaauaucgaagauggacauaggaguuccacuucucgccuuagggugcuauucccaggugaacccauugacgcugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccagauaauguuacugauacuuuguacaucacagauccucuugaugcggaccacaugggccuugugugaauccaucacacuggcuacuggaccccugacuacucucugggagggaucuccaggaaaauucuggaauaccacgauagcaguguccauggcaaacaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugagcaagucagaauucaacaccuacaaaaggagugggauuauggagguggacagauccgaagccaaagagggacugaaaagaggagaaacaaccaaacaugcagugucgagaggaacagccaaacugaggugguuuguggagaggaaccucgugaaaccagaaggaaaagucauagaccucgguuguggaagagguggcuggucauauuauugugcugggcugaagaaaguuacugaagugaagggauacacaaaaggaggaccuggacaugaggagccuaucccaauggcgaccuauggauggaaccuaguaaagcuacacucuggaaaagauguauuuuucaugccaccugagaaaugugacacccuucugugugauauuggugaguccucuccaaauccaaccauagaagaaggaagaacguuacguguucuaaaaaugguggaaccauggcucagaggaaaccaauucugcauaaaaaucuuaaauccuuacaugccaagugugguagaaacucuggagcaaaugcaaagaaaacauggagggaugcuagugcgaaacccacucucaagaaauucuacccaugaaauguauuggguuucacgcggaacaggaaacauugugucggcagugaacaugacauccagaaugcuacugaaccgauucacaauggcucacaggaagccaacauaugaaagagauguggacuuaggcgcuggaacaagacauguggcaguggaaccagagguagccaaccuagauaucauuggccagaggauagagaauauaaaaaaugaacacaagucaacauggcauuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugacugauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcugcaauaggagcaguguucguugacgaaaaacaauggaacucagcaaaagaagcaguggaagacgaaagguuuugggaucucgugcacagagagagggagcuucauaaacagggaaaaugugccacgugugucuacaacaugauggggaagagagagaaaaaacuaggagaguuuggaaaggcaaaaggaagucgugcaauaugguacauguggcugggagcacgcuuucuggaguucgaagcccuugguuucaugaaugaagaucacugguuuaguagagagaauucacucaguggaguggaaggagaaggacugcacaaacucggauacauacucagagacauaucaaagauuccggggggaaacauguaugcagaugauacagccggaugggacacaagaauaacagaggaugaucuucagaaugaggcuaaaaucacugacaucauggagccugaacaugcucuauuggcuacgucaauuuuuaagcugacuuaucaaaacaagguggugagggugcaaagaccagcaaaaaauggaaccgugauggauguuauauccagacgugaccagagaggaaguggacaggucggaacuuauggcuuaaauacuuucaccaauauggagguccaacuaauaagacaaauggagucugaagggaucuuuuuacccagcgaauuggaaacccccaaccuagcugagagaguucuugacugguuagaaaaacauggcgccgaaaggcugaaacgaauggcaaucagcggagaugauugcguggugaaaccaauugacgacagguucgcaacagccuuaacagcucugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaucugagacuagcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccaccaacauacaaguagccauaaaccaagugagaaggcucaucgggaaugagaauuaucuagauuacaugacaucaaugaagagauucaagaacgagagugaucccgaaggagcacucugguaa

SEQ ID NO: 6243 - RNA, 9879 nt, Artificial Sequence
  derived and/or modified CDS sequence (wt) from DENV-1__KC692517__SS-prME
uccgugaccaugcuccucaugcugcugcccacagcccuggcguuccauuugaccacacgagggggagagccacacaugauaguuaguaagcaggaaagaggaaagucacucuuguuuaagaccucugcaggagucaauaugugcacucucauugcgauggacuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagaccugggccuugagacauccaggauucacggugauagcccuuuuuuuagcacaugcuauaggaacauccaucacccagaaagggaucauuuucaucuugcugaugcuggugacaccaucaauggccaugcgaugcgugggaauaggcaacagagacuucguugaaggacugucaggagcaacguggguggacgugguauuggagcauggaagcugcgucaccaccauggcaaaaaauaaaccaacauuggacauugaacucuugaagacggaggucacgaacccugccgucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcugggguaacggcugcggacuauucggaaagggaagucuauugacgugugccaaguucaagugugugacaaaacuagaaggaaagauaguucaauaugagaacuuaaaauacucagugauaguuacuguccacacuggggaccagcaccaggugggaaacgagaccauagaacauggaacaauugcaaccauaacaccucaagcuccuacgucggaaauacagcugaccgacuacggagcccuuacauuggacugcucaccuagaacagggcuggacuuuaaugagauggugcuauuaacaaugaaagaaaaaucauggcuuguccacaaacaaugguuucuggacuuaccacugccauggacuucgggggcuucaacaccccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuucgcaggacaccugaaaugcagacuaaaaauggauaaacugacuuuaaaagggaugucauaugugaugugcacaggcucauuuaagcuagagaaggaaguggcugagacccagcauggaacuguucuagugcaggucaaauacgaaggaacagacgcgccaugcaagauccccuucucgacucaagaugagaaaggagugacccagaaugggagauugauaacagccaaucccauaguuacugacaaagaaaaaucagucaacauugagacagaaccaccuuuuggugagagcuacaucgugguagggguaggcgaaaaagcuuugaaacuaagcugguucaagaaaggaagcaguauagggaaaauguucgaagcaaccgcccgaggagcacgaaggauggcuauccugggagacaccgcaugggacuucgguucuauaggaggaguguuuacaucugugggaaaauugguacaccagguuuuuggaaccgcauaugggguucuguucagcgguguuucuuggaccaugaaaauaggaauagggauucuguugacaugguugggauuaaauucaaggagcacgucacuuucgaugacgugcauugcaguuggcauggucacacuguaccuaggagucaugguucaagcggacucgggauguguaaucaacuggaagggcagagaacuuaaauguggaaguggcauuuuugucacuaaugaaguccacacuuggacagagcaauacaaauuccaggcugacuccccaaaaagacugucagcagccauuggaaaggcuugggaggagggaguguguggaauucgaucagccacgcgucuugagaacaucauguggaagcaaauaucaaaugaauugaaccacauucuacuugaaaaugacaugaaauucacagugguuguaggagaugcuaacggaauuuuggcccaaggaaaaaaaaugauuaggccacaacccauggaacacaaauacucauggaaaagcuggggaaaagcuaaaaucauaggagcagacauacaaaauaccaccuuuaucaucgacggcccagacaccccagaaugucccgauggccaaagagcauggaacauuugggaaguugaggacuauggguuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaaugaaaccuggaagcuggcgagagccuccuucauagaagucaagacaugcaccuggccgaaaucucacacucuauggagcaauggagucuuggaaagugaaaugauaaucccaaagauauauggaggaccaauaucucagcacaacuacaggccaggguauuucacacaaacagcagggccauggcaccuagguaaguuggaacuggauuuugacuugugugaaggcaccacaguuguuguggaugaacauuguggaaaucgagguccaucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguaaggucaauggucucugcagggucaggagaaguggacagcuucucauugggaauacuaugcguaucaauaaugauugaagaggugaugagauccagauggaguagaaagaugcugaugacuggaacauuggcuguuuuccuccuucuuauaaugggacagcugacauggaaugaucugauuagguuaugcaucaugguuggagcuaaugcuucagacaggauggggaugggaacaacguaccuagccuugauggcuacuuucaaaaugagaccaauguucgcuguugggcuauuauuccgcagauuaacauccagagaaguucuucuccucacgauuggauuaagccugguggcauccguggagcuaccaaauucuuuggaggagcuaggggauggacuugcaauggguaucaugaugcuaaaauuguugacugaauuucagccacaccaguuauggaccaccuuacugucuuugacauuugucaaaacaacucucucauuggauuaugcauggaaaacaacggccaugguauugucuaucguaucucucuuuccuuuaugccugucuacgaccucccaaaaaacaacauggcuuccggugcuguuaggaucuuuuggaugcaacccauuaaccauguuucuuauaacagaaaacaaaauuuggggaaggaaaaguuggccccucaaugaaggaauuauggcuauuggaauagucagcauucuacuaaguucacuccucaaaaaugaugugccguuggccggcccacuaauagcuggaggcaugcuaauagcauguuaugucauauccggaagcucagccgauuuaucauuggagaaagcggcugagguguccugggaacaagaagcagaacacuccggugccucacacaacauauuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguauuuuuggcagaaaaagaaacagagaucaggaguguuaugggacacacccagcccuccgaaaguggaaagagcaguucuugaugauggcaucuacagaaucuugcaaagaggacuguugggcaggucccaaguaggagugggagucuuccaagauggcguguuccacacaauguggcacgucaccaggggagcuguccuuauguaccaagggaagaggcuggaaccaagcugggccagugucaaaaaggacuugaucucauauggaggagguuggagauuucaaggaucauggaauacgggagaagaagugcaggugauagcuguugaaccaggaaaaaaccccaaaaauguacagacaacgccgggcaccuucaagacuccugaaggcgaaguuggagccauagcucuagauuucaaacccggcacaucuggaucucccauugugaacagagagggaaaaauagugggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcacccaggaucaggaaaaacaagaagauaucuuccagccauaguccgugaggccauaaaaaggaaacugcguacguuaaucuuggcucccacaagaguugucgccucugaaauggcagaggcacucaagggaaugccaauaagauaucagacaacagcagugaagagugaacacacaggaagggagauaguugaccuuaugugccacgcuacuuuuaccaugcgucucuuauccccagugagaguucccaauuacaacaugauuauuauggaugaagcacauuuuaccgauccagccagcauagcggccagaggauacaucucgacccgaguggguaugggugaagcagcugcgaucuuuaugacagccacucccccaggaucgguggaggccuuuccacagagcaaugcagucauccaagaugaggaaagagacauuccugagagaucauggaacucaggcuacgacuggauuacugauuuuccagguaaaacagucugguuuguuccaagcauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuucugaaaugggggcaaauuuccgggccgauaggguaauagacccaaggcggugcuugaaaccgguaauauuaaaagaugguccagagcgcgucauucuagccggaccgaugccagugacuguggccagugcugcccagagaagaggaagaauuggaaggaaccaaaacaaggaaggugaucaguauguuuacaugggacagccuuuaaauaaugaugaggaucacgcucauuggacagaagcaaaaaugcuccuugacaacauaaacacaccagaagggaucaucccagcccucuuugagccagagagagaaaagagugcagcaauagacggggaguacagacugcggggagaagcaaggaaaacguuuguggagcucaugagaagaggagaucuaccaguuugguuauccuacaaaguagccucagaagguuuucaguacuccgacagaagguggugcuuugauggggaaaggaacaaccagguguuagaggagaacauggacguggagaucuggacaaaggaaggagaaagaaagaaauugcgaccucgcugguuggaugccagaacauacucugauccacuggcucugcgcgaguuuaaagaguuugcagcaggaagaagaagugucucaggugaccuaauauuggaaauagggaaacuuccacaacauuugacgcuaagagcccagaaugcucuggacaacuuggucauguugcacaauuccgaacaaggaggaaaagccuacagacaugcuauggaggaauuaccagacaccauagaaacauugaugcuuuuagcuuugauagcuguguugacugguggagugacgcuauucuuccuaucaggaaaaggcuuagggaaaacaucuauuggcuuacucugugugacggccucaagcgcacuguuauggauggccaguguggagccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggcuauguagccgccgaaaaccaccaacacgcuacaaugcuggacguagaccuacgcccagcuucagccuggacacucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccagggaaauucuggaauaccacgauagcaguguccauggcaaacaucuucaggggaaguuaucuagcaggagcaggucuggcuuuuucauuaaugaaaucuuuaggaggagguaggagaggcacgggagcucaaggggaaacacugggagagaaauggaaaagacaguuaaaccaacugagcaagucagaauucaacaccuacaaaaggagugggauuauggagguggacagaucugaagccaaagagggacugaaaagaggagaaacaaccaaacaugcagugucgagaggaacagccaaacugaggugguuuguggagaggaaccucgugaaaccagaaggaaaagucauagaccucgguuguggaagagguggcuggucauauuauugugcugggcugaagaaaguuacugaagugaaaggauacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacgcuacguguucuaaaaaugguggaaccauggcucagaggaaaccaauucugcauaaaaauccuaaauccuuacaugccaagugugguagaaacucuggaacaaaugcaaagaaaacauggagggaugcuagugcgaaacccacucucaagaaauucuacccaugaaauguauuggguuucauguggaacaggaaacauugugucggcagugaacaugacauccagaauguuacugaaccgauucacgauggcucacaggaagccaacauaugaaagagacguggacuuaggcgcuggaacaagacauguggcaguggaaccagagguagccaaccuagauauuauuggccagaggauagagaauauaaaaaaugaacacaagucaacauggcauuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugacugauaccacacccuuuggacaacagagaguguuuaaagagaaaguugacacgcguacaccaagagcaaaacgaggcacaacacaaauuauggaggugacagccaagugguuaugggguuuccuuuccagaaacaaaaaacccagaaucugcacaagagaggaguucacaagaaaggucaggucaaacgcggcaauaggagcaguguucguugaugaaaaccaauggaacucggcaaaagaagcaguggaagacgaaagguuuugggaucucgugcacagagagagggagcuucauaaacagggaaaaugugccacgugugucuacaacaugauggggaagagagagaagaaauuaggagaguuuggaaaggcaaaaggaagucgugcaauaugguauauguggcugggagcacgcuuucuggaguucgaagcccuugguuucaugaaugaagaucacugguuuaguagagagaauucacucaguggaguggaaggagaaggacugcacaaacuuggauacauacucagagacauaucaaagauuccagggggaaauauguaugcagaugauacagccggaugggacacaagaauaacagaggaugaucuucagaaugaggcuaaaaucacugacaucauggagccugaacaugcucuauuggccacgucaauuuuuaagcugacuuaucaaaacaagguggugagggugcaaagaccagcaaaaaauggaaccgugauggauguuauauccagacgugaccagagaggaaguggacaggucggaacuuauggcuuaaauacuuucaccaauauggagguccaacuaguaagacaaauggagucugaaggaaucuuuuuacccagcgaauuggaaacccccaaccuagcugagagaguucuugacugguuggaaaaacauggcgucgaaaggcugaaacgaauggcaaucagcggagaugauugcguggugaaaccaauugacgacagguucgcaacagccuuaacagcucugaaugacaugggaaaaguaagaaaagacauaccgcagugggagccuucaaaaggauggaaugauuggcagcaagugccuuucuguucacaccauuuccaccagcugaucaugaaggaugggagggaaauaguggugccaugccgcaaccaagaugaacuugugggcagggcuagaguaucgcaaggcgccggauggagccugagagaaacugcuugccuaggcaagucauaugcacaaauguggcagcugauguacuuccacaggagagaccugagacuagcggcuaacgcuaucuguucagccgucccaguugauugggucccaaccagccgcacaaccuggucaauccaugcucaccaccaauggaugacaacagaagacauguugucaguguggaauaggguuuggauagaggaaaacccauggauggaggacaaaacccauguauccaguugggaagaaguuccauaccuagggaaaagggaagaucaauggugugggucccugauaggcuugacagcgagggcuaccugggcuacuaacauacaaguagccauaaaccaagugagaaggcucaucgggaaugagaauuaucuagauuacaugacaucaaugaagagauucaagaaugagagugauccugaaggagcacucugguaa

SEQ ID NO: 6244 - RNA, 9879 nt, Artificial Sequence
  derived and/or modified CDS sequence (wt) from DENV-1__KC762649__SS-prME
ucugugaccaugcuccuuaugcugaugccuacagcuuuggcguuccauuugacuacacgagggggagagccgcacaugauagucagcaagcaggaaagaggaaagucacuuuuguuuaagaccucagcaggugucaacaugugcacccuuauagcgauggauuugggagaguuaugugaggacacacugacuuacaaaugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccuccgaaggcgcuuggaaacagauacaaagaguggagacuugggcccugagacacccaggauucacggugauagcccuuuuccuagcacaugccauaggagcauccaucacccagaaagggauuaucuucauuuuguuaaugcuggucacaccauccauggccaugcgaugcgugggaauaggcagcagggacuucguggaaggacugucaggagcaacuuggguagauguggugcuggaacauggaaguugcgucacuaccauggcaaaagacaaaccaacauuggacauugaacuuuugaagacggaagucacaaacccugccguucugcgcaaacuaugcauugaagcuaaaauaucaaacaccaccaccgacucaagauguccaacacaaggagaagcuacacugguggaagaacaagacgcgaacuuugugugucgacgaacguuuguggacagaggcuggggcaauggcugugggcucuucggaaaaggaagccuuauaacgugugcuaaguucaagugugugucaaaacuggaaggaaaaauaguucaguaugaaaacuugaaauauucaguaauagucaccguccacacuggagaccagcaucaggugggaaaugaaagcacagaacaugggacaacugcaacuauaacaccucaagcucccacgacagaaauacaguugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagaaacuuggaacagacaagauuugcuggugacauuuaagacagcucaugcaaagaagcaggaaguagucguacuaggaucacaagaaggagcaaugcacacugcgcugaccggagcgacggaaauccaaacgucuggaacgacaacaauuuuugcaggacacuugaaauguagacuaaagauggacaaacugacucuaaaagggaugucauaugugaugugcacaggcucauucaagcuagagaaagaaguggcugagacccagcauggaaccguucuagugcagaucaaauacgaaggaacagaugcaccauguaagauuccuuuuucgacccaagaugaaaaaggaguaacccagaaugggagauugauaacagccaaccccauagucacugauaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagaucuuuggaacugcauauggaguuuuguucagcgguguuuccuggaccaugaaaauaggaauagggguucugcugacauggcuaggauuaaacucaaggagcacgucccuuucgaugacgugcauugcaguuggccuaguaacgcuauacuuaggagucaugguucaggcggauucaggauguguaauuaauuggaaagguagagaacucaaauguggaaguggcauuuuugucaccaaugaaguucacacuuggacagagcaauacaaauuucaagcugauuccccaaagagacuaucagcagccauugggaaggcaugggaggaggguguguguggaauucgaucagcaacucgucucgagaacaucauguggaagcaaauaucaaaugaauugaaccacaucuuacuugaaaaugacaugaaauucacagugguuguaggagauguugcugggaucuuggcucaagggaaaaaaaugauuaggccacaacccauggaacacaaauacucguggaaaagcuggggaaaggcuaaaaucauaggggcagauguacagaacaccaccuuuaucaucgacggcccaaacaccccagaaugcccugaugaucaaagagcauggaacauuugggaaguugaggauuauggauuuggaauuuucacgacaaacauauggcugaaauugcgugacuccuacacccaggugugugaccaccggcuaaugucagcugccaucaaggacagcaaggcaguucacgcugacaugggguacuggauagaaagugaaaagaacgagaccuggaagcuggcaagagccucuuucauagaagucaaaacauguaucuggccaaaaucucacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacggucguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagauccagauggaguaggaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguagggcuacuauuccgcagacuaacauccagagaaguucuucuucuaacaauuggauugagucuaguggcaucuguggaguuaccaaauuccuuggaggagcugggagauggacuugcaaugggcauuaugauuuuaaaauuauugacugacuuucaaucacaucagcugugggcuaccuugcuguccuugacauuuaucaaaacaacguuuuccuugcacuaugcauggaagacaauggcuaugguacugucaauuguaucucucuuccccuuaugccuguccacgaccucccaaaaaacaacauggcuuccggugcuguugggaucucuuggauguaaaccacuaaccauguuucuuauagcagaaaacaaaaucuggggaaggaaaaguuggccccucaaugaaggaaucauggcuguuggaauugucagcauccuacuaagcucacuccucaaaaaugaugugccgcuagcugggccacuaauagcuggaggcaugcuaauagcauguuauguuauaucuggaagcucagccgaucuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaaucaugcagagaggacuguugggcagaucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaucuuuaagaccccugaaggcgaaguuggagccauugcccuagauuuuaaacccggcacaucuggaucucccaucgugaacagagaagggaaaauaguaggucuuuauggaaauggaguagugacaacaaguggaaccuacgucagugccauagcucaagcuaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucuccugugagaguucccaauuacaacaugauuaucauggaugaagcacauuucaccgauccauccagcauagcggcuagaggguacauuucaacccgagugggcaugggugaagcagcugcgaucuucaugacagccacucccccaggaucaguggaggccuuuccacagagcaacgcaguuauccaagaugaggaaagagacauuccugagagaucauggaacucaggcuaugaguggaucacugacuucccaggcaaaacaguuugguuuguuccaagcauuaaaucaggaaaugauauugccaacugcuuaagaaagaaugggaaacgggugauucaauugagcagaaaaaccuuugacacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaguuggaaggaaccacaauaaggaaggugaucaguacaucuacaugggacagccuuuaaacaacgaugaagaucacgcucacuggacggaagcaaaaaugcuccuugauaauauaaacacaccagaagggauuaucccagcccucuucgagccggagagagaaaagagugcagcaauagacggggaauacagacugcggggugaagcaaggaaaacguuuguggagcucaugagaagaggagaucuaccugucuggcuauccuacaaaguugccucagaaggcuuccaguacucugauagaagauggugcuuugacggggaaaggaacaaccagguguuggaggagaacauggacguggagaucuggacaaaagaaggagaaagaaagaaacuacgaccccguuggcuggaugccagaacauacucagacccacuggcccugcgcgaguuuaaagaguuugcagcaggaagaagaagcgucucaggagaucuaauauuagaaauagggaaacuuccacaacacuugacgcaaagggcccagaaugccuuggacaaccugguuauguuacacaacuccgaacaaggaggaagagccuauagacaugcaauggaagaacugccagacaccauagaaacguugaugcuccuagcuuugauagcuguguuaacugguggagugacgcuguucuuccuaucaggaaggggcuuagggaaaacaucuaucggccuacucugcgugauggcuucaagcguacugcuauggauggccaguguagagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagccauauugaugggacuugacaaaggauggccaauaucgaagauggacauaggaguuccacuucucgccuuggggugcuauucccaagugaauccacugacgcugacagcggcgguauugaugcuaguggcucauuacgcuauaauuggaccuggacugcaagcaaaagcuacuagagaagcucaaaaaaggacagcggccggaauaaugaaaaauccaaccguugauggaaucguugcaauagauuuggacccugugguuuaugaugcgaaauuugagaaacaacuaggccaaauaaugcuguugauacuaugcacaucacagauccucuugaugcggacuacaugggccuugugcgaauccaucacacuggccacuggaccccugaccacgcucugggagggaucuccaggaaaauuuuggaacaccacgauagcgguuuccauggcaaacauuuucagaggaaguuaucuagcaggagcaggccuggccuucucauuaaugaaaucucuaggaggagguaggagaggcacgggagcccaaggggaaacacugggagagaaauggaaaagacagcuaaaucaacugagcaagucagaauucaacaccuauaaaaggagugggauuauggaaguggacagauccgaagccaaagagggacugaaaagaggggaaacaaccaaacaugcagugucgagaggaaccgcuaaauugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaagaaccaaucccaauggcgaccuauggauggaaccuaguaaagcugcacuccgggaaagacguauucuuuauaccaccugagaaaugugacacccucuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacauaugaaagagacguggaccuaggcgcuggaacaagacauguggcaguggaaccagagguagccaaccuagauaucauuggccagaggauagagaacauaaaacaugaacacaagucaacauggcauuaugaugaggacaauccauauaaaacaugggccuaucauggaucauaugaggucaagccaucaggaucagccucauccauggucaaugguguggugaaacugcucaccaaaccaugggaugucauccccauggucacacaaauagccaugacugacacuacacccuuuggacaacagaggguguuuaaagagaaaguugacacacgcacaccaaaagcaaaacgaggcacaacacaaaucauggaggugacagccaggugguuaugggguuuucuuucuagaaacaagaagccaagaauuuguacaagagaggaguuuacaagaaaaguuaggucaaacgcagccaucggagcaguguucguugacgaaaaucaauggaacucagcaaaagaagcaguggaagaugagcgguucugggaccuugugcacagagagagggagcuucacaaacagggaaaaugugccacguguguuuacaacaugauggggaagagagagaaaaagcuaggagaauuuggaaaggcaaaaggaagucgugcaauaugguacaugugguugggagcacgcuuucuagaguucgaagcucuugguuucaugaacgaagaccacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccaaaauuacugacaucauggaacccgaacaugcccuacuggcuaaggcaaucuucaagcuaaccuaccaaaauaaagugguaaggguacagagaccagcaaaaaauggaaccgugauggaugucauauccagacgugaccagagaggaaguggccaggucggaacuuauggcuuaaacacuuucaccaacauggaagcucagcugauaagacaaauggagucugagggaaucuuuucacccagugaauuagagaccccaaauuuagccgagagaguucucgacuggcuggaaaaauauggcgucgaaaggcuaaaaagaauggcaaucaguggagaugacugcguagugaaaccaauugaugauagguuugcaacagccuuaacagcucugaaugauaugggaaaaguaagaaaagauauaccacaaugggaacccucaaaaggauggaaugauuggcaacaagugccuuuuuguucacaccacuuccaccagcugauuaugaaggaugggagggaaauaguggugccaugccgcaaccaagaugaacuuguggguagagcuagaguaucacaaggugcuggauggagccugagagaaaccgcaugccuaggcaaaucauaugcacaaauguggcagcugauguacuuccacaggagagaccugagauuagccgcuaaugcuaucuguucagccguuccaguugauugggucccaaccagccguaccaccuggucgauccaugcccaucaccaauggaugacaacagaagacaugcugucaguguggaauaggguuuggauagaggaaaacccauggauggaggacaaaacccauauauccaguugggaagauguuccauauuuagggaaaagggaagaucaaugguguggaucccugauaggcuuaacagcaagggccaccugggccaccaacauacaaguggccauaaaccaagugagaagacuaauugggaaugagaauuaccuagauuacaugacaucaaugaagagauucaagaacgagagugaucccgaaggggcacucugguga

SEQ ID NO: 6245 - RNA, 9879 nt, Artificial Sequence
  derived and/or modified CDS sequence (wt) from DENV-1__KC762625__SS-prME
ucugugaccaugcuccuuaugcugaugccuacagcuuuggcguuccauuugacuacacgagggggagagccgcacaugauagucagcaagcaggaaagaggaaagucacuuuuguuuaagaccucagcaggugucaacaugugcacccuuauagcgauggauuugggagaguuaugugaggacacacugacuuacaaaugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccuccgaaggcgcuuggaaacagauacaaagaguggagacuugggcccugagacacccaggauucacggugauagcccuuuuccuagcacaugccauaggaacauccaucacccagaaagggauuaucuucauuuuguuaaugcuggucacaccauccauggccaugcgaugcgugggaauaggcagcagggacuucguggaaggacugucaggagcaacuuggguagauguggugcuggaacauggaaguugcgucacuaccauggcaaaagacaaaccaacauuggacauugaacuuuugaagacggaagucacaaacccugccguccugcgcaaacuaugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuuauaacgugugcuaaguucaagugugugucaaaacuggaaggaaaaauaguucaguaugaaaacuugaaauauucaguaauagucaccguccacacuggagaccagcaucaggugggaaaugaaagcacagaacaugggacaacugcaacuauaacaccucaagcucccacgacagaaauacaguugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagaaacuuggaacagacaagauuugcuggugacauuuaagacagcucaugcaaagaagcaggaaguagucguacuaggaucacaagaaggagcaaugcacacugcgcugaccggagcgacggaaauccaaacgucuggaacgacaacaauuuuugcaggacacuugaaauguagacuaaagauggacaaacugacucuaaaagggaugucauaugugaugugcacaggcucauucaagcuagagaaagaaguggcugagacccagcauggaaccguucuagugcagaucaaauacgaaggaacagaugcaccaugcaagauuccuuuuucgacccaagaugaaaaaggaguaacccagaaugggagauugauaacagccaaccccauagucacugauaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagaucuuuggaacugcauauggaguuuuguucagcgguguuuccuggaccaugaaaauaggaauagggguucugcugacauggcuaggauuaaacucaaggagcacgucccuuucgaugacgugcauugcaguuggccuaguaacgcuauacuuaggagucaugguucaggcggauucaggauguguaauuaauuggaaagguagagaacucaaauguggaaguggcauuuuugucaccaaugaaguucacacuuggacagagcaauacaaauuucaagcugauuccccaaagagacuaucagcagccauugggaaggcaugggaggaggguguguguggaauucgaucagcaacucgucucgagaacaucauguggaagcaaauaucaaaugaauugaaccacaucuuacuugaaaaugacaugaaauucacagugguuguaggagauguugcugggaucuuggcucaaggaaaaaaaaugauuaggccacaacccauggaacacaaauacucguggaaaagcuggggaaaggcuaaaaucauaggggcagauguacagaacaccaccuuuaucaucgacggcccaaacaccccagaaugcccugaugaucaaagagcauggaacauuugggaaguugaggauuauggauuuggaauuuucacgacaaacauauggcugaaauugcgugacuccuacacccaggugugugaccaccggcuaaugucagcugccaucaaggacagcaaggcaguucacgcugacaugggguacuggauagaaagugaaaagaacgagaccuggaagcuggcaagagccucuuucauagaagucaaaucauguaucuggccaaaaucucacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacggucguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagauccagauggaguaggaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuucaaaaugagaccaauguuugcuguagggcuacuauuccgcagacuaacauccagagaaguucuucuucuaacaauuggauugagucuaguggcaucuguggaguuaccaaauuccuuggaggagcugggagauggacuugcaaugggcauuaugauuuuaaaauuauugacugacuuucaaucacaucagcugugggcuaccuugcuguccuugacauuuaucaaaacaacguuuuccuugcacuaugcauggaagacaauggcuaugguacugucaauuguaucucucuuccccuuaugccuguccacgaccucccaaaaaacaacauggcuuccggugcuguugggaucucuuggauguaaaccacuaaccauguuucuuauagcagaaaacaaaaucuggggaaggaaaaguuggccccucaaugaaggaaucauggcuguuggaauugucagcauccuacuaagcucacuccucaaaaaugaugugccgcuagcugggccacuaauagcuggaggcaugcuaauagcauguuauguuauaucuggaagcucagccgaucuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaaucaugcagagaggacuguugggcagaucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggcgaaguuggagccauugcccuagauuuuaaacccggcacaucuggaucuccuaucgugaacagagaagggaaaauaguaggucuuuauggaaauggaguagugacaacaaguggaaccuacgucagugccauagcucaagcuaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucuccugugagaguucccaauuacaacaugauuaucauggaugaagcacauuucaccgauccauccagcauagcggcuagaggguacauuucaacccgagugggcaugggugaagcagcugcgaucuucaugacagccacucccccaggaucaguggaggccuuuccacagagcaacgcaguuauccaagaugaggaaagagacauuccugagagaucauggaacucaggcuaugaguggaucacugacuucccaggcaaaacaguuugguuuguuccaagcauuaaaucaggaaaugauauugccaacugcuuaagaaagaaugggaaacgggugauucaauugagcagaaaaaccuuugacacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaguuggaaggaaccacaauaaggaaggugaucaguacaucuacaugggacagccuuuaaacaacgaugaagaucacgcucacuggacggaagcaaaaaugcuccuugauaauauaaacacaccagaagggauuaucccagcccucuucgagccggagagagaaaagagugcagcaauagacggggaauacagacugcggggugaagcaaggaaaacguuuguggagcucaugagaagaggagaucuaccugucuggcuauccuacaaaguugccucagaaggcuuccaguacucugauagaagauggugcuuugacggggaaaggaacaaccagguguuggaggagaacauggacguggagaucuggacaaaagaaggagaaagaaagaaacuacgaccccguuggcuggaugccagaacauacucagacccacuggcccugcgcgaguuuaaagaguuugcagcaggaagaagaagcgucucaggagaucuaauauuagaaauagggaaacuuccacaacacuugacgcaaagggcccagaaugccuuggacaaccugguuauguuacacaacuccgaacaaggaggaagagccuauagacaugcaauggaagaacugccagacaccauagaaacguugaugcuccuagcuuugauagcuguguuaacugguggagugacgcuguucuuccuaucaggaaggggcuuagggaaaacaucuaucggccuacucugcgugauggcuucaagcguacugcuauggauggccaguguagagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggauguagacuuacauccagcuucagccuggacccucuaugcaguggccacaacaauuaucacucccaugaugaggcacacaaucgaaaacacaacggcaaacauuucccugacagccauugcaaaccaggcagccauauugaugggacuugacaaaggauggccaauaucgaagauggacauaggaguuccacuucucgccuuggggugcuauucccaagugaauccacugacgcugacagcggcgguauugaugcuaguggcucauuacgcuauaauuggaccuggacugcaagcaaaagcuacuagagaagcucaaaagaggacagcggccggaauaaugaaaaauccaaccguugauggaaucguugcaauagauuuggacccugugguuuaugaugcgaaauuugagaaacaacuaggccaaauaaugcuguugauacuaugcacaucacagauccucuugaugcggacuacaugggccuugugcgaauccaucacacuggccacuggaccccugaccacgcucugggagggaucuccaggaaaauuuuggaacaccacgauagcgguuuccauggcaaacauuuucagaggaaguuaucuagcaggagcaggccuggccuucucauuaaugaaaucucuaggaggagguaggagaggcacgggagcccaaggggaaacacugggagagaaauggaaaagacagcugaaucaacugagcaagucagaauucaacaccuauaaaaggagugggauuauggaaguggacagauccgaagccaaagagggacugaaaagaggggaaacaaccaaacaugcagugucgagaggaaccgcuaaauugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaagaaccaaucccaauggcgaccuauggauggaaccuaguaaagcugcacuccgggaaagacguauucuuuauaccaccugagaaaugugacacccucuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacauaugaaagagacguggaccuaggcgcuggaacaagacauguggcaguggaaccagagguagccaaccuagauaucauuggccagaggauagagaacauaaaacaugaacacaagucaacauggcauuaugaugaggacaauccauauaaaacaugggccuaucauggaucauaugaggucaagccaucaggaucagccucauccauggucaaugguguggugaaacugcucaccaaaccaugggaugucauccccauggucacacaaauagccaugacugacacuacacccuuuggacaacagaggguguuuaaagagaaaguugacacacgcacaccaaaagcaaaacgaggcacaacacaaaucauggaggugacagccaggugguuaugggguuuucuuucuagaaacaagaagccaagaauuuguacaagagaggaguuuacaagaaaaguuaggucaaacgcagccaucggagcaguguucguugacgaaaaccaauggaacucagcaaaagaagcaguggaagaugagcgguucugggaccuugugcacagagagagggagcuucacaaacagggaaaaugugccacguguguuuacaacaugauggggaagagagagaaaaagcuaggagaauuuggaaaggcaaaaggaagucgugcaauaugguacaugugguugggagcacgcuuucuagaguucgaagcucuugguuucaugaacgaagaccacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccaaaauuacugacaucauggaacccgaacaugcccuacuggcuaaggcaaucuucaagcuaaccuaccaaaauaaagugguaaggguacagagaccagcaaaaaauggaaccgugauggaugucauauccagacgugaccagagaggaaguggccaggucggaacuuauggcuuaaacacuuucaccaacauggaagcccagcugauaagacaaauggagucugagggaaucuuuucacccagugaauuagagaccccaaauuuagccgagagaguucucgacuggcuggaaaaauauggcgucgaaaggcuaaaaagaauggcaaucaguggagaugacugcguagugaaaccaauugaugauagguuugcaacagccuuaacagcucugaaugauaugggaaaaguaagaaaagauauaccacaaugggaacccucaaaaggauggaaugauuggcaacaagugccuuuuuguucacaccacuuccaccagcugauuaugaaggaugggagggaaauaguggugccaugccgcaaccaagaugaacuuguggguagagcuagaguaucacaaggugcuggauggagccugagagaaaccgcaugccuaggcaaaucauaugcacaaauguggcagcugauguacuuccacaggagagaccugagauuagccgcuaaugcuaucuguucagccguuccaguugauugggucccaaccagccguaccaccuggucgauccaugcccaucaccaauggaugacaacagaagacaugcugucaguguggaauaggguuuggauagaggaaaacccauggauggaggacaaaacccauauauccaguugggaagauguuccauauuuagggaaaagggaagaucaaugguguggaucccugauaggcuuaacagcaagggccaccugggccaccaacauacaaguggccauaaaccaagugagaagacuaauugggaaugagaauuaccuagauuacaugacaucaaugaagagauucaagaacgagagugaucccgaaggggcacucugguga

SEQ ID NO: 6246 - RNA, 9879 nt, Artificial Sequence
  derived and/or modified CDS sequence (wt) from DENV-1__KC762635__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuaugugaggacacacugacuuacaaaugcccucgaaucacugaggcggaaccagaugacguugauugcuggugcaaugccacagauacaugggugaccuauggaacauguucccaaacuggcgagcaccgacgagacaaacguuccgucgcacuggccccacacgugggacuugguuuggaaacaagaaccgaaacguggauguccuccgaaggcgcuuggagacagauacaaagaguggagacuugggcccugagacacccaggauucacggugauagcccuuuuucuagcacaugccauaggaacauccaucacccagaaagggauuaucuucauuuuguuaaugcuggucacaccauccauggccaugcgaugcgugggaauaggcagcagggacuucguggaaggacugucaggagcaacuuggguagauguggugcuggaacauggaaguugugucacuaccauggcaaaagacaaaccaacauuggacauugaacucuugaagacggaagucacaaacccugccguccugcgcaaacuaugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuuauaacgugugcuaaguucaagugugugacaaaacuggaaggaaaaauaguucaguaugaaaacuugaaauauucaguaauagucacuguccacacuggagaccagcaucaggugggaaaugaaagcacagaacaugggacaacugcaacuauaacaccucaagcuccuacgacagaaauacaguugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagaaacuuggaacagacaagauuugcuggugacauuuaagacagcucaugcaaagaagcaggaaguagucguacuaggaucacaagaaggagcaaugcacacugcgcugaccggagcgacggaaauccaaacgucuggaacgacaacaauuuuugcaggacacuugaaauguagacuaaagauggacaaacugacucuaaaagggaugucauaugugaugugcacaggcucauucaagcuagagaaagaaguggcugagacccagcauggaaccguucuagugcagaucaaauacgaaggaacagaugcaccaugcaagauuccuuuuucgacccaagaugaaaaaggaguaacccagaaugggagauugauaacagccaaccccauagucacugauaaagaaaaaccagucaacauugaggcagaaccgccuuuuggugagaguuacaucgugauaggagcaggugaaaaagcucugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagaucuuuggaacugcauauggaguuuuguucagcgguguuuccuggaccaugaaaauaggaauagggguucugcugacauggcugggauuaaacucaaggagcacgucccuuucgaugacgugcauugcaguuggccuaguaacgcuauacuuaggagucaugguucaggcggauucaggauguguaauuaauuggaaagguagagaacucaaauguggaaguggcauuuuugucaccaaugaaguucacacuuggacagagcaauacaaauuucaagcugauuccccaaagagacuaucagcagccauugggaaggcaugggaggaggguguguguggaauucgaucagcaacucgucucgagaacaucauguggaagcaaauaucaaaugaauugaaccacaucuuacuugaaaaugacaugaaauucacagugguuguaggagauguugcugggaucuuggcucaaggaaaaaaaaugauuaggccacaacccauggaacacaaauacucguggaaaagcuggggaaaggcuaaaaucauaggggcagauguacagaacaccaccuuuaucaucgacggcccaaacaccccagaaugcccugaugaucaaagagcauggaacauuugggaaguugaggauuauggauuuggaauuuucacgacaaacauauggcugaaauugcgugacuccuacacccaggugugugaccaccggcuaaugucagcugccaucaaggacagcaaggcaguucacgcugacaugggguacuggauagaaagugaaaagaacgagaccuggaagcuggcaagagccucuuucauagaagucaaaacauguaucuggccaaaaucucacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuuaauuugugugaggguaccacggucguuguggaugaacauuguggaaaucgaggaccaucucuuaggaccacaacagucacaggaaagauaauucaugaaugguguugcagaucuuguacgcuaccacccuuacguuuuagaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguagggcuacuauuccgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuaugcauggaagacaauggcuaugguacugucaauuguaucucucuuccccuuaugccuguccacgaccucccaaaaaacaacauggcuuccggugcuguugggaucucuuggauguaaaccacuaaccauguuucuuauagcagaaaacaaaaucuggggaaggaaaaguuggccccucaaugaaggaaucauggcuguuggaauugucagcauccuacuaagcucacuccucaaaaaugaugugccgcuagcugggccacuaauagcuggaggcaugcuaauagcauguuauguuauaucuggaagcucagccgaucuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaaucaugcagagaggacuguugggcagaucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggcgaaguuggagccauugcccuagauuuuaaacccggcacaucuggaucucccaucgugaacagagaagggaaaauaguaggccuuuauggaaauggaguagugacaacaaguggaaccuacgucagugccauagcucaagcuaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccagcauagcggcuagaggguacaucucaacccgagugggcaugggugaagcagcugcgaucuucaugacagccacucccccaggaucaguggaggccuuuccacagagcaacgcaguuauccaagaugaggaaagagacauuccugagagaucauggaacucaggcuaugaguggaucacugacuucccaggcaaaacaguuugguuuguuccaagcauuaaaucaggaaaugauauugccaacugcuuaagaaagaaugggaaacgggugauccaauugagcagaaaaaccuuugauacagaguaccaaaaaacaaaaaauaacgacugggacuacgucgucacaacagauaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaguuggaaggaaccacaauaaggaaggugaucaguacaucuacaugggacagccuuuaaacaacgaugaagaucacgcucacuggacggaagcaaaaaugcuccuugauaauauaaacacaccagaagggauuaucccagcccucuucgagccggagagagagaagagugcagcaauagacggggaauacagacugcggggugaagcaaggaaaacguuuguggagcucaugagaagaggagaucuaccugucuggcuauccuacaaaguugccucagaaggcuuccaguacucugauagaagauggugcuuugacggggaaaggaacaaccagguguuggaggagaacauggacguggagaucuggacaaaagaaggggaaagaaagaaacuacgaccccguuggcuggaugccagaacauacucagacccacuggcccugcgcgaguuuaaagaguuugcagcaggaagaagaagcgucucaggagaucuaauauuagaaauaggaaaacuuccacagcacuugacgcaaagggcccagaaugccuuggacaaccugguuauguuacacaacuccgaacaaggaggaagagccuauagacaugcaauggaagaacugccagacaccauagaaacguugaugcuccuagcuuugauagcuguguuaacugguggagugacgcuguucuuccuaucaggaaggggcuuagggaaaacaucuaucggccuacucugcgugauggcuucaagcguacugcuauggauggccaguguagagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacuguuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccaucgcaaaccaggcagccauauugaugggacuugacaaaggauggccaauaucgaagauggacauaggaguuccacuucucgccuuggggugcuauucccaagugaauccacugacgcugacagcggcgguauugaugcuaguggcucauuacgcuauaauuggaccuggacugcaagcaaaagcuacuagagaagcucaaaaaaggacagcggccggaauaaugaaaaauccaaccguugauggaaucguugcaauagauuuggacccugugguuuaugaugcgaaauuugagaaacaacuaggccaaauaauguuguugauacuaugcacaucacagauccucuugaugcggacuacaugggccuugugcgaauccaucacacuggccacuggaccucugaccacgcucugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacaccuauaaaaggagugggauuauggaaguggacagauccgaagccaaagagggacugaaaagaggggaaacaaccaaacaugcagugucgagaggaaccgcuaaauugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaagaaccaaucccaauggcgaccuauggauggaaccuaguaaagcugcacuccgggaaagacguauucuuuauaccaccugagaaaugugacacccucuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacauaugaaagagacguggaccuaggcgcuggaacaagacauguggcaguggaaccagagguagccaaccuagauaucaucggccagaggauagagaacauaaaacaugaacacaagucaacauggcauuaugaugaggacaauccauauaaaacaugggccuaucauggaucauaugaggucaagccaucaggaucagccucauccauggucaaugguguggugaaacugcucaccaaaccaugggaugucauccccauggucacacaaauagccaugacugacacuacacccuuuggacaacagaggguguuuaaagagaaaguugacacacgcacaccaaaagcaaaacgaggcacaacacaaaucauggaggugacagccaggugguuaugggguuuucuuucuagaaacaagaagccaagaauuuguacaagagaggaguuuacaagaaaaguuaggucaaacgcagccaucggagcaguguucguugacgaaaaucaauggaacucagcaaaagaagcaguggaagaugagcgguucugggaccuugugcacagagagagggagcuucacaaacagggaaaaugugcuacguguguuuacaacaugauggggaagagagagaaaaagcuaggagaauuuggaaaggcaaaaggaagucgugcaauaugguacaugugguugggagcacgcuuucuagaguucgaagcucuugguuucaugaacgaagaccacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccaaaauuacugacaucauggaacccgaacaugcccuacuggcuaaggcaaucuucaagcuaaccuaccaaaauaaagugguaaggguacagagaccagcaaaaaauggaaccgugauggaugucauauccagacgugaccagagaggaaguggccaggucggaacuuauggcuuaaacacuuucaccaacauggaagcccagcugauaagacaaauggagucugagggaaucuuuucacccagugaauuagagaccccaaauuuagccgagagaguucucgacuggcuggaaaaauauggcgucgaaaggcuaaaaagaauggcaaucaguggagaugacugcguagugaaaccaauugaugauagguuugcaacagccuuaacagcucugaaugauaugggaaaaguaagaaaagauauaccacaaugggaacccucaaaaggauggaaugauuggcaacaagugccuuuuuguucacaccacuuccaccagcugauuaugaaggaugggagggaaauaguggugccaugccgcaaccaagaugaacuuguggguagagcuagaguaucacaaggugcuggauggagccugagagaaaccgcaugccuaggcaaaucauaugcacaaauguggcagcugauguacuuccacaggagagaccugagacuagccgcuaaugcuaucuguucagccguuccaguugauugggucccaaccagccguaccaccuggucgauccaugcccaucaccaauggaugacaacagaagacaugcugucaguguggaauaggguuuggauagaggaaaacccauggauggaggacaaaacccauauauccaguugggaagauguuccauauuuagggaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6247 - RNA, 9879 nt, Artificial Sequence
  derived and/or modified CDS sequence (wt) from DENV-1__KC762650__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuaugugaggacacacugacuuacaaaugcccucgaaucacugaggcggaaccagaugacguugauugcuggugcaaugccacagacacaugggugaccuauggaacauguucccaaacuggcgagcaccgacgagacaaacguuccgucgcacuggccccacacgugggacuugguuuggaaacaagaaccgaaacguggauguccuccgaaggcgcuuggagacagauacaaagaguggagacuugggcccugagacacccaggauucacggugauagcccuuuuucuagcacaugccauaggaacauccaucacccagaaagggauuaucuucauuuuguuaaugcuggucacaccauccauggccaugcgaugcgugggaauaggcagcagggacuucguggaaggacugucaggagcaacuuggguagauguggugcuggaacauggaaguugugucacuaccauggcaaaagacaaaccaacauuggacauugaacucuugaagacggaagucacaaacccugccguccugcgcaaacuaugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuuauaacgugugcuaaguucaagugugugacaaaacuggaaggaaaaauaguucaguaugaaaacuugaaauauucaguaauagucaccguccacacuggagaccagcaucaggugggaaaugaaagcacagaacaugggacaacugcaacuauaacaccucaagcuccuacgacagaaauacaguugaccgacuacggagcucucacauuggauuguucaccuagaacaggacuagacuucaaugaaaugguguuguugacaaugaaagaaaaaucauggcuaguccacaaacaaugguuucuagaccuaccacugccuuggaccucgggagcuucaacaucacaagaaacuuggaacagacaagauuugcuggugacauuuaagacagcucaugcaaagaagcaggaaguagucguacuaggaucacaagaaggagcaaugcacacugcgcugaccggagcgacggaaauccaaacgucuggaacgacaacaauuuuugcaggacacuugaaauguagacuaaagauggacaaacugacucuaaaagggaugucauaugugaugugcacaggcucauucaagcuagagaaagaaguggcugagacccagcauggaaccguucuagugcagaucaaauacgaaggaacagaugcaccaugcaagauuccuuuuucgacccaagaugaaaaaggaguaacccagaaugggagauugauaacagccaaccccauagucacugauaaagaaaaaccagucaacauugaggcagaaccgccuuuuggugagaguuacaucgugauaggagcaggugaaaaagcucugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagaucuuuggaacugcauauggaguuuuguucagcgguguuuccuggaccaugaaaauaggaauagggguucugcugacauggcuaggauuaaacucaaggagcacgucccuuucgaugacgugcauugcaguuggccuaguaacgcuauacuuaggagucaugguucaggcggauucaggauguguaauuaauuggaaagguagagaacucaaauguggaaguggcauuuuugucaccaaugaaguucacacuuggacagagcaauacaaauuucaagcugauuccccaaagagacuaucagcagccauugggaaggcaugggaggaggguguguguggaauucgaucagcaacucgucucgagaacaucauguggaagcaaauaucaaaugaauugaaccacaucuuacuugaaaaugacaugaaauucacagugguuguaggagauguugcugggaucuuggcucaaggaaaaaaaaugauuaggccacaacccauggaacacaaauacucguggaaaagcuggggaaaggcuaaaaucauaggggcagauguacagaacaccaccuuuaucaucgacggcccaaacaccccagaaugcccugaugaucaaagagcauggaacauuugggaaguugaggauuauggauuuggaauuuucacgacaaacauauggcugaaauugcgugacuccuacacccaggugugugaccaccggcuaaugucagcugccaucaaggacagcaaggcaguucacgcugacaugggguacuggauagaaagugaaaagaacgagaccuggaagcuggcaagagccucuuucauagaagucaaaacauguaucuggccaaaaucucacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuuaauuugugugaggguaccacggucguuguggaugaacauuguggaaaucgaggaccaucucuuaggaccacaacagucacaggaaagauaauucaugaaugguguugcagaucuuguacgcuaccacccuuacguuuuagaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguagggcuacuauuccgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuaugcauggaagacaauggccaugguacugucaauuguaucucucuuccccuuaugccuguccacgaccucccaaaaaacaacauggcuuccggugcuguugggaucucuuggauguaaaccacuaaccauguuucuuauagcagaaaacaaaaucuggggaaggaaaaguuggccccucaaugaaggaaucauggccguuggaauugucagcauccuacuaagcucacuccucaaaaaugaugugccgcuagcugggccacuaauagcuggaggcaugcuaauagcauguuauguuauaucuggaagcucagccgaucuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaaucaugcagagaggacuguugggcagaucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggcgaaguuggagccauugcccuagauuuuaaacccggcacaucuggaucucccaucgugaacagagaagggaaaauaguaggccuuuauggaaauggaguagugacaacaaguggaaccuacgucagugccauagcucaagcuaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccagcauagcggcuagaggguacaucucaacccgagugggcaugggugaagcagcugcgaucuucaugacagccacucccccaggaucaguggaggccuuuccacagagcaacgcaguuauccaagaugaggaaagagacauuccugagagaucauggaacucaggcuaugaguggaucacugacuucccaggcaaaacaguuugguuuguuccaagcauuaaaucaggaaaugauauugccaacugcuuaagaaagaaugggaaacgggugauccaauugagcagaaaaaccuuugauacagaguaccaaaaaacaaaaaauaacgacugggacuacgucgucacaacagauaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaguuggaaggaaccacaauaaggaaggugaucaguacaucuacaugggacagccuuuaaacaacgaugaagaucacgcucacuggacggaagcaaaaaugcuccuugauaauauaaacacaccagaagggauuaucccagcccucuucgagccggagagagagaagagugcagcaauagacggggaauacagacugcggggugaagcaaggaaaacguuuguggagcucaugagaagaggagaucuaccugucuggcuauccuacaaaguugccucagaaggcuuccaguacucugauagaagauggugcuuugacggggaaaggaacaaccagguguuggaggagaacauggacguggagaucuggacaaaagaaggggaaagaaagaaacuacgaccccguuggcuggaugccagaacauacucagacccacuggcccugcgcgaguuuaaagaguuugcagcaggaagaagaagcgucucaggagaucuaauauuagaaauaggaaaacuuccacagcacuugacgcaaagggcccagaaugccuuggacaaccugguuauguuacacaacuccgaacaaggaggaagagccuauagacaugcaauagaagaacugccagacaccauagaaacguugaugcuccuagcuuugauagcuguguuaacugguggagugacgcuguucuuccuaucaggaaggggcuuagggaaaacaucuaucggccuacucugcgugauggcuucaagcguacugcuauggauggccaguguagagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacuguuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccaucgcaaaccaggcagccauauugaugggacuugacaaaggauggccaauaucgaagauggacauaggaguuccacuucucgccuuggggugcuauucccaagugaauccacugacgcugacagcggcgguauugaugcuaguggcucauuacgcuauaaucggaccuggacugcaagcaaaagcuacuagagaagcucaaaaaaggacagcggccggaauaaugaaaaauccaaccguugauggaaucguugcaauagauuuggacccugugguuuaugaugcgaaauuugagaaacaacuaggccaaauaauguuguugauacuaugcacaucacagauccucuugaugcggacuacaugggccuugugcgaauccaucacacuggccacuggaccucugaccacgcucugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacaccuauaaaaggagugggauuauggaaguggacagauccgaagccaaagagggacugaaaagaggggaaacaaccaaacaugcagugucgagaggaaccgccaaauugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaagaaccaaucccaauggcgaccuauggauggaaccuaguaaagcugcacuccgggaaagacguauucuucauaccaccugagaaaugugacacccucuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacaugggggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacauaugaaagagacguggaccuaggcgcuggaacaagacauguggcaguggaaccagagguagccaaccuagauaucaucggccagaggauagagaacauaaaacaugaacacaagucaacauggcauuaugaugaggacaauccauauaaaacaugggccuaucauggaucauaugaggucaagccaucaggaucagccucauccauggucaaugguguggugaaacugcucaccaaaccaugggaugucauccccauggucacacaaauagccaugacugacacuacacccuuuggacaacagaggguguuuaaagagaaaguugacacacgcacaccaaaagcaaaacgaggcacaacacaaaucauggaggugacagccaggugguuaugggguuuucuuucuagaaacaagaagccaagaauuuguacaagagaggaguuuacaagaaaaguuaggucaaacgcagccaucggagcaguguucguugacgaaaaucaauggaacucagcaaaagaagcaguggaagaugagcgguucugggaccuugugcacagagagagggagcuucacaaacagggaaaaugugcuacguguguuuacaacaugauggggaagagagagaaaaagcuaggagaauuuggaaaggcaaaaggaagucgugcaauaugguacaugugguugggagcacgcuuucuagaguucgaagcucuugguuucaugaacgaagaccacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccaaaauuacugacaucauggaacccgaacaugcccuacuggcuaaggcaaucuucaagcuaaccuaccaaaauaaagugguaaggguacagagaccagcaaaaaauggaaccgugauggaugucauauccagacgugaccagagaggaaguggccaggucggaacuuauggcuuaaacacuuucaccaacauggaagcccagcugauaagacaaauggagucugagggaaucuuuucacccagugaauuagagaccccaaauuuagccgagagaguucucgacuggcuggaaaaauauggcgucgaaaggcuaaaaagaauggcaaucaguggagaugacugcguagugaaaccaauugaugauagguuugcaacagccuuaacagcucugaaugauaugggaaaaguaagaaaagauauaccacaaugggaacccucaaaaggauggaaugauuggcaacaagugccuuuuuguucacaccacuuccaccagcugauuaugaaggaugggagggaaauaguggugccaugccgcaaccaagaugaacuuguggguagagcuagaguaucacaaggugcuggauggagccugagagaaaccgcaugccuaggcaaaucauaugcacaaauguggcagcugauguacuuccacaggagagaccugagacuagccgcuaaugcuaucuguucagccguuccaguugauugggucccaaccagccguaccaccuggucgauccaugcccaucaccaauggaugacaacagaagacaugcugucaguguggaauaggguuuggauagaggaaaacccauggauggaggacaaaacccauauauccaguugggaagauguuccauauuuagggaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6248 - RNA, 9879 nt, Artificial Sequence
  derived and/or modified CDS sequence (wt) from DENV-1__KC762623__SS-prME
ucugugaccaugcuccuuaugcugaugccuacagcuuuggcguuccauuugacuacacgagggggagagccgcacaugauagucagcaagcaggaaagaggaaagucacuuuuguuuaagaccucagcaggugucaacaugugcacccuuauagcgauggauuugggagaguuaugugaggacacacugacuuacaaaugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccuccgaaggcgcuuggaaacagauacaaagaguggagacuugggcccugagacacccaggauucacggugauagcccuuuuccuagcacaugccauaggaacauccaucacccagaaagggauuaucuucauuuuguuaaugcuggucacaccauccauggccaugcgaugcgugggaauaggcagcagggacuucguggaaggacugucaggagcaacuuggguagauguggugcuggaacauggaaguugcgucacuaccauggcaaaagacaaaccaacauuggacauugaacuuuugaagacggaagucacaaacccugccguccugcgcaaacuaugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuuauaacgugugcuaaguucaagugugugucaaaacuggaaggaaaaauaguucaguaugaaaacuugaaauauucaguaauagucaccguccacacuggagaccagcaucaggugggaaaugaaagcacagaacaugggacaacugcaacuauaacaccucaagcucccacgacagaaauacaguugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagaaacuuggaacagacaagauuugcuggugacauuuaagacagcucaugcaaagaagcaggaaguagucguacuaggaucacaagaaggagcaaugcacacugcgcugaccggagcgacggaaauccaaacgucuggaacgacaacaauuuuugcaggacacuugaaauguagacuaaagauggacaaacugacucuaaaagggaugucauaugugaugugcacaggcucauucaagcuagagaaagaaguggcugagacccagcauggaaccguucuagugcagaucaaauacgaaggaacagaugcaccaugcaagauuccuuuuucgacccaagaugaaaaaggaguaacccagaaugggagauugauaacagccaaccccauagucacugauaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagaucuuuggaacugcauauggaguuuuguucagcgguguuuccuggaccaugaaaauaggaauagggguucugcugacauggcuaggauuaaacucaaggagcacgucccuuucgaugacgugcauugcaguuggccuaguaacgcuauacuuaggagucaugguucaggcggauucaggauguguaauuaauuggaaagguagagaacucaaauguggaaguggcauuuuugucaccaaugaaguucacacuuggacagagcaauacaaauuucaagcugauuccccaaagagacuaucagcagccauugggaaggcaugggaggaggguguguguggaauucgaucagcaacucgucucgagaacaucauguggaagcaaauaucaaaugaauugaaccacaucuuacuugaaaaugacaugaaauucacagugguuguaggagauguugcugggaucuuggcucaaggaaaaaaaaugauuaggccacaacccauggaacacaaauacucguggaaaagcuggggaaaggcuaaaaucauaggggcagauguacagaacaccaccuuuaucaucgacggcccaaacaccccagaaugcccugaugaucaaagagcauggaacauuugggaaguugaggauuauggauuuggaauuuucacgacaaacauauggcugaaauugcgugacuccuacacccaggugugugaccaccggcuaaugucagcugccaucaaggacagcaaggcaguucacgcugacaugggguacuggauagaaagugaaaagaacgagaccuggaagcuggcaagagccucuuucauagaagucaaaucauguaucuggccaaaaucucacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacggucguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagauccagauggaguaggaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuucaaaaugagaccaauguuugcuguagggcuacuauuccgcagacuaacauccagagaaguucuucuucuaacaauuggauugagucuaguggcaucuguggaguuaccaaauuccuuggaggagcugggagauggacuugcaaugggcauuaugauuuuaaaauuauugacugacuuucaaucacaucagcugugggcuaccuugcuguccuugacauuuaucaaaacaacguuuuccuugcacuaugcauggaagacaauggcuaugguacugucaauuguaucucucuuccccuuaugccuguccacgaccucccaaaaaacaacauggcuuccggugcuguugggaucucuuggauguaaaccacuaaccauguuucuuauagcagaaaacaaaaucuggggaaggaaaaguuggccccucaaugaaggaaucauggcuguuggaauugucagcauccuacuaagcucacuccucaaaaaugaugugccgcuagcugggccacuaauagcuggaggcaugcuaauagcauguuauguuauaucuggaagcucagccgaucuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuuuugugguacuuuuggcagaaaaagaaacagagaucuggaguguuaugggacacaccuagcccuccagaaguggaaagagcaguucuugaugaugguaucuauagaaucaugcagagaggacuguugggcagaucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggcgaaguuggagccauugcccuagauuuuaaacccggcacaucuggaucuccuaucgugaacagagaagggaaaauaguaggucuuuauggaaauggaguagugacaacaaguggaaccuacgucagugccauagcucaagcuaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucuccugugagaguucccaauuacaacaugauuaucauggaugaagcacauuucaccgauccauccagcauagcggcuagaggguacauuucaacccgagugggcaugggugaagcagcugcgaucuucaugacagccacucccccaggaucaguggaggccuuuccacagagcaacgcaguuauccaagaugaggaaagagacauuccugagagaucauggaacucaggcuaugaguggaucacugacuucccaggcaaaacaguuugguuuguuccaagcauuaaaucaggaaaugauauugccaacugcuuaagaaagaaugggaaacgggugauucaauugagcagaaaaaccuuugacacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaguuggaaggaaccacaauaaggaaggugaucaguacaucuacaugggacagccuuuaaacaacgaugaagaucacgcucacuggacggaagcaaaaaugcuccuugauaauauaaacacaccagaagggauuaucccagcccucuucgagccggagagagaaaagagugcagcaauagacggggaauacagacugcggggugaagcaaggaaaacguuuguggagcucaugagaagaggagaucuaccugucuggcuauccuacaaaguugccucagaaggcuuccaguacucugauagaagauggugcuuugacggggaaaggaacaaccagguguuggaggagaacauggacguggagaucuggacaaaagaaggagaaagaaagaaacuacgaccccguuggcuggaugccagaacauacucagacccacuggcccugcgcgaguuuaaagaguuugcagcaggaagaagaagcgucucaggagaucuaauauuagaaauagggaaacuuccacaacacuugacgcaaagggcccagaaugccuuggacaaccugguuauguuacacaacuccgaacaaggaggaagagccuauagacaugcaauggaagaacugccagacaccauagaaacguugaugcuccuagcuuugauagcuguguuaacugguggagugacgcuguucuuccuaucaggaaggggcuuagggaaaacaucuaucggccuacucugcgugauggcuucaagcguacugcuauggauggccaguguagagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggauguagacuuacauccagcuucagccuggacccucuaugcaguggccacaacaauuaucacucccaugaugaggcacacaaucgaaaacacaacggcaaacauuucccugacagccauugcaaaccaggcagccauauugaugggacuugacaaaggauggccaauaucgaagauggacauaggaguuccacuucucgccuuggggugcuauucccaagugaauccacugacgcugacagcggcgguauugaugcuaguggcucauuacgcuauaauuggaccuggacugcaagcaaaagcuacuagagaagcucaaaagaggacagcggccggaauaaugaaaaauccaaccguugauggaaucguugcaauagauuuggacccugugguuuaugaugcgaaauuugagaaacaacuaggccaaauaaugcuguugauacuaugcacaucacagauccucuugaugcggacuacaugggccuugugcgaauccaucacacuggccacuggaccccugaccacgcucugggagggaucuccaggaaaauuuuggaacaccacgauagcgguuuccauggcaaacauuuucagaggaaguuaucuagcaggagcaggccuggccuucucauuaaugaaaucucuaggaggagguaggagaggcacgggagcccaaggggaaacacugggagagaaauggaaaagacagcugaaucaacugagcaagucagaauucaacaccuauaaaaggagugggauuauggaaguggacagauccgaagccaaagagggacugaaaagaggggaaacaaccaaacaugcagugucgagaggaaccgcuaaauugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaagaaccaaucccaauggcgaccuauggauggaaccuaguaaagcugcacuccgggaaagacguauucuuuauaccaccugagaaaugugacacccucuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacauaugaaagagacguggaccuaggcgcuggaacaagacauguggcaguggaaccagagguagccaaccuagauaucauuggccagaggauagagaacauaaaacaugaacacaagucaacauggcauuaugaugaggacaauccauauaaaacaugggccuaucauggaucauaugaggucaagccaucaggaucagccucauccauggucaaugguguggugaaacugcucaccaaaccaugggaugucauccccauggucacacaaauagccaugacugacacuacacccuuuggacaacagaggguguuuaaagagaaaguugacacacgcacaccaaaagcaaaacgaggcacaacacaaaucauggaggugacagccaggugguuaugggguuuucuuucuagaaacaagaagccaagaauuuguacaagagaggaguuuacaagaaaaguuaggucaaacgcagccaucggagcaguguucguugacgaaaaccaauggaacucagcaaaagaagcaguggaagaugagcgguucugggaccuugugcacagagagagggagcuucacaaacagggaaaaugugccacguguguuuacaacaugauggggaagagagagaaaaagcuaggagaauuuggaaaggcaaaaggaagucgugcaauaugguacaugugguugggagcacgcuuucuagaguucgaagcucuugguuucaugaacgaagaccacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccaaaauuacugacaucauggaacccgaacaugcccuacuggcuaaggcaaucuucaagcuaaccuaccaaaauaaagugguaaggguacagagaccagcaaaaaauggaaccgugauggaugucauauccagacgugaccagagaggaaguggccaggucggaacuuauggcuuaaacacuuucaccaacauggaagcccagcugauaagacaaauggagucugagggaaucuuuucacccagugaauuagagaccccaaauuuagccgagagaguucucgacuggcuggaaaaauauggcgucgaaaggcuaaaaagaauggcaaucaguggagaugacugcguagugaaaccaauugaugauagguuugcaacagccuuaacagcucugaaugauaugggaaaaguaagaaaagauauaccacaaugggaacccucaaaaggauggaaugauuggcaacaagugccuuuuuguucacaccacuuccaccagcugauuaugaaggaugggagggaaauaguggugccaugccgcaaccaagaugaacuuguggguagagcuagaguaucacaaggugcuggauggagccugagagaaaccgcaugccuaggcaaaucauaugcacaaauguggcagcugauguacuuccacaggagagaccugagauuagccgcuaaugcuaucuguucagccguuccaguugauugggucccaaccagccguaccaccuggucgauccaugcccaucaccaauggaugacaacagaagacaugcugucaguguggaauaggguuuggauagaggaaaacccauggauggaggacaaaacccauauauccaguugggaagauguuccauauuuagggaaaagggaagaucaaugguguggaucccugauaggcuuaacagcaagggccaccugggccaccaacauacaaguggccauaaaccaagugagaagacuaauugggaaugagaauuaccuagauuacaugacaucaaugaagagauucaagaacgagagugaucccgaaggggcacucugguga

SEQ ID NO: 6249 - RNA, 9879 nt, Artificial Sequence
  derived and/or modified CDS sequence (wt) from DENV-1__KC762632__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuaugugaggacacacugacuuacaaaugcccucgaaucacugaggcggaaccagaugacguugauugcuggugcaaugcuacagacacaugggugaccuauggaacauguucccaaacuggcgagcaccgacgagacaaacguuccgucgcacuggccccacacgugggacuugguuuggaaacaagaaccgaaacguggauguccuccgaaggcgcuuggagacagaugcaaagaguggagacuugggcccugagacacccaggauucacggugauagcccuuuuucuagcacaugccauaggaacauccaucacccagaaagggauuaucuucauuuuguuaaugcuggucacaccauccauggccaugcgaugcgugggaauaggcagcagggacuucguggaaggacugucaggagcaacuuggguagauguggugcuggaacauggaaguugugucacuaccauggcaaaagacaaaccaacauuggacauugaacucuugaagacggaagucacaaacccugccguccugcgcaaacuaugcauugaagcuaaaauaucaaacaucaccaccgacucaagauguccaacacaaggagaagccacacugguggaagaacaagacgcgaacuuugugugucgacgaacguuuguggacagaggcuggggcaauggcugugggcucuucggaaaaggaagccuuauaacgugugcuaaguucaagugugugacaaaacuggaaggaaaaauaguucaguaugaaaacuugaaauauucaguaauagucaccguccacacuggagaccagcaucaggugggaaaugaaagcacagaacaugggacaacugcaacuauaacaccucaagcuccuacgacagaaauacaguugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagaaacuuggaacagacaagauuugcuggugacauuuaagacagcucaugcaaagaagcaggaaguagucguacuaggaucacaagaaggagcaaugcacacugcgcugaccggagcgacggaaauccaaacgucuggaacgacaacaauuuuugcaggacacuugaaauguagacuaaagauggacaaacugacucuaaaagggaugucauaugugaugugcacaggcucauucaagcuagagaaagaaguggcugagacccagcauggaaccguucuagugcagaucaaauacgaaggaacagaugcaccaugcaagauuccuuuuucgacccaagaugaaaaaggaguaacccagaaugggagauugauaacagccaaccccauagucacugauaaagaaaaaccagucaacauugaggcagaaccgccuuuuggugagaguuacaucgugauaggagcaggugaaaaagcucugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagaucuuuggaacugcauauggaguuuuguucagcgguguuuccuggaccaugaaaauaggaauagggguucugcugacauggcuaggauuaaacucaaggagcacgucccuuucgaugacgugcauugcaguuggccuaguaacgcuauacuuaggagucaugguucaggcggauucaggauguguaauuaacuggaaagguagagaacucaaauguggaaguggcauuuuugucaccaaugaaguucacacuuggacagagcaauacaaauuucaagcugauuccccaaagagacuaucagcagccauugggaaggcaugggaggaggguguguguggaauucgaucagcaacucgucucgagaacaucauguggaagcaaauaucaaaugaauugaaccacaucuuacuugaaaaugacaugaaauucacagugguuguaggagauguugcugggaucuuggcucaaggaaaaaaaaugauuaggccacaacccauggaacacaaauacucguggaaaagcuggggaaaggcuaaaaucauaggggcagauguacagaacaccaccuuuaucaucgacggcccaaacaccccagaaugcccugaugaucaaagagcauggaacauuugggaaguugaggauuauggauuuggaauuuucacgacaaacauauggcugaaauugcgagacuccuacacccaggugugugaccaccggcuaaugucagcugccaucaaggacagcaaggcaguucacgcugacaugggauacuggauagaaagugaaaagaacgagaccuggaagcuggcaagagccucuuucauagaagucaaaacauguaucuggccaaaaucucacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuuaauuugugugaggguacuacggucguuguggaugaacauuguggaaaucgaggaccaucucuuaggaccacaacagucacaggaaagauaauucaugaaugguguugcagaucuuguacgcuaccacccuuacguuuuagaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguagggcuacuauuccgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuaugcauggaagacaauggcuaugguacugucaauuguaucucucuuccccuuaugccuguccacgaccucccaaaaaacaacauggcuuccggugcuguugggaucucuuggauguaaaccacuaaccauguuucuuauagcagaaaacaaaaucuggggaaggaaaaguuggccccucaaugaaggaaucauggcuguuggaauugucagcauccuacuaagcucacuccucaaaaaugaugugccgcuagcugggccacuaauagcuggaggcaugcuaauagcauguuauguuauaucuggaagcucagccgaucuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaaucaugcagagaggacuguugggcagaucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggcgaaguuggagccauugcccuagauuuuaaacccggcacaucuggaucucccaucgugaacagagaagggaaaauaguaggccuuuauggaaauggaguagugacaacaaguggaaccuacgucagugccauagcucaagcuaaagcaucacaagaagggccccuaccagagauugaagacgagguguuuaggaaaagaaacuuaacaauaauggaccuacauccaggaucggggaaaacuagaagauaccuuccagccauaguccgugaggccauaaaaaggaagcugcgcacacuaauucuggcucccacaaggguugucgcuucagaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccagcauagcggcuagaggguacaucucaacccgagugggcaugggugaagcagcugcgaucuucaugacagccacucccccaggaucaguggaggccuuuccacagagcaacgcaguuauccaagaugaggaaagagacauuccugagagaucauggaacucaggcuaugaguggaucacugacuucccaggcaaaacaguuugguuuguuccaagcauuaaaucaggaaaugauauugccaacugcuuaagaaagaaugggaaacgggugauccaauugagcagaaaaaccuuugauacagaguaccaaaaaacaaaaaauaacgacugggauuacgucgucacaacagauaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaguuggaaggaaccacaauaaggaaggugaucaguacaucuacaugggacagccuuuaaacaacgaugaagaucacgcucacuggacggaagcaaaaaugcuccuugauaauauaaacacaccagaagggauuaucccagcccucuucgagccggagagagagaagagugcagcaauagacggggaauacagacugcggggugaagcaaggaaaacguuuguggagcucaugagaagaggagaucuaccugucuggcuauccuacaaaguugccucagaaggcuuccaguacucugauagaagauggugcuuugacggggaaaggaacaaccagguguuggaggagaacauggacguggagaucuggacaaaagaaggggaaagaaagaaacuacgaccccguuggcuggaugccagaacauacucagacccacuggcccugcgcgaguuuaaagaguuugcagcaggaagaagaagcgucucaggagaucuaauauuagaaauaggaaaacuuccacaacacuugacgcaaagggcccagaaugccuuggacaaccugguuauguuacacaacuccgaacaaggaggaagagccuauagacaugcaauggaagaacugccagauaccauagaaacguugaugcuccuagcuuugauagcuguguuaacugguggagugacgcuguucuuccuaucaggaaggggcuuaggaaaaacaucuaucggccuacucugcgugauggcuucaagcguacugcuauggauggccaguguagagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacuguuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccaucgcaaaccaggcagccauauugaugggacuugacaaaggauggccaauaucgaagauggacauaggaguuccacuucucgccuuggggugcuauucccaagugaauccacugacgcugacagcggcgguacugaugcuaguggcucauuacgcuauaauuggaccuggacugcaagcaaaagcuacuagagaagcucaaaaaaggacagcggccggaauaaugaaaaauccaaccguugauggaaucguugcaauagauuuggacccugugguuuaugaugcgaaauuugagaaacaacuaggccaaauaauguuguugauacuaugcacaucacagauccucuugaugcggacuacaugggccuugugcgaauccaucacacuggccacuggaccucugaccacgcucugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacaccuauaaaaggagugggauuauggaaguggacagauccgaagccaaagagggacugaaaagaggggaaacaaccaaacaugcagugucgagaggaaccgcuaaauugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaagaaccaaucccaauggcgaccuauggauggaaccuaguaaagcugcacuccgggaaagacguauucuuuauaccaccugagaaaugugacacccucuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggaccaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacauaugaaagagacguggaccuaggcgcuggaacaagacauguggcaguggaaccagagguagccaaccuagauaucaucggccagaggauagagaacauaaaacaugaacacaagucaacauggcauuaugaugaggacaauccauauaaaacaugggccuaucauggaucauaugaggucaagccaucaggaucagccucauccauggucaaugguguggugaaacugcucaccaaaccaugggaugucauccccauggucacacaaauagccaugacugacacuacacccuuuggacaacagaggguguuuaaagagaaaguugacacacgcacaccaaaagcaaaacgaggcacaacacaaaucauggaggugacagccaggugguuaugggguuuucuuucuagaaacaagaagccaagaauuuguacaagagaggaguuuacaagaaaaguuaggucaaacgcagccaucggagcaguguucguugacgaaaaucaauggaacucagcaaaagaagcaguggaagaugagcgguucugggaccuugugcacagagagagggagcuucacaaacagggaaaaugugcuacguguguuuacaacaugauggggaagagagagaaaaagcuaggagaauuuggaaaggcaaaaggaagucgugcaauaugguacaugugguugggagcacgcuuucuagaguucgaagcucuugguuucaugaacgaagaccacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccaaaauuacugacaucauggaacccgaacaugcccuacuggcuaaggcaaucuucaagcuaaccuaccaaaauaaagugguaaggguacagagaccagcaaaaaauggaaccgugauggaugucauauccagacgugaccagagaggaaguggccaggucggaacuuauggcuuaaacacuuucaccaacauggaagcccagcugauaagacaaauggagucugagggaaucuuuucacccagugaauuagagaccccaaauuuagccgagagaguucucgacuggcuggaaaaauauggcgucgaaaggcuaaaaagaauggcaaucaguggagaugacugcguagugaaaccaauugaugauagguuugcaacagccuuaacagcucugaaugauaugggaaaaguaagaaaagauauaccacaaugggaacccucaaaaggauggaaugauuggcaacaagugccuuuuuguucacaccacuuccaccagcugauuaugaaggaugggagggaaauaguggugccaugccgcaaccaagaugaacuuguggguagagcuagaguaucacaaggugcuggauggagccugagagaaaccgcaugccuaggcaaaucauaugcacaaauguggcagcugauguacuuccacaggagagaccugagacuagccgcuaaugcuaucuguucagccguuccaguugauugggucccaaccagccguaccaccuggucgauccaugcccaucaccaauggaugacaacagaagacaugcugucaguguggaauaggguuuggauagaggaaaacccauggauggaggacaaaacccauauauccaguugggaagauguuccauauuuagggaaaagggaagaucaaugguguggaucccugauaggcuuaacagcaagggccaccugggccaccaauauacaaguggccauaaaccaagugagaagacuaauugggaaugagaauuaucuagauuacaugacaucaaugaagagauucaagaacgagagugaucccgaaggggcacucugguga

SEQ ID NO: 6250 - RNA, 9879 nt, Artificial Sequence
  derived and/or modified CDS sequence (wt) from DENV-1__KC762637__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuaugugaggacacacugacuuacaaaugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccuccgaaggcgcuuggaaacagauacaaagaguggagacuugggcccugagacacccaggauucacggugauagcccuuuuucuagcacaugccauaggaacauccaucacccagaaagggauuaucuucauuuuguuaaugcuggucacaccauccauggccaugcgaugcgugggaauaggcagcagggacuucguggaaggacugucaggagcaacuuggguagauguggugcuggaacauggaaguugcgucacuaccauggcaaaagacaaaccaacauuggacauugaacucuugaagacggaagucacaaacccugccguccugcgcaaacuaugcauugaagcuaaaauaucaaacacuaccaccgacucaagauguccaacacaaggagaagccacacugguggaagaacaagacgcgaacuuugugugucgacgaacguuuguggacagaggcuggggcaauggcugugggcucuucggaaaaggaagccuuauaacgugugcuaaguucaagugugugacaaaacuggaaggaaaaauaguucaguaugaaaacuugaaauauucaguaauagucaccguccacacuggagaccagcaucaggugggaaaugaaagcacagaacaugggacaacugcaacuauaacaccucaagcuccuacgacagaaauacaguugaccgacuacggagcucuuacauuggauuguucaccuagaacaggacuagacuuuaaugaaaugguguuguugacaaugaaagaaaaaucauggcuaguccacaagcaaugguuucuagaccuaccacugccuuggaccucgggagcuucaacaucacaagaaacuuggaacagacaagauuugcuggugacauuuaagacagcucaugcaaagaagcaggaaguagucguacuaggaucacaagaaggagcaaugcacacugcucugaccggagcgacggaaauccaaacgucuggaacgacaacaauuuuugcaggacacuugaaauguagacuaaagauggacaaacugacucuaaaagggaugucauaugugaugugcacaggcucauucaagcuagagaaagaaguggcugagacccagcauggaaccguucuagugcagaucaaauacgaaggaacagaugcaccaugcaagauuccuuuuucgacccaagaugaaaaaggaguaacccagaaugggagauugauaacagccaaccccauagucacugauaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagaucuuuggaacugcauauggaguuuuguucagcgguguuuccuggaccaugaaaauaggaauagggguucugcugacauggcuaggauuaaacucaaggagcacgucccuuucgaugacgugcauugcaguuggccuaguaacgcuauacuuaggagucaugguucaggcggauucaggauguguaauuaauuggaaagguagagaacucaaauguggaaguggcauuuuugucaccaaugaaguucacacuuggacagagcaauacaaauuucaagcugauuccccaaagagacuaucagcagccauugggaaggcaugggaggaggguguguguggaauucgaucagcaacucgucucgaaaacaucauguggaagcaaauaucaaaugaauugaaccacaucuuacuugaaaaugacaugaaauucacagugguuguaggagauguugcugggaucuuggcucaagggaaaaaaaugauuaggccacaacccauggaacacaaauacucguggaaaagcuggggaaaggcuaaaaucauaggggcagauguacagaauaccaccuuuaucaucgacggcccaaacaccccagaaugcccugaugaucaaagagcauggaacauuugggaaguugaggauuauggauuuggaauuuucacgacaaacauauggcugaaauugcgugacuccuacacccaggugugugaccaccgguuaaugucagcugccaucaaggacagcaaggcuguucacgcugacaugggguacuggauagaaagugaaaagaacgagaccuggaagcuggcaagagccucuuucauagaagucaaaacauguaucuggccaaaaucucacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacggucguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguucgcuguagggcuacuauuccgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcauuaugcauggaagacaauggcuaugguacugucaauuguaucucucuuccccuuaugccuguccacgaccucccaaaaaacaacauggcuuccggugcuguugggaucucuuggauguaaaccacuaaccauguuucuuauagcagaaaacaaaaucuggggaaggaaaaguuggccccucaaugaaggaaucauggcuguuggaauugucagcauccuacuaagcucacuccucaaaaaugaugugccgcuagcugggccacuaauagcuggaggcaugcuaauagcauguuauguuauaucuggaagcucagccgaucuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagauccggaguguuaugggacacaccuagcccuccagaaguggaaagagcaguucuugaugaugguaucuauagaaucaugcagagaggacuguugggcagaucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggcgaaguuggagccauugcccuagauuuuaaacccggcacaucuggaucucccaucgugaacagagaagggaaaauaguaggucuuuauggaaauggaguagugacaacaaguggaaccuacgucagugccauagcucaagcuaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuauaacaugauuaucauggaugaagcacauuucaccgauccauccagcauagcggcuagaggguacaucucaacccgagugggcaugggugaagcagcugcgaucuucaugacagccacucccccaggaucaguggaggccuuuccacagagcaacgcaguuauccaagaugaggaaagagacauuccugagagaucauggaacucaggcuaugaguggaucacugauuucccaggcaaaacaguuugguuuguuccaagcauuaaaucaggaaaugauauugccaacugcuuaagaaagaaugggaaacgggugauucaauugagcagaaaaaccuuugacacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaguuggaaggaaccacaauaaggaaggugaucaguacaucuacaugggacagccuuuaaacaacgaugaagaucacgcucacuggacggaagcaaaaaugcuccuugauaauauaaacacaccagaagggauuaucccagcccucuucgagccggagagagaaaagagugcagcaauagacggggaauacagacugcggggugaagcaaggaaaacguuuguggagcucaugagaagaggagaucuaccugucuggcuauccuacaaaguugccucagaaggcuuccaguacucugauagaagauggugcuuugacggggaaaggaacaaccagguguuggaggagaacauggacguggagaucuggacaaaagaaggagaaagaaagaaacuacgaccccguuggcuggaugccagaacauacucagacccacuggcccugcgcgaguuuaaagaguuugcagcaggaagaagaagcgucucaggagaucuaauauuagaaauagggaaacuuccacaacacuugacgcaaagggcccagaaugccuuggacaaccugguuauguuacacaacuccgaacaaggaggaagagccuauagacaugcaauggaagaauugccagacaccauugaaacguugaugcuccuagcuuugauagcuguguuaacugguggagugacgcuguucuuccuaucaggaaggggcuuagggaaaacaucuaucggccuacucugcgugauggcuucaagcguacugcuauggauggccaguguagagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagccauauugaugggacuugacaaaggauggccaauaucgaagauggacauaggaguuccacuucucgccuuggggugcuauucccaagugaauccacugacgcugacagcggcgguauugaugcuaguggcucauuacgcuauaauuggaccuggacugcaagcaaaagcuacuagagaagcucaaaaaaggacagcggccggaauaaugaaaaauccaaccguugauggaaucguugcaauagauuuggacccugugguuuaugaugcgaaauuugagaaacaacuaggccaaauaauguuguugauacuaugcacaucacagauccucuugaugcggacuacaugggccuugugcgaauccaucacacuggccacuggaccucugaccacgcucugggagggaucuccaggaaaauuuuggaacaccacgauagcgguuuccauggcaaacauuuucagaggaaguuaucuagcaggagcaggucuggccuucucauuaaugaaaucucuaggaggaggcaggagaggcacgggagcccaaggggaaacacugggagagaaauggaaaagacagcugaaccaauugagcaagucagaauucaacaccuauaaaaggagugggauuauggaaguggacagauccgaagccaaagagggacugaaaagaggggaaacaaccaaacaugcagugucgagaggaaccgcuaaauugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaagaaccaaucccaauggcgaccuauggauggaaccuaguaaagcugcacuccgggaaagacguauucuuuauaccaccugagaaaugugacacccucuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacauaugaaagagacguggaccuaggcgcuggaacaagacauguggcaguggaaccagagguagccaaccuagauaucauuggccagaggauagagaacauaaaacaugaacacaagucaacauggcauuaugaugaggacaauccauauaaaacaugggccuaucauggaucauaugaggucaagccaucaggaucagccucauccauggucaaugguguggugaaacugcucaccaaaccaugggaugucauccccauggucacacaaauagccaugacugacacuacacccuuuggacaacagaggguguuuaaagagaaaguugacacacgcacaccaaaagcaaaacgaggcacaacacaaaucauggaggugacagccaggugguuaugggguuuucuuucuagaaacaagaagccaagaauuuguacaagagaggaguuuacaagaaaaguuaggucaaacgcagccaucggagcaguguucguugacgaaaaucaauggaacucagcaaaagaagcaguggaagaugagcgguucugggaccuugugcacagagagagggagcuucacaaacagggaaaaugugcuacguguguuuacaacaugauggggaagagagagaaaaagcuaggagaauuuggaaaggcaaaaggaagucgugcaauaugguacaugugguugggagcacgcuuucuagaguucgaagcucuugguuucaugaacgaagaccacugguucagcagagagaauucacucagcggaguggaaggagaaggacuccacaaacuuggauauauacucagagacauaucaaagauuccaggaggaaacauguaugcagaugacacagccggaugggauacaaggauaacagaggaugaccuucagaaugaggccaaaauuacugacaucauggaacccgaacaugcccuacuggcuaaggcaaucuucaagcuaaccuaccaaaauaaagugguaaggguacagagaccagcaaaaaauggaaccgugauggaugucauauccagacgugaccagagaggaaguggccaggucggaacuuauggcuuaaacacuuucaccaacauggaagcccagcugauaagacaaauggagucugagggaaucuuuucacccagugaauuagagaccccaaauuuagccgagagaguucucgacuggcuggaaaaauauggcgucgaaaggcuaaaaagaauggcaaucaguggagaugacugcguagugaaaccaauugaugauagguuugcaacagccuuaacagcucugaaugauaugggaaaaguaagaaaagauauaccacaaugggaacccucaaaaggauggaaugauuggcaacaagugccuuuuuguucacaccacuuccaccagcugauuaugaaggaugggagggaaauaguggugccaugccgcaaccaagaugaacuuguggguagagcuagaguaucacaaggugcuggauggagccugagagaaaccgcaugccuaggcaaaucauaugcacaaauguggcagcugauguacuuccacaggagagaccugagacuagccgcuaaugcuaucuguucagccguuccaguugauugggucccaaccagccguaccaccuggucgauccaugcccaucaccaauggaugacaacagaagacaugcugucaguguggaauaggguuuggauagaggaaaacccauggauggaggacaaaacccauauauccaguugggaggauguuccauauuuagggaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6251 - RNA, 9879 nt, Artificial Sequence
  derived and/or modified CDS sequence (wt) from DENV-1__KC762620__SS-prME
ucugugaccaugcucuucaugcugcugcccacagcccuggcguuccaucugaccacccgagggggagagccgcacaugauaguuagcaagcaggaaagaggaaagucacuuuuguuuaagaccucugcaggugucaacauguguacccuuaucgcaauggauuugggagaguuaugugaggacacaaugaccuacaaaugcccccggaucacugaaacggaaccagaugacguugacugcuggugcaacgccacggagacaugggugacuuauggaacauguucucaaacuggugaacaccgacgagacaaacguuccgucgcauuggcaccacacguagggcuuggucuagaaacaagaaccgaaacguggauguccucugaaggcgcuuggaaacaaauacaaaaaguggagaccugggcucugagacacccaggauucacggugauagcucuuuuucuagcacaugccauaggaacauccaucacucagaaaggaauuauuuucauuuugcugaugcugguaacuccauccauggccaugcggugcgugggaauagguaacagagacuucguggaaggacugucaggagcuacguggguggaugugguacuggagcauggaaguugcguuacuaccauggcaaaagacaaaccaacacuggauauugaacucuuaaagacggaggucacaaacccagccguccugcgcaaacugugcauugaagccaaaauaucaaauaccaccaccgauucgagauguccaacacaaggagaagccacgcugguggaagaacaagacacgaacuuugugugucgacgaacguucguggacagaggcuggggcaaugguugugggcuauucggaaaaggcagcuuaauaacaugugccaaguuuaagugugugacaaaacuggaagggaagauaguccaauaugaaaauuuaaaauauucaguaauagucaccguccacacuggagaccagcaccaaguuggaaaugagacuauagaacauggaacaacugcuaccauaacaccucaagcucccacgucggaaauacagcugacagacuacggggcucuaacacuggacuguucacccagaacagggcuagacuuuaaugagaugguguuguugacuaugaaagaaaaaucauggcucguccacaaacaaugguuucuagacuuaccgcugccuuggaccucaggggcuucaacaucccaagagacuuggaauagacaagacuugcuggucacauucaagacagcucaugcaaagaagcaggaaguaguuguacuaggaucacaagaaggagcgaugcacacugcguugacuggagcgacagaaauccaaacgucuggaacgacaacaauuuuugcaggacaccugaaaugcagacugaaaauggauaaacugacucuaaaggggguaucauauguaaugugcacaggcucauucaagcuagaaaaggaaguggcugagacccaacauggaaccguucuagugcagguuaaguacgaaggaacagaugcaccauguaagauccccuucucaucccaagaugagaggggaguaauccagaaugggagauugauaacagccaaccccauagucacugacaaagaaaaaccagucaacauugaggcggagccaccuuuuggugagagcuacaucgugguaggagcaggugaaaaagcuuugaaacuaagcugguucaagaagggaagcaguauaggaaaaauguuugaagcaacugcccguggagcacgaaggauggccauucugggagacacugcaugggacuucgguucuauaggaggaguguucacguccgugggaaaacugguacaccagauuuuuggaacugcguauggaguuuuguucagcgguguuucuuggaccaugaaaauaggaauagggauucuacugacauggcuaggauuaaauucaaggaacacgucccuuucaaugacguguaucgcaguuggcaugguuacacuguaccuaggagucaugguucaggcggauucgggauguguaauuaacuggaaaggcagagaacucaaauguggaagcggcauuuuugucacuaaugaaguucacaccuggacagagcaauacaaauuccaggccgacuccccaaaaagacuaucagcagccauugggaaggcaugggaggaggguguguguggaauucgaucagccacucgucucgagaacaucauguggaagcaaauaucaaaugaauugaaccacaucuuacuugaaaaugacaugaaauucacaguggucguaggagacgucagugggaucuuggcccaaggaaagaaaaugauuaggccacaacccauggaacacaaauacucguggaaaagcuggggaaaagccaagaucauaggagcagauguacagaauaccaccuucaucaucgauggcccaaacaccccagaaugcccugauaaccaaagagcauggaacaucugggaaguugaagacuauggauuuggaguuuucacgacaaacauaugguugaaauugcgugacuccuacacucaagugugugaccaccggcuaaugucagcugcuauuaaggauagcaaagcaguccaugcugacaugggguacuggauagaaagugaaaagaacgagacuuggaaguuggaaagagccuccuuuauagaaguuaagacaugcaucuggccaagaucucacacucuauggagcaauggaguccuggaaagugagaugauaaucccaaagacauauggaggaccaguaucucagcacaacuacagaccaggauauuucacacaaacagcagggccguggcauuuaggcaaguuggaacuagauuuugauuugugugaagguaccacaguuguuguggaugaaaauuguggaaaucgaggaccaucucuuagaaccacaacagucacaggaaagauaauccaugaauggugcuguagaucuugcacguuacccccccuacguuucaaaggggaagacgggugcugguacggcauggaaaucagaccaguuaaggagaaggaagaaaaccuaguuaagucaauggucucugcagggucaggagaaguggacaguuuuucacuaggacugcuaugcauaucaauaaugaucgaagagguaaugagauccagauggagcggaaagaugcugaugacuggaacauuggcuguguuccuccuucucacaaugggacaacugacauggaaugaucugaucaggcuauguaucaugguuggagccaaugcuucagacaugauggggaugggaacaacguaccuagcuuugauggcuacuuucagaaugagaccaauguucgcagucgggcuguuauuucgcagacuaacauccagagaaguucuucuucuuacaguuggauugagccuggcggcaucuguagaacuaccaaauuccuuagaggagcuaggggauggacuugcaaugggcaucaugauguugaaauuacugacugauuuucagucacaucagcuaugggcuaccuugcugucuuuaacauuugucaaaacaacuuuuucauugcacuaugcauggaagacaauggccaugauacuaucaauuguaucucucuucccuuugugccuguccacgacuucucaaaaaacaacauggcuuccggugcugcugggaucucuuggaugcaaaccacuaaccaugcuucuuauaacagaaaacaaaauuugggggaggagaaguuggcccaucaaugaaggaauuauggcuauuggaauaguuagcauccuacuaaguucacuucucaaaaaugaugugccacuagcuggcccacuaauagcuggaggcaugcugauagcauguuaugucauauccggaagcucggccgauuugucacuggagaaagcggcugaggucuccugggaagaugaagcagaacacucuggugccucacacaacauacuaguagagguccaagaugacggaaccaugaagauaaaggaugaagagagggaugacacacucacuauucuccucaaagcaacucuguuagcaaucucagggguauacccaaugucaauaccagcgacccucuuugugugguauuuuuggcagaaaaagaaacagagaucaggagugcuaugggacacacccagcccuccagaaguggaaagagcaguccuugacgauggcauuuauagaauucuucaaagaggauugcugggcaggucucaaguaggaguaggaguuuuucaagaagguguguuccacacaauguggcacgucaccaggggagcuguccucauguaccaagggaagagauuggaaccaagcugggcuagugucaaaaaagacuugaucucauauggaggagguuggagguuucaaggauccuggaacacgggagaagaagugcaggugauugcuguugaaccggggaagaaccccaaaaauguacagacaacgccgggcaccuucaagaccucugaaggugaaguuggagccauagcucuagacuucaagcccggcacaucuggaucuccuaucgugaacagagaggggaaaauagugggucuuuauggaaauggaguggugacaacaaguggaaccuacgucagugccauagcucaagccaaagcaucacaagaagggccccuaccagagauugaggacgagguguuuaggaaaaggaacuuaacaauaauggaccuacauccaggaucagggaagacaagaagauaccuuccagccauacuccgugaggccauaaaaagaaagcugcgcacgcuagucuuggcccccacaagaguugucgcuucugaaauggcagaagcacucaagggaaugccaauaagguaucagacaacagcagugaaaagugaacacacgggaaaggagauaguugaucuuaugugucacgccacuuucaccaugcgucuccugucuccugugagaguccccaacuauaacaugauuaucauggaugaagcacauuucaccgauccagccagcauagcagccagaggguacaucucaacccgaguagguaugggugaagcagcugcgaucuucaugacagccacuccccccggaucgguggaggccuuuccacagagcaaugcaguuauccaagaugaggaaagagacauuccugaaagaucauggaacucaggcuaugacuggaucacugauuucccagguaaaacagucugguuuguuccaagcaucaaaucaggaaaugacauugccaacuguuuaagaaagaaugggaaacgggugguccaauugagcaggaaaacuuuugacacugaguaccagaaaacaaaaaauaacgacugggacuauguugucacaacagacauauccgaaaugggagcaaacuuccgagccgacaggguaauagacccaaggcggugccugaaaccaguaauacuaaaagaugguccagagcgcgucauccuagccggaccgaugccagugacuguggccagugccgcccagaggagaggaagaauuggaaggaacucaaauaaggaaggagaucaguauguguacaugggacagccucuaaauaaugaugaggaccacgcccauuggacagaagcaaaaaugcuccuugacaacauaaacacaccagaaggaaucauuccagcccucuuugagccggagagagaaaagagugcagcaauagacggggaauacagauuacggggugaagcgaggaaaacguucguggagcucaugagaagaggagaucuaccugucuggcuauccuacaaaguugccucagagggcuuccaguacucugacagaagguggugcuuugauggggaaaggaacaaccagguguuggaggagaacauggacguggagauuuggacaaaagagggagaaagaaagaaacuacgaccccgcuggcuggaugccagaacauauucugacccacuggcucugcgcgaguucaaagaguucgcagcaggaagaagaagcgucucaggugaucuaauauuagaaauagggaaacuuccacaacauuuaacgcaaaaggcccagaaugcuuuggacaaucuggucaugcugcacaacucugaacaaggaggaaaagccuacagacacgccauggaagaacuaccagacaccauagaaacguuaaugcuccuagcuuugauagcugugcugacugguggagugacguuguucuuccuaucaggaagaggucuaggaaaaacauccauuggccuacucugugugauggcuucaagugcauuguuauggauggccaguguggagccucauuggauagcggccuccaucauacuggaguucuuucugaugguguugcuuauuccagagccagacagacagcgcacuccacaagacaaccagcuagcauacguggugauaggcuuguuauucaugauauugacaguggcagccaaugagaugggauuguuggaaaccacaaagaaagaccuggggauuggucaugcagcagcugaaaaccaccaccaugcugcaaugcuggacguggaccuacauccagcuucagccuggacucucuaugcaguggccacaacaauuaucacucccaugaugagacacacaauugaaaacacaacggcaaauauuucccugacagcuauugcaaaccaggcagcuauauugaugggacuugacaagggauggccaauaucaaagauggacauaggaguuccacuucucgccuuggggugcuacucucaggugaacccguugacgcugacagcggcgguauugaugcuaguggcucauuaugccauaauuggaccuggacugcaggcaaaagcuacuagagaagcucaaaaaaggacagcagccggaauaaugaaaaacccaacugucgacgggaucguugcaauagauuuggacccuguaguuuaugaugcaaaauuugaaaaacagcuaggucaaauaauguuguugauacuuugcacaucacaaauucuccuaaugcggaccacaugggccuugugugaauccaucacauuggccacuggaccucugaccacgcuuugggagggaucuccaggaaaauucuggaauaccaccauagcgguguccauggcaaacauuuucaggggaaguuaucuagcaggagcaggucuggccuuuucauugaugaaaucucuaggaggagguaggagaggcacaggagcccaaggagaaacgcugggagaaaaauggaaaagacagcuaaaccaauugagcaaaucagaauuuaauauuuacaaaaggagugggauuauggagguggauagaucugaagccaaagagggguugaaaagaggagaaacaaccaaacaugcagugucgagaggaacggccaaauugaggugguuuguggagaggaaccuugugaaaccagaagguaaagucauugaccucgguuguggaagagguggcuggucauauuacugcgcugggcugaagaaagucacagaagugaaaggauacacgaaaggaggaccuggacaugaggaaccagucccaauggcaaccuauggauggaaccuaguaaagcuacacuccgggaaggauguauucuuuacaccaccugagaaaugugacacccuuuugugugauaucggugaguccucuccgaacccaaccauagaagaaggaagaacguuacguguucuaaagaugguggaaccauggcucagaggaaaccaauuuugcauaaaaauucuaaaucccuauaugccgagugugguagaaacucuggagcaaaugcaaagaaaacauggaggaaugcuagugcgaaauccacucucaagaaacuccacucaugaaauguacuggguuucauguggaacaggaaacauugugucagcaguaaacaugacauccagaaugcugcuaaaucgauucacaauggcucacaggaagccaacauaugaaaaagauguggacuuaggcgcuggaacaagacauguggcaguggaaccagagguggccaaccuagauaucauuggccagaggauagagaauauaaaaaaugagcacaaaucaacauggcauuacgaugaggacaauccauacaaaacaugggccuaucauggaucauaugaggucaagccaucaggaucagccucauccauggucaaugguguggugagacugcuaaccaaaccaugggaugucauucccauggucacacaaauagccaugacugauaccacacccuuuggacaacagaggguguuuaaagagaaaguugacacacgcacaccaaaagcgaaacgaggcacagcacaaauuauggagguaacagccaagugguugugggguuuucucucuagaaacaaaaaacccagaaucugcacaagagaggaguucacaagaaaagucagaucaaacgcagcuauuggagcaguguucguugaugaaaaucaauggaacucagcaaaagaggcaguggaagaugaacgauucugggaccuugugcacagagagagggagcuucauaaacaaggaaaaugugccacgugugucuacaacaugaugggaaagagagagaaaaaacuaggagaguucggaaaggcaaaaggaagucgcgcaauaugguacaugugguugggagcgcgcuuuuuagaguuugaggcccuugguuucaugaaugaagaucauugguucagcagagagaauucacucaguggaguggaaggagaaggacuccacaaacuuggauacauacucagagacauaucaaagauuccagggggaaauuuguaugcagaugacacagccggaugggacacaagaauaacagaggaugaucuucagaaugaggccaaaaucacugacaucauggaacccgaacaugcccuacuggccacgucaaucuuuaaacuaaccuaccaaaacaagguaguaagggugcagagaccagcaaaaaauggaaccgugauggaugucauauccagacgugaucagagaggaaguggacagguuggaaccuauggcuuaaacaccuucacuaacauggaggcccaacuaauaagacaaauggagucugagggaaucuuuucacccagcgaauuggaaaccccaaaucuagcuaaaagaguccucgacugguuggaaaaacauggcaucgagaggcugaaaaggauggcaaucaguggagaugacuguguggugaaaccaauugaugacagauuugcaacagccuuaacagccuugaaugacaugggaaagguaagaaaagacauaccgcaaugggaaccuucaaaaggauggaacgauuggcaacaagugcccuuuuguucacaccauuuccaccagcugauuaugaaggaugggagggagauaguggugccaugccgcaaccaagaugaacuuauagguagggccagagucucacaaggcgccggauggagcuuaagagaaacugcaugccuaggcaagucauaugcacaaauguggcagcugauguauuuccauaggagagaucugagacuagcggcuaaugccaucuguucagccguuccaguugacugggucccaaccagccgcaccaccuggucgauccaugcccaccaucaauggaugacaacagaagacauguugucaguguggaauaggguuuggauagaggaaaacccauggauggaggauaaaacucauguguccaguugggaagacguuccauaccuaggaaaaagggaagaucaaugguguggaucccuaauaggcuuaacagcacgagccaccugggccagcaacauacaaguggccauaaaccaagugagaaggcucauugggaacgagaauuaucuagacuauaugacaucaaugaagagauucaaaaacgagagugaucccgaaggggcacucugguaa

SEQ ID NO: 6252 - RNA, 9879 nt, Artificial Sequence
  derived and/or modified CDS sequence (wt) from DENV-1__KC762631__SS-prME
ucugugaccaugcuccuuaugcugaugccuacagccuuggcguuccauuugacuacacgagggggagagccgcacaugacagucagcaagcaggaaagaggaaagucacuuuuguuuaagaccucagcaggugucaacaugugcacccuuauagcgauggauuugggagaguuaugugaggacacacugacuuacaaaugcccucgaauuacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccuccgaaggcgcuuggaaacagauacaaagaguggagacuugggcccugagacacccaggauucacggugauagcccuuuuucuagcacaugccauaggaacauccaucacccagaaagggauuaucuucauuuuguuaaugcugguuacaccauccauggccaugcgaugcgugggaauaggcagcagggacuucguggaaggacugucaggagcaacuuggguagauguggugcuggaacauggaaguugcgucacuaccauggcaaaagacaaaccaacauuggacauugaacucuugaagacggaagucacaaacccugccguccugcgcaaacuaugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuuauaacgugugcuaaguucaagugugugacaaaacuggaaggaaaaauaguucaguaugaaaacuugaaauauucaguaauagucaccguccacacuggggaccagcaucaggugggaaaugaaagcacagaacaugggacaacugcaacuauaacaccucaagcuccuacgacagaaauacaguugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagaaacuuggaacagacaagauuugcuggugacauucaagacagcucaugcaaagaagcaggaaguagucguacuaggaucacaagaaggagcaaugcacacugcgcugaccggagcgacggaaauccaaacgucuggaacgacaacaauuuuugcaggacacuugaaauguagacuaaagauggacaaacugacucuaaaagggaugucauaugugaugugcacaggcucauucaagcuagagaaagaaguggcugagacccagcauggaaccguucuagugcagaucaaauacgaaggaacagaugcaccaugcaagauuccuuuuucgacccaagaugaaaaaggaguaacccagaaugggagauugauaacagccaaccccauagucacugauaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagaucuuuggaacugcauauggaguuuuguucagcgguguuuccuggaccaugaaaauaggaauagggguucugcugacauggcuaggauuaaacucaaggagcacgucccuuucgaugacgugcauugcaguuggccuaguaacgcuauacuuaggagucaugguucaggcggauucaggauguguaauuaauuggaaagguagagaacucaaauguggaaguggcauuuuugucaccaaugaaguucacacuuggacagagcaauacaaauuucaagcugauuccccaaagagacuaucagcagccauugggaaggcaugggaggaggguguguguggaauucgaucagcaacucgucucgagaacaucauguggaagcaaauaucaaaugaauugaaccacaucuuacuugaaaaugacaugaaauucacagugguuguaggagauguugcugggaucuuggcucaaggaaaaaaaaugauuaggccacaacccauggaacacaaauacucguggaaaagcuggggaaaggcuaaaaucauaggggcagauguacagaauaccaccuuuaucaucgacggcccaaacaccccagaaugcccugaugaucaaagagcauggaacauuugggaaguugaggauuauggauuuggaauuuucacgacaaacauauggcugaaauugcgugacuccuacacccaggugugugaccaccggcuaaugucagcugccaucaaggacagcaaggcaguucacgcugacaugggguacuggauagaaagugaaaagaacgagaccuggaagcuggcaagagccucuuucauagaagucaaaacauguaucuggccaaaaucucacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacggucguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguagggcuacuauuccgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuaugcauggaagacaauggcuaugguacugucaauuguaucucucuucccuuuaugccuguccacgaccucccaaaaaacaacauggcuuccggugcuguugggaucucuuggauguaaaccacuaaccauguuucuuauagcagaaaacaaaaucuggggaaggaaaaguuggccccucaaugaaggaaucauggcuguuggaauugucagcauccuacuaagcucacuucucaaaaaugaugugccgcuagcugggccacuaauagcuggaggcaugcuaauagcauguuauguuauaucuggaagcucagccgaucuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaaucaugcagagaggacuguuggguagaucccaaguagggguaggaguuuuucaagaaaauuuguuccacacaauguggcaugucaccaggggagcuguccucauguaucaagggaagagacuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuucaagaccccugaaggcgaaguuggagccauugcccuagauuuuaaacccggcacaucuggaucucccaucgugaacagagaagggaaaauaguaggucuuuauggaaauggaguagugacaacaaguggaaccuacgucagugccauagcucaagcuaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuauaacaugauuaucauggaugaagcacauuucaccgauccauccagcauagcggcuagaggguacaucucaacccgagugggcaugggugaagcagcugcgaucuucaugacagccacucccccaggaucaguggaggccuuuccacagagcaacgcaguuauccaagaugaggaaagagacauuccugagagaucauggaacuuaggcuaugaguggaucacugacuucccaggcaaaacaguuugguuuguuccaagcauuaaaucaggaaaugauauugccaacugcuuaagaaagaaugggaaacgggugauucaauugagcagaaaaaccuuugacacagaguaccaaaaaacaaaaaauaacgauugggacuacgucgucacaacagacaucucugaaaugggagcaaauuuccgggccgacagggugauagacccaagacggugucugaaaccgguaauacugaaagaugguccagagcgugucauuuuagcaggaccgaugccagugacuguggccagugccgcccagaggagaggaagaguuggaaggaaccacaauaaggaaggugaucaguacaucuacaugggacagccuuuaaacaacgaugaagaucacgcucacuggacggaagcaaaaaugcuccuugauaauauaaacacaccagaagggauuaucccagcccucuucgagccggagagagaaaagagugcagcaauagacggggaauacagacugcggggugaagcaaggaaaacguuuguggagcucaugagaagaggagaucuaccugucuggcuauccuacaaaguugccucagaaggcuuccaguacucugauagaagauggugcuuugacggggaaaggaacaaccagguguuggaggagaacauggacguggagaucuggacaaaagaaggagaaagaaagaaacuacgaccccguuggcuggaugccagaacauacucagacccacuggcccugcgcgaguuuaaagaguuugcagcuggaagaagaagcgucucaggagaucuaauauuggaaauagggaaacuuccacaacacuugacgcaaagggcccagaaugccuuggacaaccugguuauguuacacaacuccgaacaaggaggaagagccuauagacaugcaauggaagaacugccagaaaccauagaaacguugaugcuccuagcuuugauagcuguguuaacugguggagugacgcuguucuuccuaucaggaaggggcuuagggaaaacaucuaucggccuacucugcgugauggcuucaagcguacugcuauggauggccaguguagagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagccauauugaugggacuugacaaaggauggccaauaucgaagauggacauaggaguuccacuucucgccuuggggugcuauucccaagugaauccacugacgcugacagcggcgguauugaugcuaguggcucauuacgcuauaauuggaccuggacugcaagcaaaagcuacuagagaagcucaaaaaaggacagcggccggaauaaugaaaaauccaaccguugauggaaucguugcaauagauuuggacccugugguuuaugaugcgaaauuugagaaacaacuaggccaaauaauguuguugauacuaugcacaucacagauccucuugaugcggaccacaugggccuugugcgaauccaucacacuggccacuggaccucugaccacacucugggagggaucuccaggaaaauuuuggaacaccacgauagcgguuuccauggcaaauaucuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacaccuauaaaaggagugggauuauggaaguggacagauccgaagccaaagagggacugaaaagaggggaaacaaccaaacaugcagugucgagaggaaccgcuaaauugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaagaaccaaucccaauggcgaccuauggauggaaccuaguaaagcugcacuccgggaaagacguauucuuuauaccaccugagaaaugugacacccucuugugugauauuggugaguccucuccaaacccaacuauagaagaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacauaugaaagagacguggaccuaggcgcuggaacaagacauguggcaguggaaccagagguagccaaccuagauaucauuggccagaggauagagaacauaaaacaugaacacaagucaacauggcauuaugaugaggacaauccauauaaaacaugggccuaucauggaucauaugaggucaagccaucaggaucagccucauccauggucaaugguguggugaaacugcucaccaaaccaugggaugucauccccauggucacacaaauagccaugacugacacuacacccuuuggacaacagaggguguuuaaagagaaaguugacacacgcacaccaaaagcaaaacgaggcacaacacaaaucauggaggugacagccaggugguuaugggguuuucuuucuagaaacaagaagccaagaauuuguacaagagaggaguucacaagaaaaguuaggucaaacgcagccaucggagcaguguucguugacgaaaaucaauggaacucagcaaaagaagcaguggaagaugagcgguucugggagcuugugcacagagagagggagcuucacaaacagggaaaaugugcuacguguguuuacaacaugauggggaagagagagaaaaagcuaggagaauuuggaaaggcaaaaggaagucgugcaauaugguacaugugguugggagcacgcuuucuagaguucgaagcucuugguuucaugaacgaagaccacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccaaaauuaccgacaucauggaacccgaacaugcccuacuggcuaaggcaaucuucaagcuaaccuaccaaaauaaagugguaaggguacagagaccagcaaaaaauggaaccgugauggaugucauauccagacgugaccagagaggaaguggccaggucggaacuuauggcuuaaacacuuucaccaacauggaagcccagcugauaagacaaauggagucugagggaaucuuuucacccagugaauuagagaccccaaauuuagccgagagaguucucgacuggcuggaaaaauauggcgucgaaaggcuaaaaagaauggcaaucaguggagaugacugcguagugaaaccaauugaugauagguuugcaacagccuuaacagcucugaaugauaugggaaaaguaagaaaagauauaccacaaugggaacccucaaaaggauggaaugauuggcaacaagugccuuuuuguucacaccacuuccaccagcugauuaugaaggaugggagggaaauaguggugccaugccgcaaccaagaugaacuuguggguagagcuagaguaucacaaggugcuggauggagccugagagaaaccgcaugccuaggcaaaucauaugcacaaauguggcagcugauguacuuccacaggagagaucugagacuagccgcuaaugcuaucuguucagccguuccaguugauugggucccaaccagccguaccaccuggucgauccaugcccaucaccaauggaugacaacagaagacaugcugucaguguggaauaggguuuggauagaggaaaacccauggauggaggacaaaacccauauauccaguugggaagauguuccuuauuuagggaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6253 - RNA, 9879 nt, Artificial Sequence
  derived and/or modified CDS sequence (wt) from DENV-1__KC762621__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuaugugaggacacacugacuuacaaaugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggaaacuugggcccugagacacccaggauucacggugauagcccuuuuucuagcacaugccauaggaacauccaucacccagaaagggauuaucuucauuuuguuaaugcuggucacaccauccauggccaugcgaugcgugggaauagguagcagggacuucguggaaggacugucaggagcaacuuggguagauguggugcuggaacauggaaguugcgucacuaccauggcaaaagacaaaccaacauuggacauugaacucuugaagacggaagucacaaacccugccguccugcgcaaacuaugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuuauaacgugugcuaaguucaagugugugacaaaacuggaaggaaaaauaguucaguaugaaaacuugaaauauucaguaauagucaccguccacacuggagaccagcaucaggugggaaaugaaagcacagaacaugggacaacugcaacuauaacaccucaagcuccuacgacagaaauacaguugaccgacuacggagcucucacauuggauuguucaccuaggacaggacuagacuuuaaugaaaugguguuguugacaaugaaagaaaaaucauggcuaguccacaaacaaugguuucuagaccuaccacugccuuggaccucgggagcuucaacaucacaagaaacuuggaacagacaagauuugcuggugacauuuaagacagcucaugcaaagaagcaggaaguagucguacuaggaucacaagaaggagcaaugcacacugcgcugaccggagcgacggaaauccaaacgucuggaacgacaacaauuuuugcaggacacuugaaauguagacuaaagauggacaaacugacucuaaaagggaugucauaugugaugugcacaggcucauucaagcuagagaaagaaguagcugagacccagcauggaaccguucuagugcagaucaaauacgaaggaacagaugcaccaugcaagauuccuuuuucgacccaagaugaaaaaggaguaacccagaaugggagauugauaacagccaaccccauagucaccgauaaagaaaaaccagucaacauugaggcagaaccgccuuuuggugagaguuacaucgugauaggagcaggugaaaaagcuuuaaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagaucuuuggaacugcauauggaguuuuguucagcgguguuuccuggaccaugaaaauaggaauagggguucugcugacauggcuaggauuaaacucaaggagcacgucccuuucgaugacgugcauugcaguuggucuaguaacgcuauacuuaggagucaugguucaggcggauucaggauguguaauuaauuggaaagguagagaacucaaauguggaaguggcauuuuugucaccaaugaaguucacaccuggacagagcaauacaaauuucaagcugauuccccaaagagacuaucagcagccauugggaaggcaugggaggaggguguguguggaauucgaucagcaacucgucucgagaacaucauguggaagcaaauaucaaaugaauugaaccacaucuuacuugaaaaugacaugaaauucacagugguuguaggagauguugcugggaucuuggcucaaggaaaaaagaugauuaggccacaacccauggaacacaaauacucguggaaaagcuggggaaaggcuaaaaucauaggggcagauguacagaacaccaccuuuaucaucgacggcccaaacaccccagaaugcccugaugaucaaagagcauggaacauuugggaaguugaggauuauggauuuggaauuuucacgacaaacauauggcugaaauugcgugacuccuacacccaggugugugaccaccggcuaaugucagcugccaucaaggacagcaaggcaguucacgcugacaugggguacuggauagaaagugaaaagaacgagaccuggaagcuggcaagagccucuuucauagaagucaaaacauguaucuggccaaaaucucacacucuauggagcaauggaguucuggaaagugaaaugauaauuccaaagaucuauggaggaccaacaucucagcacaacuacagaccaggauauuucacacaaacggcagggccguggcaccuaggcaaguuggaacuggauuuugauuugugugaggguaccacggucguuguggaugaacauuguggaaaucgaggaccaucucuuaggaccacaacagucacaggaaaaauaauucaugaaugguguugcagaucuuguacgcuaccacccuuacguuucagaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaaugcuuccgacaggauggggaugggaacgacguaccuagcucugauggccacuuuuaaaaugagaccaauguuugcuguagggcuacuauuccgcagacuaacauccagagaaguucuucuucugacaauuggauuaagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcauuaugcauggaagacaauggcuaugguacugucaauuguaucucucuuccccuuaugccuguccacgaccucccaaaaaacaacauggcuuccggugcuguugggaucucuuggauguaaaccacuaaccauguuucuuauagcagaaaacaaaaucuggggaaggaaaaguuggccccucaaugaaggaaucauggcuguuggaauugucagcauccuacuaagcucacuccucaaaaaugaugugccgcuagcugggccacuaauagcuggaggcaugcuaauagcauguuauguuauaucuggaagcucagccgaucuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacacccagcccuccagaaguggaaagagcaguucuugaugaugguaucuauagaaucaugcagagaggacuguugggcagaucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggcgaaguuggagccauugcccuagauuuuaaacccggcacaucuggaucucccaucgugaacagagaagggaaaauaguaggucuuuauggaaauggaguagugacaacaaguggaaccuacgucagugccauagcucaagcuaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaaguugcgcacacuaauucuggcucccacaaggguugucgcuuccgaaauggcagaggcgcuuaagggaaugccaauaagguaccaaacaacagcagugaagagugaacacacaggaaaagagauaguugaccucaugugucacgccacuuucaccaugcgccuccugucucccgugagaguucccaauuauaacaugauuaucauggaugaagcacauuucaccgauccauccagcauagcggcuagaggguacaucucaacccgaguaggcaugggugaagcagcugcgaucuucaugacagccacucccccaggaucaguggaggccuuuccacagagcaacgcaguuauccaagaugaggaaagagacauuccugagagaucauggaacucaggcuaugaguggaucacugacuucccaggcaaaacaguuugguuuguuccaagcauuaaaucaggaaaugauauugccaacugcuuaagaaagaaugggaaacgggugauucaauugagcagaaaaaccuuugacacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaguuggaaggaaccacaauaaggaaggugaucaguacaucuacaugggacagccucuaaacaacgaugaagaucacgcucacuggacggaagcaaaaaugcuccuugauaauauaaacacaccagaagggauuaucccagcccucuucgagccggagagagaaaagagugcagcaauagacggggaauacagacugcggggugaagcaaggaaaacguuuguggagcucaugagaagaggagaucuaccugucuggcuauccuacaaaguugccucagaaggcuuccaguacucugauagaagauggugcuuugacggggaaaggaacaaccagguguuggaggagaacauggacguggagaucuggacaaaagaaggagaaagaaagaaacuacgaccccguuggcuggaugccagaacauacucagacccacuggcccugcgcgaguuuaaagaguuugcagcaggaagaagaagcgucucaggagaucuaauauuagaaauagggaaacuuccacaacacuugacgcaaagggcccagaaugccuuggacaaccugguuauguuacacaacuccgaacaaggaggaagagccuauagacaugcaauggaagaacugccagacaccauagaaacuuugaugcuccuagcuuugauagcuguguuaacugguggagugacgcuguucuuccugucaggaaggggcuuaggaaaaacaucuaucggccuacucugcgugauggcuucaagcguacugcuauggauggccaguguagagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggcuauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagccauauugaugggacuugauaaaggauggccaauaucgaagauggacauaggaguuccacuucucgccuuggggugcuauucccaagugaauccacugacgcugacagcggcgguauugaugcuaguggcucauuacgcuauaauuggaccuggacugcaagcaaaagcuacuagagaagcucaaaaaaggacagcggccggaauaaugaaaaauccaaccguugauggaaucguugcaauagauuuggacccugugguuuaugaugcgaaauuugagaaacaacuaggccagauaauguuguugauacuaugcacaucacagauccucuugaugcggacuacaugggccuugugcgaauccaucacacuggccacuggaccucugaccacgcucugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacaggagcccaaggggaaacacugggagagaaauggaaaagacagcugaaccaacugagcaagucagaauucaacaccuauaaaaggagcgggauuauggaaguggacagauccgaagccaaagagggacugaaaagaggggaaacaaccaaacaugcagugucgagaggaaccgcuaaauugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaagaaccaaucccaauggcgaccuauggauggaaccuagugaagcugcacuccgggaaagacguauucuuuauaccaccugagaaaugugacacccucuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacauaugaaagagacguggaccuaggcgcuggaacaagacauguggcaguggaaccagagguagccaaccuagauaucauuggccagaggauagagaacauaaaacaugaacacaagucaacauggcauuaugaugaggacaauccauauaaaacaugggccuaucauggaucauaugagguuaagccaucaggaucagccucauccauggucaaugguguggugaaacugcucaccaaaccaugggaugucauccccauggucacacaaauagccaugacugacacuacacccuuuggacaacagaggguguuuaaagagaaaguugacacacgcacaccaaaagcaaaacgaggcacaacacaaaucauggaggugacagccaggugguuaugggguuuucuuucuagaaacaagaagccaagaauuuguacaagagaggaguuuacaagaaaaguuaggucaaacgcagccaucggagcaguguucguugacgaaaaucaauggaacucagcaaaagaagcaguggaagaugagcgguucugggaccuugugcacagagagagggagcuucacaaacagggaaaaugugcuacguguguuuacaacaugauggggaagagagagaaaaagcuaggagaauuuggaaaggcaaaaggaagucgugcaauaugguacaugugguugggagcacgcuuucuagaguucgaagcucuugguuucaugaacgaagaccacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccaaaauuacugacaucauggaacccgaacaugcccuacuggcuaaggcaaucuucaagcuaaccuaccaaaauaaagugguaaggguacagagaccagcaaaaaauggaaccgugauggaugucauauccagacgugaccagagaggaaguggccaggucggaacuuauggcuuaaacacuuucaccaacauggaagcccagcugauaagacaaauggagucugagggaaucuuuucacccagugaauuagagaccccaaauuuagccgagagaguucucgacuggcuggaaaaauauggcgucgaaaggcuaaaaagaauggcaaucaguggagaugacugcguagugaaaccaauugaugauagguuugcaacagccuuaacagcucugaaugauaugggaaaaguaagaaaagauauaccacaaugggaacccucaaaaggauggaaugauuggcaacaagugccuuuuuguucacaccacuuccaccagcugauuaugaaggaugggagggaaauaguggugccaugccgcaaccaagaugaacuuguggguagagcuagaguaucacaaggugcuggauggagccugagagaaaccgcaugccuaggcaaaucauaugcacaaauguggcagcugauguacuuccacaggagagaccugagacuagccgcuaaugcuaucuguucagccguuccaguugauugggucccaaccagccguaccaccuggucgauccaugcccaucaccaauggaugacaacagaagacaugcugucaguguggaauaggguuuggauagaggaaaacccauggauggaggacaaaacccauguauccaguugggaggauguuccauauuuagggaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6254 - RNA, 9879 nt, Artificial Sequence
  derived and/or modified CDS sequence (wt) from DENV-1__KC762643__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuaugugaggacacacugacuuacaaaugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauggcccuuuuucuagcacaugccauaggaacauccaucacccagaaagggauuaucuucauuuuguuaaugcuggucacaccauccauggccaugcgaugcgugggaauaggcagcagggacuucguggaaggacugucaggagcaacuuggguagauguggugcuggaacauggaaguugcgucacuaccauggcaaaagacaaaccaacauuggacauugaacucuugaagacggaagucacaaacccugccguccugcgcaaacuaugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuuauaacgugugcuaaguucaagugugugacaaaacuggaaggaaaaauaguucaguaugaaaacuugaaauauucaguaauagucaccguccacacuggagaccagcaucaggugggaaaugaaagcacagaacaugggacaacugcaacuauaacaccucaagcuccuacgacagaaauacaguugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagaaacuuggaacagacaagauuugcuggugacauuuaagacagcucaugcaaagaagcaggaaguagucguacuaggaucacaagaaggagcaaugcacacugcgcugaccggagcgacugaaauccaaacgucuggaacgacaacaauuuuugcaggacacuugaaauguagacuaaagauggacaaacugacucuaaaagggaugucauaugugaugugcacaggcucauucaagcuagagaaagaaguggcugagacccagcauggaaccguucuagugcagaucaaauacgaaggaacagaugcaccaugcaagauuccuuuuucgacccaagaugaaaaaggaguaacccagaaugggagauugauaacagccaaccccauagucacugauaaagaaaaaccagucaacauugaggcagaaccgccuuuuggugagaguuacaucgugauaggagcaggugaaaaagcuuugaaacuaagcugguucaagaaaggaagcagcauaggaaaaauguuugaggcaacugccagaggagcacgaaggauggccauacugggagacaccgcaugggacuuugguucuauaggaggagugcucacgucuguuggaaaauuaguacaccagaucuuuggaacugcauauggaguuuuguucagcgguguuuccuggaccaugaaaauaggaauagggguucugcugacauggcuaggauuaaacucaaggagcacgucccuuucgaugacgugcauugcaguuggucuaguaacgcuauacuuaggagucaugguucaggcggauucaggauguguaauuaauuggaaagguagagaacucaaauguggaaguggcauuuuugucaccaaugaaguucacaccuggacagagcaauacaaauuucaagcugauuccccaaagagacuaucagcagccauugggaaggcaugggaggaggguguguguggaauucgaucagcaacucgucucgagaacaucauguggaagcaaauaucaaaugaauugaaccacaucuuacuugaaaaugacaugaaauucacagugguuguaggagauguugcugggaucuuggcucaaggaaaaaagaugauuaggccacaacccauggaacacaaauacucguggaaaagcuggggaaaggcuaaaaucauaggggcagauguacagaacaccaccuuuaucaucgacggcccaaacaccccagaaugcccugaugaucaaagagcauggaacauuugggaaguugaggauuauggauuuggaauuuucacgacaaacauauggcugaaauugcgugacuccuacacccaggugugugaccaccggcuaaugucagcugccaucaaggacagcaaggcaguucacgcugacaugggguacuggauagaaagugaaaagaacgagaccuggaagcuggcaagagccucuuucauagaagucaaaacauguaucuggccaaaaucucacacucuauggagcaauggaguucuggaaagugaaaugauaauuccaaagaucuauggaggaccaacaucucagcacaacuacagaccaggauauuucacacaaacggcagggccguggcaccuaggcaaguuggaacuggauuuugauuugugugaggguaccacggucguuguggaugaacauuguggaaaucgaggaccaucucuuaggaccacaacagucacaggaaaaauaauucaugaaugguguugcagaucuuguacgcuaccacccuuacguuucagaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaaugcuuccgacaggauggggaugggaacgacguaccuagcucugauggccacuuuuaaaaugagaccaauguuugcuguagggcuacuauuccgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcauuaugcauggaagacaauggcuaugguacugucaauuguaucccucuuccccuuaugccuguccacgaccucccaaaaaacaacauggcuuccggugcuguugggaucucuuggauguaaaccacuaaccauguuucuuauagcagaaaacaaaaucuggggaaggaaaaguuggccccucaaugaaggaaucauggcuguuggaauugucagcauccuacuaagcucacuccucaaaaaugaugugccgcuagcugggccacuaauagcuggaggcaugcuaauagcauguuauguuauaucuggaagcucagccgaucuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacacccagcccuccagaaguggaaagagcaguucuugaugaugguaucuauagaaucaugcagagaggacuguugggcagaucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggcgaaguuggagccauugcucuagauuuuaaacccggcacaucuggaucucccaucgugaacagagaggggaaaauaguaggucuuuauggaaauggaguagugacaacaaguggaaccuacgucagugccauagcucaagcuaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaaguugcgcacacuaauucuggcucccacaaggguugucgcuuccgaaauggcagaggcgcuuaagggaaugccaauaagguaccaaacaacagcagugaagagugaacacacaggaaaagagauaguugaccucaugugucacgccacuuucaccaugcgccuccugucucccgugagaguucccaauuauaacaugauuaucauggaugaagcacauuucaccgauccauccagcauagcggcuagaggguacaucucaacccgagugggcaugggugaagcagcugcgaucuucaugacagccacucccccaggaucaguggaggccuuuccacagagcaacgcaguuauccaagaugaggaaagagacauuccugagagaucauggaacucaggcuaugaguggaucacugacuucccaggcaaaacaguuugguuuguuccaagcauuaaaucaggaaaugauauugccaacugcuuaagaaagaaugggaaacgggugauucaauugagcagaaaaaccuuugacacagaguaccaaaaaacaaaaaauaacgacugggacuacguugucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaguuggaaggaaccacaauaaggaaggugaucaguacaucuacaugggacagccuuuaaacaacgaugaagaucacgcucacuggacggaagcaaaaaugcuccuugauaauauaaacacaccagaagggauuaucccagcccucuucgagccggagagagaaaagagugcagcaauagacggggaauacagacugcggggugaagcaaggaaaacguuuguggagcucaugagaagaggagaucuaccugucuggcuauccuacaaaguugccucagaaggcuuccaguacucugauagaagauggugcuuugacggggaaaggaacaaccagguguuggaggagaacauggacguggagaucuggacaaaagaaggagaaagaaagaaacuacgaccccguuggcuagaugccagaacauacucagacccacuggcccugcgcgaguuuaaagaguuugcagcaggaagaagaagcgucucaggagaucuaauauuagaaauagggaaacuuccacaacacuugacgcaaagggcccagaaugccuuggacaaccugguuauguuacacaacuccgaacaaggaggaagagccuauagacaugcaauggaagaacugccagacaccauagaaacuuugaugcuccuagcuuugauagcuguguuaacugguggagugacgcuguucuuccuaucaggaaggggcuuagggaaaacaucuaucggccuacucugcgugauggcuucaagcguacugcuauggauggccaguguagagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagccauauugaugggacuugauaaaggauggccaauaucgaagauggacauaggaguuccacuucucgccuuggggugcuauucccaagugaauccacugacgcugacagcggcgguguugaugcuaguggcucauuacgcuauaauuggaccuggacugcaagcaaaagcuacuagagaagcucaaaaaaggacagcggccggaauaaugaaaaauccaaccguugauggaaucguugcaauagauuuggacccugugguuuaugaugcgaaauuugagaaacaacuaggccagauaauguuguugauacuaugcacaucacagauccucuugaugcggacuacaugggccuugugcgaauccaucacacuggccacuggaccucugaccacgcucugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacaggagcccaaggggaaacacugggagagaaauggaaaagacagcugaaccaacugagcaagucagaauucaacaccuauaaaaggagcgggauuauggaaguggacagauccgaagccaaagagggacugaaaagaggggaaacaaccaaacaugcagugucgagaggaaccgcuaaauugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaagaaccaaucccaauggcgaccuauggauggaaccuaguaaagcugcacuccgggaaagacguauucuuuauaccaccugagaaaugugacacccucuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacauaugaaagagacguggaccuaggcgcuggaacaagacauguggcaguggaaccagagguagccaaccuagauaucauuggccagaggauagagaacauaaaacaugaacacaagucaacauggcauuaugaugaggacaauccauauaaaacaugggccuaucauggaucauaugagguuaagccaucaggaucagccucauccauggucaaugguguggugaaacugcucaccaaaccaugggaugucauccccauggucacacaaauagccaugacugacacuacacccuuuggacaacagaggguguuuaaagagaaaguugacacacgcacaccaaaagcaaaacgaggcacaacacaaaucauggaggugacagccaggugguuaugggguuuucuuucuagaaacaagaagccaagaauuuguacaagagaggaguuuauaagaaaagucaggucaaacgcagccaucggagcaguguucguugacgaaaaucaauggaacucagcaaaagaagcaguggaagaugagcgguucugggaccuugugcacagagagagggagcuucacaaacagggaaaaugugcuacguguguuuacaacaugauggggaagagagagaaaaagcuaggagaauuuggaaaggcaaaaggaagucgugcaauaugguacaugugguugggagcacgcuuucuagaguucgaagcucuugguuucaugaacgaagaccacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccaaaauuacugacaucauggaacccgaacaugcccuacuggcuaaggcaaucuucaagcuaaccuaccaaaauaaagugguaaggguacagagaccagcaaaaaauggaaccgugauggaugucauauccagacgugaccagagaggaaguggccaggucggaacuuauggcuuaaacacuuucaccaacauggaagcccagcugauaagacaaauggagucugagggaaucuuuucacccagugaauuagagaccccaaauuuagccgagagaguucucgacuggcuggaaaaauauggcgucgaaaggcuaaaaagaauggcaaucaguggagaugacugcguagugaaaccaauugaugauagguuugcaacagccuuaacagcucugaaugauaugggaaaaguaagaaaagauauaccacaaugggaacccucaaaaggauggaaugauuggcaacaagugccuuuuuguucacaccacuuccaccagcugauuaugaaggaugggagggaaauaguggugccaugccgcaaccaagaugaacuuguggguagagcuagaguaucacaaggugcuggauggagccugagagaaaccgcaugccuaggcaaaucauaugcacaaauguggcagcugauguacuuccacaggagagaccugagacuagccgcuaaugcuaucuguucagccguuccaguugauugggucccaaccagccguaccaccuggucgauccaugcccaucaccaauggaugacaacagaagacaugcugucaguguggaauaggguuuggauagaggaaaacccauggauggaggacaaggcccauguauccaguugggaggauguuccauauuuagggaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6255 - RNA, 9879 nt, Artificial Sequence
  derived and/or modified CDS sequence (wt) from DENV-1__KC762651__SS-prME
ucugugaccaugcucuucaugcugcugcccacagcccuggcguuccaucugaccacccgagggggagagccgcacaugauaguuagcaagcaggaaagaggaaaaucacuuuuguuuaagaccucugcagguguuaacauguguacccuuaucgcaauggauuugggagaguuaugugaggacacaaugaccuacaaaugcccccggaucacugaaacggaaccagaugacguugacugcuggugcaacgccacggagacaugggugacuuauggaacauguucucaaacuggugaacaccgacgagacaaacguuccgucgcauuggcaccacacguagggcuugguuuagaaacaagaaccgaaacguggauguccucugaaggcgcuuggaaacaaauacaaaaaguggagaccugggcucugagacacccaggauucacggugauagcucuuuuucuagcacaugccauaggaacauccaucacucagaaaggaauuauuuucauuuugcugaugcugguaacuccauccauggccaugcggugcgugggaauagguaacagagacuuuguggaaggacugucaggagcuacguggguggaugugguacuggagcauggaaguugcguuacuaccauggcaaaagacaaaccaacacuggauauugaacucuuaaagacggaggucacaaacccagccguccugcgcaaacugugcauugaagccaaaauaucaaauaccaccaccgauucgagauguccaacacaaggagaagccacgcugguggaagaacaagacacgaacuuugugugucgacgaacguucguggacagaggcuggggcaaugguugugggcuauucggaaaaggcagcuuaauaacaugugcuaaguuuaagugugugacaaaacuggaaggaaagauaguccaauaugaaaauuuaaaauauucaguaauagucaccguccacacuggagaccagcaccaaguuggaaaugagacuacagaacauggaacaacugcuaccauaacaccucaagcucccacgucggaaauacagcugacagacuacggggcucuaacacuggacuguucacccagaacagggcuagacuuuaaugagaugguguuguugacuaugaaagaaaaaucauggcucguccacaaacaaugguuucuagacuuaccgcugccuuggaccucaggggcuucaacaucccaagagacuuggaauagacaagacuugcuggucacauucaagacagcucaugcaaagaagcaggaaguaguuguacuaggaucacaagaaggagcgaugcacacugcguugacuggagcgacagaaauccaaacgucuggaacgacaacaauuuuugcaggacaccugaaaugcagacugaaaauggauaaacugacucuaaaagggguaucauauguaaugugcacaggcucauucaagcuagaaaaggaaguggcugagacccaacauggaaccguucuagugcagguuaaguacgaaggaacagaugcaccauguaagauccccuucucaucccaagaugagaggggaguaauccagaaugggagauugauaacagccaaccccauagucacugacaaagaaaaaccagucaacauugaggcggagccaccuuuuggugagagcuacaucgugguaggagcaggugaaaaagcuuugaaacuaagcugguucaagaagggaagcagcauaggaaaaauguuugaagcaacugcccguggagcacgaaggauggccauucugggagacacugcaugggacuucgguucuauaggaggaguguuuacguccgugggaaaacugguacaccagauuuuuggaacugcguacggaguuuuguucagcgguguuucuuggaccaugaaaauaggaauagggauucuacugacauggcuaggauuaaauucaaggagcacgucccuuucaaugacguguaucgcaguuggcaugguuacacuguaccuaggagucaugguucaggcggacucgggauguguaauuaacuggaaaggcagagaacucaaauguggaagcggcauuuuugucacuaaugaaguucacaccuggacagagcaauacaaauuccaggccgacuccccaaaaagacuaucagcagccauugggaaggcaugggaggaggguguguguggaauucgaucagccacucgucucgagaacaucauguggaagcaaauaucaaaugaauugaaccacaucuuacuugaaaaugacaugaaauuuacaguggucguaggagacgucagugggaucuuggcccaaggaaagaaaaugauuaggccacaacccauggaacacaaauacucguggaaaagcuggggaaaagccaagaucauaggagcagauguacagaauaccaccuucaucaucgacggcccaaacaccccagaaugcccugauaaccaaagagcauggaacaucugggaaguugaagacuauggauuuggaguuuucacgacaaacauaugguugaaauugcgugacuccuacacucaagugugugaccaccggcuaaugucagcugcuauuaaggauagcaaagcaguccaugcugacaugggguacuggauagaaagugaaaagaacgagacuuggaaguuggaaagagccuccuucauagaaguuaagacaugcaucuggccaagaucucacacucuauggagcaauggaguccuggaaagugagaugauaaucccaaagacauauggaggaccaguaucucagcacaacuacagaccaggauauuucacacaaacagcagggccguggcauuuaggcaaguuggaacuagauuuuaauuugugugaagguaccacaguuguuguggaugaaaauuguggaaaccgaggaccaucucuuagaaccacaacagucacaggaaagauaauccaugaauggugcuguagaucuugcacguuacccccccuacguuucaaaggggaagacgggugcugguacggcauggaaaucagaccaguuaaggagaaggaagaaaaccuaguuaagucaauggucucugcagggucaggagaaguggacaguuuuucacuaggacugcuaugcauaucaauaaugaucgaagagguaaugagauccagauggagcggaaagaugcugaugacuggaacauuggcuguguuccuccuucucacaaugggacaauugacauggaaugaucugaucaggcuauguaucaugguuggagccaaugcuucagacaugauggggaugggaacaacguaccuagcuuugauggcuacuuucagaaugagaccaauguucgcagucgggcuauuauuucgcagacuaacauccagagaaguucuucuucuuacaguuggauugagccugguggcaucuguagaacuaccaaauuccuuagaggagcuaggggauggacuugcaaugggcaucaugauguugaaauuacugacugauuuucagucacaucagcuaugggcuaccuugcugucuuuaacauuugucaaaacagcuuuuucauugcacuaugcauggaagacaauggccaugauacuaucaauuguaucucucuucccuuugugccuguccacgacuucucaaaaaacaacauggcuuccggugcugcugggaucucuuggaugcaaaccacuaaccaugcuucuuauaacagaaaacaaaauuugggggaggagaaguuggccccucaaugaaggaauuauggcuauuggaauaguuagcauccuacuaaguucacuucucaaaaaugaugugccacuagcuggcccacuaauagcuggaggcaugcugauagcauguuacgucauauccggaagcucggccgauuugucacuggagaaagcggcugaggucuccugggaagaugaagcagaacacucuggugccucacacaacauacuaguagagguccaagaugacggaaccaugaagauaaaggaugaagagagggaugacacacucacuauucuccucaaagcaacucuguuagcaaucucagggguauacccaaugucaauaccagcgacccucuuugugugguauuuuuggcagaaaaagaaacagagaucaggagugcuaugggacacacccagcccuccagaaguggaaagagcaguccuugacgauggcauuuauagaauucuucaaagaggauugcugggcaggucucaaguaggaguaggaguuuuucaagaagguguguuccacacaauguggcacgucaccaggggagcuguccucauguaccaagggaagagauuggaaccaagcugggcuaguguaaaaaaagacuugaucucauauggaggagguuggagguuucaaggauccuggaacacgggagaagaagugcaggugauugcuguugaaccggggaagaaccccaaaaauguacagacaacgccgggcaccuucaagaccucugaaggugaaguuggagccauagcucuagacuucaagcccggcacaucuggaucuccuauugugaacagagaggggaaaauagugggucuuuauggaaauggaguggugacaacaaguggaaccuacgucagugccauagcucaagccaaagcaucacaagaagggccccuaccagagauugaggacgagguguuuaggaaaaggaacuuaacaauaauggaccuacauccaggaucagggaagacaagaagauaccuuccagccauacuccgugaggccauaaaaagaaagcugcgcacgcuagucuuggcccccacaagaguugucgcuucugaaauggcagaagcacucaagggaaugccaauaagguaucagacaacagcagugaaaagugaacacacgggaaaggagauaguugaucuuaugugucacgccacuuucaccaugcgucuccugucuccugugagaguccccaacuauaacaugauuaucauggaugaagcacacuucaccgauccagccagcauagcagccagaggguacaucucaacccgaguagguaugggugaagcagcugcgaucuucaugacagccacuccccccggaucgguggaggccuuuccacagagcaaugcaguuauccaagaugaggaaagagacauuccugaaagaucauggaacucaggcuaugacuggaucacugauuucccagguaaaacagucugguuuguuccaagcaucaaaucaggaaaugacauugccaacuguuuaagaaagaaugggaaacgggugguccaauugagcaggaaaacuuuugacacugaguaccagaaaacaaaaaauaacgacugggacuauguugucacaacagacauauccgaaaugggagcaaacuuccgagccgacaggguaauagacccaaggcggugccugaaaccaguaauacuaaaagaugguccagagcgcgucauccuagccggaccgaugccagugacuguggccagugccgcccagaggagaggaagaauuggaaggaacccaaauaaggaaggugaucaguauguguacaugggacagccucugaauaaugaugaggaccacgcccauuggacagaagcaaaaaugcuccuugacaacauaaacacaccagaaggaaucauuccagcccucuuugagccggagagagaaaagagugcagcaauagacggggaauacagauuacggggugaagcgaggaaaacguucguggagcucaugagaagaggagaucuaccugucuggcuauccuacaaaguugccucagagggcuuccaguacucugacagaagguggugcuuugauggggaaaggaacaaccagguguuggaggagaacauggacguggagauuuggacaaaagagggagaaagaaagaaacuacgaccccgcuggcuggaugcuagaacauauucugacccacuggcucugcgcgaauucaaagaguucgcagcaggaagaagaagcgucucaggugaccuaauauuagaaauagggaaacuuccacaacauuuaacgcaaaaggcccagaaugcuuuggauaaucuggucaugcugcacaacucugaacaaggaggaaaagccuacagacacgccauggaagaacuaccagacaccauagaaacguuaaugcuccuagcuuugauagcugugcugacugguggagugacguuguucuuccuaucaggaagaggucuaggaaaaacauccauuggccuacucugugugauggccucaagugcauuguuauggauggccaguguggagccucauuggauagcggccuccaucauacuggaguucuuucugaugguguugcuuauuccagagccagacagacagcgcacuccacaagacaaccagcuagcauacguggugauaggcuuguuauucaugauauugacaguggcagccaaugagaugggauuguuggaaaccacaaagaaagaccuggggauuggucaugcagcagcugaaaaccaccaccaugcugcaaugcuggacguggaccuacauccagcuucagccuggacucucuaugcaguggccacaacaauuaucacucccaugaugagacacacaauugaaaacacaacggcaaauauuucccugacagcuauugcaaaccaggcagcuauauugaugggacuugacaagggauggccaauaucaaagauggacauaggaguuccacuucucgccuuggggugcuacucucaggugaacccguugacgcugacagcggcgguauugaugcuaguggcucauuaugccauaauuggaccuggacugcaggcaaaagcuacuagagaagcucaaaaaaggacagcagccggaauaaugaaaaacccaacugucgacgggaucguugcaauagauuuggacccuguaguuuaugaugcaaaguuugaaaaacagcuaggucaaauaauguuguugauacuuugcacaucacaaauucuccuaaugcggaccacaugggccuugugugaauccaucacauuggccacuggaccuuugaccacgcuuugggagggaucuccaggaaaauucuggaauaccacuauagcgguguccauggcaaacauuuucaggggaaguuaucuagcaggagcaggucuggccuuuucauugaugaaaucucuaggaggagguaggagaggcacaggagcccaaggagaaacgcugggagaaaaauggaaaagacagcuaaaccaauugagcaaaucagaauuuaauauuuacaaaaggagugggauuauggagguggauagaucugaagccaaagagggguugaaaagaggagaaacaaccaaacaugcagugucgagaggaacagccaaauugaggugguuuguggagaggaaccuugugaaaccagaagguaaagucauugaccucgguuguggaagagguggcuggucauauuacugcgcugggcugaagaaagucacagaagugaaaggauacacgaaaggaggaccuggacaugaggaaccagucccaauggcaaccuauggauggaaccuaguaaagcuacacuccgggaaggauguguucuuuacaccaccugagaaaugugacacccuuuugugugauaucggugaguccucuccgaacccaaccauagaagaaggaagaacguuacguguucuaaagaugguggaaccauggcucagaggaaaccaauuuugcauaaaaauucuaaaucccuauaugccgagugugguagaaacucuggagcaaaugcaaagaaaacauggaggaaugcuagugcgaaauccacucucaagaaacuccacucaugaaauguacuggguuucauguggaacaggaaacauugugucagcaguaaacaugacauccagaaugcugcugaaucgauucacaauggcucacaggaagccaacauaugaaagagacguggacuuaggcgcuggaacaagacauguggcaguggaaccagagguggccaaccuagauaucauuggccagaggauagagaauauaaaaaaugagcacaaaucaacauggcauuacgaugaggacaauccauacaaaacaugggccuaucauggaucauaugaggucaagccaucaggaucagccucauccauggucaaugguguggugagacugcuaaccaaaccaugggaugucauucccauggucacacaaauagccaugacugauaccacacccuuuggacaacagaggguguuuaaagagaaaguugacacgcgcacaccaaaagcgaaacgaggcacagcacaaauuauggagguaacagccaagugguugugggguuuucucucuagaaacaaaaaacccagaaucugcacaagagaggaguucacaagaaaagucagaucaaacgcagccauuggagcaguguucguugaugaaaaucaauggaacucagcaaaagaggcaguggaagaugaacgauucugggaccuugugcacagagagagggagcuucauaaacaaggaaaaugugccacgugugucuacaacaugaugggaaagagagagaaaaaacuaggagaguucggaaaggcaaaaggaagucgcgcaauaugguacaugugguugggagcgcgcuuuuuagaguuugaggcccuugguuucaugaaugaagaucauugguucagcagagagaauucacucagcggaguggaaggagaaggacuccacaaacuuggauacauacucagagacauaucaaagauuccagggggaaauuuguaugcagaugacacagccggaugggacacaagaauaacagaggaugaucuucagaaugaggccaaaaucacugacaucauggaaccugaacaugcccuacuggcuacgucaaucuuuaaacuaaccuaccaaaacaagguaguaagggugcagagaccagcaaaaaauggaaccgugauggaugucauauccagacgugaucagagaggaaguggacagguuggaaccuauggcuuaaacaccuucacuaacauggaggcccaacuaauaagacaaauggagucugagggaaucuuuucacccagcgaauuggaaaccccaaaucuagcuaaaagaguccucgacugguuggaaaaacauggcaucgagaggcugaaaaggauggcaaucaguggagaugacuguguggugaaaccaauugaugacagauuugcaacagccuuaacagccuugaaugacaugggaaagguaagaaaagacauaccgcaaugggaaccuucaaaaggauggaacgauuggcaacaagugccuuuuuguucacaccauuuccaccagcugauuaugaaggaugggagggagauaguggugccaugccgcaaccaagaugaacucauagguagggccagagucucacaaggcgcuggauggagcuuaagagaaacugcaugccuaggcaagucauaugcacaaauguggcagcugauguauuuccauaggagagaucugagacuagcggcuaaugccaucuguucagccguuccaguugacugggucccaaccagccgcaccaccuggucgauccaugcccaccaucaauggaugacaacagaagacauguugucaguguggaauaggguuuggauagaggaaaacccauggauggaggauaaaacucauguguccaguugggaagacguuccauaccuaggaaaaagggaagaucaaugguguggaucccuaauaggcuuaacagcacgagccaccugggccagcaacauacaaguggccauaaaccaggugagaaggcucauugggaacgagaauuaucuagacuauaugacaucaaugaagagauucaaaaacgagagugaucccgaaggggcacucugguga

SEQ ID NO: 6256 - RNA, 9879 nt, Artificial Sequence
  derived and/or modified CDS sequence (wt) from DENV-1__KC762653__SS-prME
ucugugaccaugcuccucaugcugcugcccacagcccuggcguuccaucugaccacccgaggaggagagccgcacaugauagucagcaagcaagaaagaggaaaaucacuuuuguucaagaccucugcaggugucaacauguguacccuuauugcaauggauuugggagaguuaugugaagacacaaugaccuacaaaugcccccggaucacugagacggaaccagaugacguugacuguuggugcaaugccacggagacaugggugaccuauggaacauguuaccaaacuggugaacaccgacgagacaaacguuccgucgcauuggcaccacacguagggcuuggucuagaaacaagaaccgaaacguggauguccucugaaggcgcuuggagacaaauacaaaaaguggagacuugggcucuaagacacccaggauucacggugauagcccuuuuucuagcacaugcuauaggaacauccaucacccagaaagggauuauuuuuauuuugcugaugcugguaacuccauccauggccaugcggugcgugggaauaggcaacagagacuucguggaaggacucucaggagcuacguggguggauguggugcuggagcauggaaguugcgucacuaccauggcaaaagacaaaccaacacuggacauugaacuccugaagacggaggucacaaacccugcaguccugcgcaaauugugcauugaagcuaaaauaucaaacaccaccaccgauucgagauguccaacacaaggagaagccacgcugguggaagagcaggacacgaauuuugugugccgacgaacguucguggacagaggcuggggcaaugguugugggcuauucggaaaagguagcuuaauaacgugugcuaaguuuaagugugugacaaaacuagaaggaaagauaguccaauaugaaaacuuaaaauauucagucauagucaccguacacacuggagaccaacaccaaguuggaaaugagaccacagaacauggaacaacugcaaccauaacaccucaagcucccacgucggaaauacagcugacagacuacggagcucuaacauuggauuguucaccuagaacaggguuagacuuuaaugagaugguguuguugacaaugaaagaaaaaucauggcucguccacaaacaaugguuucuagacuuaccacugccuuggaccucgggggcuucaacaucccaagagacuuggaacagacaagacuugcuggucacauuuaagacagcucaugcaaaaaagcaggaaguagucguacuaggaucacaagaaggagcaaugcacacugcgcuaacuggagcgacagaaauccaaacgucuggaacgacaacaauuuucgcaggacaccugaaaugcagacuaaaaauggauaaacugaccuuaaaagggaugucauauguaaugugcacagggucauucaagcuagagaaggaaguggcugagacucagcauggaacuguucuagugcaggucaaauacgaaggaacagaugcaccaugcaagauccccuucucgucccaagaugagaagggagugacccagaaugggagauugauaacagccaaccccauagucacugacaaagaaaaaccaguuaacauugaagcggagccaccuuuuggugagagcuaccuugugguaggagcaggugaaaaagcuuugaaacuaagcugguucaagaagggaagcaguauaggaaagauguuugaagcaaccgcucguggagcacgaaggauggccauccugggagacaccgcaugggacuucgguucuauaggagggguguuuacgucugugggaaaauugauacaccagauuuuugggacugcguauggaguuuuguucagcgggguuucuuggacuaugaaaauaggaauagggauucugcugacauggcuaggauuaaauucaaggagcacgucccuuucaaugacguguaucgcaguuggcaugaucacacuguaccuaggagucaugguucaggcggacucgggauguguaaucaacuggaaaggcagagaacucaaauguggaagcggcaucuuugucaccaaugaaguccacaccuggacagagcaauacaaauuccaagcugacucccccaagagacuaucagcggccauugggaaggcaugggaggaggguguguguggaauccgaucagccacucgccuugaaaacauuauguggaagcaaauaucaaaugaacuaaaccacaucuuacuugaaaaugacaugaaauuuacaguggucguaggagaaguuaauggaaucuuggcccaaggaaagaaaaugauuaggccacaacccauggaacacaaauauucguggaaaagcuggggaaaagccaaagucauaggagcagauguacagaauaccaccuucaucaucgacggcccaaacaccccagaaugcccugauaaucaaagagcauggaacaucugggaagucgaagacuacggauuuggaauuuucacgacaaacauaugguugaaacugcgugacuccuacacucaagugugugaccaccggcuaaugucagcugccaucaaggauagcaaagcaguccaugcugacaugggguacuggauagaaagugaaaagaacgagacuuggaaguuggcaagagccuccuucauagaaguuaagacaugcaucuggccaaaaucccauacccuauggagcaauggaguccuggaaagugaaaugauaaucccaaaaauauauggaggaccaauaucucagcacaacuacagaccaggauauuucacacaaacagcagggccguggcacuugggcaaguuagaacuggauuuugaguugugugaagguaccaccguuguuguggaugaacauuguggaaaucgaggaccaucucuuagaaccacaacagucacaggaaagauaauccaugaauggugcugcagaucuugcacguuacccccccuacguuucaaaggagaagacgggugcugguacgguauggaaaucagaccagucaaggagaaggaagagaaccuagucaaaucaauggucucugcagggucaggagaaguggacaguuuuucacuaggacugcuaugcauaucaauaaugaucgaggagguaaugagauccagauggaguagaaaaaugcugaugacuggaacauuggcuguguuccuccuucuuacaaugggacaauugacauggaaugauuugaucaggcuauguaucaugguuggagccaaugcuucagacaagauggggaugggaacaacguaccuagcuuugauggccacuuucagaaugagaccaaugcucgcagucgggcuacuguuucgcagauuaacgucuagagaaguucuucuucucacaguuggauugagucuaguggcaucuguagaacuaccaaauuccuuggaggagcuaggggauggacuugcaaugggcaucaugauguugaaauuacuaacugacuuucagucacaccagcuaugggcugccuugcugucucuaacauuugucaaaacaacuuuaucauugcauuacgcauggaagacaauggcuaugauacugucaauuguaucucucuucccucuaugccuguccacgaccucucaaaaaacaacauggcucccgguguugcugggaucucuuggaugcaaaccacuaaccauguuucuuauaacagaaaacaaaaucuggggaaggaaaaguuggccucucaaugagggaauuauggcuguuggaauaguuaguauucuuuuaagcucacuccucaaaaaugaugugccacuagcaggcccacuaauagcuggaggcaugcuaauagcauguuaugucauaucuggaagcucggccgauuuaucauuggagaaagcggcugaggucuccugggaagaagaagcagaacacucuggugccucacacaacauacuaguggagguccaagaugauggaaccaugaagauaaaggaugaagagagagaugacacacuuaccauucuccucaaagcaacuuugcuagcaaucucaggggucuacccaaugucaauaccggcgacccucuuugugugguacuuuuggcagaaaaagaaacagagaucaggagugcuaugggacacacccagcccuccagaaguggaaaaagcaguccuugaugauggcauuuauagaauucuccaaagaggacuguugggcaagucucaaguaggaguaggaguuuuucaagaagguguguuucacacaauguggcacgucacuaggggagcuguccucauguaucaagggaagagauuggaaccaaguugggccagugucaaaaaagacuugaucucauauggaggagguuggagguuucaaggauccuggaacacgggagaagaagugcaggugauugcuguugaaccggggaagaacccaaaaaacgugcagacagcgccggguaccuuuaagacuccugaaggcgaaguuggagcuauagcucuagacuuuaaacccggcacaucuggaucuccuauugugaacagggagggaaaaauaguaggucuuuauggaaauggaguggugacaacaaguggaaccuacgucagugccauagcucaagccaaagcaucacaagaaggaccucuaccagagauugaggacgagguguuuaggaaaagaaacuuaacaauaauggaccuacacccaggaucgggaaaaacaagaagauaccuuccagccauaguccgugaggcuauaaaaagaaaguuacgcacgcuagucuuagcucccacaagaguugucgccucugaaauggcagaggcgcucaagggaaugccaauaagguaccagacaacagcagugaaaagugaacacacgggaaaggagauaguugaccuuaugugucacgccacuuuuaccaugcgucuccuuuccccugugagaguucccaauuauaauaugauuaucauggaugaagcacauuucacugauccagccagcauagcagccagaggguauaucucaacccgaguggguaugggugaagcagcugcaauuuucaugacagccacuccccccggaucgauggaggccuuuccacagagcaaugcagcuauccaagaugaggaaagagacauuccugaaaggucauggaacucaggcuaugacuggauuaccgauuuuccaggcaaaacaguuugguuuguuccaagcaucaaaucaggaaaugauauugccaacuguuuaagaaagaaugggaaacggguaauccaauugagcagaaaaaccuucgacacugaguaccagaagacaaaaaauaacgacugggacuauguugucacaacagacauauccgaaaugggagcaaacuuccgagcagacaggguaauagacccgaggcggugccugaaaccaguaauacuaaaagauggcccagagcgugucauucuagccggaccgaugccagugacuguggcuagcgccgcccagaggagaggaagaauuggaaggaaccaaaauaaggaaggugaucaguauauuuacaugggacagccucuaaacaaugaugaggaccacgcccauuggacagaagcaaaaaugcuccuugacaacauaaacacaccagaagggauuaucccagcccucuuugagccggagagagaaaagagugcagcaauagacggggaauacagacuacggggugaagcgaggaaaacuuucguggagcuuaugagaagaggagaucuaccugucuggcuauccuacaaaguugccucagaaggcuuccaguacuccgacagaagguggugcuuugauggagaaaggaacaaccaggugcuggaggagaauauggacguggagaucuggacaaaagaaggagaaagaaagaaacuacggccccgcuggcuggaugccagaacauacucugacccacuggcucugcgcgaauucaaagaguucgcagcgggaagaagaagcgucucaggugaccuaauauuagaaauagggaaacuuccacaacauuuaacgcaaagggcccagaaugccuuggacaaucuggucaugcugcacaacucugaacagggaggaaaagccuauagacacgccauggaagaacuaccagacaccauagaaacguuaaugcuucuggcuuugauagcugugcugacugguggggugacgcuguucuuccuaucaggaaggggucuaggaaaaacauccauuggccuacucugcgugauggccucaagugcacuguuauggauggccaguguggaaccccauuggauagcggccucuaucauacuggaguucuuuuugaugguguugcuuauuccagaaccggacagacagcgcacuccacaagacaaccagcuagcauacguggugauaggucuauuauucaugauacugacaguggcagccaaugagaugggauuacuggaaaccacaaagaaggaccuagggauuggucaugcagcugcugaaaaccaccaucaugcugcaaugcuggacguagaccuacauccagcuucagccuggacccucuaugcaguggccacaacaauuauuacucccaugaugagacacacaaucgaaaacacaacggcaaauauuucccugacagcuaucgcaaaccaggcagcuauauugaugggacuugacaagggauggccaauaucaaagauggacauaggaguuccacuucucgccuuggggugcuauucucaggugaacccgcugacgcugacagcggcgguauugauguuaguggcucauuacgccauaauuggacccggauugcaagcaaaagcuacuagagaagcucaaaaaaggacagcagcuggaauaaugaaaaacccaacuguugaugggaucguugcaauagauuuggacccuguaguuuacgaugcaaaauuugaaaaacagcuaggucaaauaaugcuguuaauacucugcacaucacagauccuccugaugcggaccacaugggccuugugugaauccaucacacuagccacuggaccucugaccacacucugggagggaucuccaggaaaauucuggaacaccacgauagcgguguccauggcaaacauuuuuaggggaaguuaucuagcaggagcaggucuggccuuuucauuaaugaaaucucuaggaggagguaggagagguacgggagcucaaggggaaacacugggagaaaaauggaaaagacagcuaaaccaauugagcaagucagaauucaacacuuacaaaaggagugggaucauggagguggacagaucugaagccaaagagggguugaaaagaggagaaacgacuaaacacgcggugucgagaggaacggccaaacugaggugguuuguggagagaaaccuugugaaaccagagggaaaagucauagaccucgguuguggaagagguggcuggucauacuauugcgcuggguugaagaaagucacagaagugaaaggauacacgaaaggaggaccugggcaugaagaaccaauuccaauggcaaccuauggauggaaccuaguaaagcuacacuccgggaaagauguauucuuuacaccaccugagaaaugugacacucucuugugugauauuggugaguccucuccgaacccaaccauagaagaaggaagaacauuacguguucuaaagaugguggaaccauggcucagaggaaaccaauuuugcauaaaaguucuaaaucccuauaugccgagugugauagaaacuuuggagcagaugcagagaaaacauggaggaaugcuagugcgaaauccacucucaagaaacuccacucaugaaauguacuggguuucauguggaacaggcaauauugugucagcaguaaacaugacaucuagaaugcugcuaaaucgauucacaauggcucacaggaagccaacauaugaaagagacguggacuuaggcgcuggaacaagacauguggcaguagaaccagagguggccaaccuagauaucauuggccagaggauagagaauauaaaaaaugaacacaaaucaacauggcauuaugaugaggauaauccauacaaaacaugggccuaucauggaucauaugaggucaagccaucaggaucagccucauccauggucaaugguguggugagacugcuaaccaaaccaugggaugucauccccauggucacacaaauagccaugacugacacuacacccuuuggacaacagaggguguucaaagagaaaguugacacgcgcacaccaaaagcgaaacgaggcacagcacaaauuauggaggugacagcuaggugguuaugggguuuucucucuagaaacaaaaaacccagaaucugcacaagagaggaauuuacaagaaaagucaggucaaacgcagcuaucggagcaguguucguugaugaaaaucaauggaacucagcaaaagaggcaguggaagaugaacgguucugggaccuugugcacagagagagggagcuucauaaacaaggaaaaugugccacgugugucuacaacaugaugggaaagagagagaaaaaacuaggagaguucggaaaggcaaaaggaagccgcgcaauaugguacaugugguugggagcgcgcuuuuuagaguuugaagcccuugguuucaugaaugaagaucacugguucagcagagagaauucacucaguggaguggagggagaaggacuccacaaacuuggauacauacucagagacauaucaaagauuccagggggaaauauguaugcagaugacacagccggaugggacacaagaauaacagaggaugaucuucagaaugaggccaaaaucacugacaucauggaaccugaacaugcucuauuggccacgucaaucuucaagcuaaccuaccaaaacaagguaguaagggugcagagaccagcgaaaaauggaaccgugauggaugucauauccagacgugaccagagaggaaguggacagguuggaaccuauggcuuaaacaccuucaccaacauggaggcccaacuaauaagacaaauggagucugagggaaucuuuacacccagcgaauuggaaaccccaaaucuagccgaaagaguucucgacugguuggaaaaacauggcaucgagaggcugaaaagaauggcaaucaguggagaugacuguguggugaaaccaauugaugacagauucgcaacagcauuaacagcuuugaaugacaugggaaagguaagaaaagacauaccgcaaugggaacccucaaaaggauggaaugauuggcaacaagugccuuucuguucgcaccauuuccaccaacugauuaugaaggaugggagggagauaguggugccaugccgcaaccaagaugaacuuguggguagggccagaguaucacaaggcgcuggauggagccugagagaaacugcaugccuaggcaagucauaugcacaaauguggcagcugauguacuuccacaggagagacuugagauuagcagcuaaugcuaucuguucagccguuccaguugauugggucccaaccagccguaccaccuggucgauccaugcccaccaccaauggaugacaacagaagacauguuaucaguguggaauaggguuuggauagaggaaaacccauggauggaggacaaaacucacguguccaguugggaagacguuccauaccuaggaaaaagggaagaucaaugguguggaucccuaauaggcuugacagcgcgagccaccugggccacuaacauacaaguggccauaaaccaagugagaaggcucauugggaaugagaauuaucuagauuacaugacaucaaugaagagauucaaaaacgagagugaucccgaaggggcacucugguaa

SEQ ID NO: 6257 - RNA, 9879 nt, Artificial Sequence
  derived and/or modified CDS sequence (wt) from DENV-1__KC762640__SS-prME
ucugugaccaugcuccucaugcugcugcccacagcccuggcguuccaucugaccacccgaggaggagagccgcacaugauagucagcaagcaagaaagaggaaaaucacuuuuguucaagaccucugcaggugucaacauguguacccuuauugcaauggauuugggagaguuaugugaagacacaaugaccuacaaaugcccccggaucacugagacggaaccagaugacguugacuguuggugcaaugccacggagacaugggugaccuauggaacauguucccaaacuggugaacaccgacgagacaaacguuccgucgcauuggcaccacacguagggcuuggucuagaaacaagaaccgaaacguggauguccucugaaggcgcuuggagacaaauacaaaaaguggagacuugggcucuaagacacccaggauucacggugauagcccuuuuucuagcacaugcuauaggaacauccaucacccagaaagggauuauuuuuauuuugcugaugcugguaacuccauccauggccaugcggugcgugggaauaggcaacagagacuucguggaaggacucucaggagcuacguggguggauguggugcuggagcauggaaguugcgucacuaccauggcaaaagacaaaccaacacuggacauugaacuccugaagacggaggucacaaauccugcaguccugcgcaaauugugcauugaagcuaaaauaucaaacaccaccaccgauucgagauguccaacacaaggagaagccacgcugguggaagagcaggacacgaauuuugugugccgacggacguucguggacagaggcuggggcaaugguugugggcuauucggaaaagguagcuuaauaacgugugcuaaguuuaagugugugacaaaacuagaaggaaagauaguccaauaugaaaacuuaaaauauucagucauagucaccguacacacuggagaccaacaccaaguuggaaaugagaccacagaacauggaacaacugcaaccauaacaccucaagcucccacgucggaaauacagcugacagacuacggagcucuaacauuggauuguucaccuagaacaggguuagacuuuaaugagaugguguuguugacaaugaaagaaaaaucauggcucguccacaaacaaugguuucuagacuuaccacugccuuggaccucgggggcuucaacaucccaagagacuuggaacagacaagacuugcuggucacauuuaagacagcucaugcaaaaaagcaggaaguagucguacuaggaucacaagaaggagcaaugcacacugcgcuaacuggagcgacagaaauccaaacgucuggaacgacaacaauuuucgcaggacaccugaaaugcagacuaaaaauggauaaacugaccuuaaaaggggugucauauguaaugugcacagggucauucaagcuagagaaggaaguggcugagacucagcauggaacuguucuagugcaggucaaauaugaaggaacagaugcaccaugcaagauccccuucucgucucaagaugagaagggagugacccagaaugggagauugauaacagccaaccccauagucacugacaaagaaaaaccaguuaacauugaagcggagccaccuuuuggugagagcuaccuugugguaggagcaggugaaaaagcuuugaaacuaagcugguucaagaagggaagcaguauaggaaagauguuugaagcaaccgcucguggagcacgaaggauggccauccugggagacaccgcaugggacuucgguucuauaggagggguguuuacgucugugggaaaauugauacaccagauuuuugggacugcguauggaguuuuguucagcgggguuucuuggacuaugaaaauaggaauagggauucugcugacauggcuaggauuaaauucaaggagcacgucccuuucaaugacguguaucgcaguuggcauggucacacuguaccuaggagucaugguucaggcggacucgggauguguaaucaacuggaaaggcagagaacucaaauguggaagcggcaucuuugucaccaaugaaguccacaccuggacagagcaauacaaauuccaagcugacucccccaagagacuaucagcggccauugggaaggcaugggaggaggguguguguggaauccgaucagccacucgccucgaaaacauuauguggaagcaaauaucaaaugaacuaaaccacaucuuacuugaaaaugacaugaaauuuacaguggucguaggagaaguuaauggaaucuuggcccaaggaaagaaaaugauuaggccacaacccauggaacacaaauauucguggaaaagcuggggaaaagccaaagucauaggagcagauguacagaauaccaccuucaucaucgacggcccaaacaccccagaaugcccugauaaucaaagagcauggaacaucugggaagucgaagacuauggauuuggaauuuucacgacaaacauaugguugaaacugcgugacuccuacacucaagugugugaccaccggcuaaugucagcugccaucaaggauagcaaagcaguccaugcugacaugggguacuggauagaaagugaaaagaacgagacuuggaaguuggcaagagccuccuucauagaaguuaagacaugcaucuggccaaaaucccauacccuauggagcaauggaguccuggaaagugaaaugauaaucccaaaaauauauggaggaccaauaucucagcacaacuacagaccaggauauuucacacaaacagcagggccguggcacuugggcaaguuagaacuggauuuugaguugugugaagguaccaccguugucguggaugaacauuguggaaaucgaggaccaucucuuagaaccacaacagucacaggaaagauaauccaugaauggugcugcagaucuugcacguuacccccccuacguuucaaaggagaagacgggugcugguacgguauggaaaucagaccagucaaggagaaggaagagaacuuaguuaaaucaauggucucugcagggucaggagaaguggacaguuuuucacuaggacugcuaugcauaucaauaaugaucgaagagguaaugagauccagauggaguagaaaaaugcugaugacuggaacauuggcuguguuccuccuucuuacaaugggacaauugacauggaaugaucugaucaggcuauguaucaugguuggagccaaugcuucagacaagauggggaugggaacaacguaccuagcuuugauggccacuuucagaaugagaccaauguucgcagucgggcuacuguuucgcagauuaacgucuagagaaguucuucuucucacaguuggauugagucuaguggcaucuguagaacuaccaaauuccuuggaggagcuaggggauggacuugcaaugggcaucaugauguugaaauuacuaacugauuuucagucacaccagcuaugggcugccuugcugucucuaacauuugucaaaacaacuuuaucauugcauuacgcauggaagacaauggcuaugauacugucaauuguaucucucuucccucuaugccuguccacgacuucucaaaaaacaacauggcucccgguguugcugggaucucuuggaugcaaaccacuaaccauguuucuuauaacagaaaacaaaaucuggggaaggaaaaguuggccucucaaugagggaauuauggcuguuggaauaguuaguauucuuuuaagcucacuccucaaaaaugaugugccacuagcaggcccacuaauagcuggaggcaugcuaauagcauguuaugucauaucuggaagcucggccgauuuaucauuggagaaagcggcugaggucuccugggaagaagaagcagaacacucuggugccucacacaacauacuaguggagguccaagaugauggaaccaugaagauaaaggaugaagagagagaugacacacuuaccauucuccucaaagcaacuuugcuagcaaucucagggguguacccaaugucaauaccggcgacccucuuugugugguacuuuuggcagaaaaagaaacagagaucaggagugcuaugggacacacccagcccuccagaaguggaaaaagcaguccuugaugauggcauuuauagaauucuccaaagaggacuguugggcaagucucaaguaggaguaggaguuuuucaagaagguguguuucacacaauguggcacgucacuaggggagcuguccucauguaucaagggaagagauuggaaccaaguugggccagugucaaaaaagacuugaucucauauggaggagguuggagguuucaaggauccuggaacacgggagaagaagugcaggugauugcuguugaaccggggaagaacccaaaaaacgugcagacagcgccggguaccuuuaagacuccugaaggcgaaguuggagcuauagcucuagacuuuaaacccggcacaucuggaucuccuauugugaacagggagggaaaaauaguaggucuuuauggaaauggaguggugacaacaaguggaaccuacgucagugccauagcucaagccaaagcaucacaagaaggaccucuaccagagauugaggacgagguguuuaggaaaagaaacuuaacaauaauggacuuacacccaggaucgggaaaaacaagaagauaccuuccagccauaguccgugaggcuauaaaaagaaaguuacgcacgcuagucuuagcucccacaagaguugucgccucugaaauggcagaggcgcucaagggaaugccaauaagguaccagacaacagcagugaaaagugaacacacgggaaaggagauaguugaccuuaugugucacgccacuuuuaccaugcgucuccuuuccccugugagaguucccaauuauaauaugauuaucauggaugaagcacauuucacugauccagccagcauagcagccagaggguauaucucaacccgaguggguaugggugaagcagcugcaauuuucaugacagccacuccccccggaucgauggaggccuuuccacagagcaaugcagcuauccaagaugaggaaagagacauuccugaaaggucauggaacucaggcuaugacuggauuaccgauuuuccagguaaaacaguuugguuuguuccaagcaucaaaucaggaaaugauauugccaacuguuuaagaaagaaugggaaacgggugauccaauugagcagaaaaaccuucgacacugaguaccagaagacaaaaaauaacgacugggacuauguugucacaacagacauauccgaaaugggagcaaacuucagagcagacaggguaauagacccgaggcggugccugaaaccaguaauacuaaaagauggcccagagcgugucauucuagccggaccgaugccagugacuguggcuagcgccgcccagaggagaggaagaauuggaaggaaccaaaauaaggaaggugaucaguauauuuacaugggacagccucuaaacaaugaugaggaccacgcccauuggacagaagcaaaaaugcuccuugacaacauaaacacaccagaagggauuaucccagcccucuuugagccggagagagaaaagagugcagcaauagacggggaauacagacuacggggugaagcgaggaaaacuuucguggagcuuaugagaagaggagaucuaccugucuggcuauccuacaaaguugccucagaaggcuuccaguacuccgacagaagguggugcuuugauggagaaaggaacaaccaggugcuggaggagaacauggacguggagaucuggacaaaagaaggagaaagaaagaaacuacggccccgcuggcuggaugccagaacauacucugacccacuggcucugcgcgaauucaaagaguucgcagcaggaagaagaagcgucucaggugaccuaauauuagaaauagggaaacuuccacaacauuuaacgcaaagggcccagaaugccuuggacaaucugguuaugcugcacaacucugaacagggaggaaaagccuauagacacgccauggaagaacuaccagacaccauagaaacguuaaugcuucuggcuuugauagcugugcugacugguggggugacgcuguucuuccuaucaggaaggggucuaggaaaaacauccauuggccuacucugcgugauggccucaagugcacuguuauggauggccaguguggaaccccauuggauagcggccucuaucauacuggaguucuuucugaugguguugcuuauuccagaaccggacagacagcgcacuccacaagacaaccagcuagcauacguggugauaggucuauuauucaugauacugacaguggcagccaaugagaugggauuacuggaaaccacaaagaaggaccuagggauuggucaugcagcugcugaaaaucaccaucaugcugcaaugcuggacguagaccuacauccagcuucagccuggacccucuaugcaguggccacaacaauuauuacucccaugaugagacacacaaucgaaaacacaacggcaaauauuucccugacagcuaucgcaaaccaggcagcuauauugaugggacuugacaagggauggccaauaucaaagauggacauaggaguuccacuucucgccuuggggugcuauucucaggugaacccgcugacgcugacagcggcgguauugaugcuaguggcucauuacgccauaauuggacccggauugcaagcaaaagcuacuagagaagcucaaaaaaggacagcagcuggaauaaugaaaaacccaacuguugaugggaucguugcaauagauuuggacccuguaguuuacgaugcaaaauuugaaaaacagcuaggccaaauaaugcuguuaauacucugcacaucacagauccuccugaugcggaccacaugggccuugugugaauccaucacacuagccacuggaccucugaccacacucugggagggaucuccaggaaaauucuggaacaccacgauagcgguguccauggcaaacauuuuuaggggaaguuaucuagcaggagcaggucuggccuuuucacuaaugaaaucucuaggaggagguaggagagguacgggagcucaaggggaaacacugggagaaaaauggaaaagacagcuaaaccaauugagcaagucagaauucaacacuuacaaaaggagugggaucauggagguggacagaucugaagccaaagagggguugaaaagaggagaaacgacuaaacacgcggugucgagaggaacggccaaacugaggugguucguagagagaaaccuugugaaaccagagggaaaagucauagaccucgguuguggaagagguggcuggucauacuauugcgcugggcugaagaaagucacagaagugaaaggauacacgaaaggaggaccugggcaugaagaaccaauuccaauggcaaccuauggauggaacuuaguaaagcuauacuccgggaaagauguauucuuuacaccaccugagaaaugugacacucucuugugugauauuggugaguccucuccgaacccaaccauagaagaaggaagaacauuacguguucuaaggaugguggaaccauggcucagaggaaaccaauuuugcauaaaaguucuaaaucccuacaugccgagugugauagaaacuuuggagcagaugcagagaaaacauggaggaaugcuagugcgaaauccacucucaagaaacuccacucaugaaauguacuggguuucauguggaacaggcaauauugugucagcaguaaacaugacaucuagaaugcugcuaaaucgauucacaauggcucacaggaagccaacauaugaaagagacguggacuuaggcgcuggaacaagacauguggcaguagaaccagagguggccaaccuagaaaucauuggccagaggauagagaauauaaaaaaugaacacaaaucaacauggcauuaugaugaggauaauccauacaaaacaugggccuaucauggaucauaugaggucaagccaucaggaucagccucauccauggucaaugguguggugagacugcuaaccaaaccaugggaugucauccccauggucacacaaauagccaugacugacacuacacccuuuggacaacagaggguguucaaagagaaaguugacacgcgcacaccaaaagcgaaacgaggcacagcacaaauuauggaggugacagcuaggugguuaugggguuuucucucuagaaacaaaaaacccagaaucugcacaagagaggaauucacaagaaaagucaggucaaacgcagcuaucggagcaguguucguugaugaaaaucaauggaacucagcaaaagaggcaguggaagaugaacgguucugggaccuugugcacagagagagggagcuucauaaacaaggaaaaugugccacgugugucuacaacaugaugggaaagagagagaaaaaacuaggagaguucggaaaggcaaaaggaagccgcgcaauaugguacaugugguugggagcgcgcuucuuagaguuugaagcccuugguuucaugaaugaagaucacugguucagcagagagaauucacucaguggaguggagggagaaggacuccacaaacuuggauacauacucagagacauaucaaagauuccagggggaaauauguaugcagaugacacagccggaugggacacaagaauaacagaggaugaucuucagaaugaggccaaaaucacugacaucauggaaccugaacaugcucuauuggccacgucaaucuuuaagcuaaccuaccaaaacaaggugguaagggugcagagaccagcgaaaaauggaaccgugauggaugucauauccagacgugaccagagaggaaguggacagguuggaaccuauggcuuaaacaccuucaccaacauggaggcccaacuaauaagacaaauggagucugagggaaucuuuacacccagcgaauuggaaaccccaaaucuagccgaaagaguucucgacugguuggaaaaacauggcaucgagaggcugaaaagaauggcaaucaguggagaugacuguguggugaaaccaauugaugacagauucgcaacagcauuaacagcuuugaaugacaugggaaagguaagaaaagacauaccgcaaugggaacccucaaaaggauggaaugauuggcaacaagugccuuucuguucacaccauuuucaccaacugauuaugaaggaugggagggagauaguggugccaugccgcaaccaagaugaacuuguggguagggccagaguaucacaaggugcuggauggagccugagagaaacugcaugccuaggcaagucauaugcacaaauguggcagcugauguacuuccacaggagagacuugagauuagcagcuaaugcuaucuguucagccguuccaguugauugggucccaaccagccguaccaccuggucgauccaugcccaccaccaauggaugacgacagaagacauguuaucaguguggaauaggguuuggauagaggaaaacccauggauggaggacaaaacucacguguccaguugggaagacguuccauaccuaggaaaaagggaagaucaaugguguggaucccuaauaggcuugacagcgcgagccaccugggccacuaacauacaaguggccauaaaccaagugagaaggcucauugggaaugagaauuaucuagauuacaugacaucaaugaagagauucaaaaacgagagugaucccgaaggggcacucugguaa

SEQ ID NO: 6258 - RNA, 9879 nt, Artificial Sequence
  derived and/or modified CDS sequence (wt) from DENV-1__KC762645__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuaugugaggacacacugacuuacaaaugcccucgaaucacugaggcggaaccagaugacguugauugcuggugcaaugccacagauacaugggugaccuauggaacauguucccaaacuggcgagcaccgacgagacaaacguuccgucgcacuggccccacacgugggacuugguuuggaaacaagaaccgaaacguggauguccuccgaaggcgcuuggagacagauacaaagaguggagacuugggcccugagacacccaggauucacggugauagcccuuuuucuagcacaugccauaggaacauccaucacccagaaagggauuaucuucauuuuguuaaugcuggucacaccauccauggccaugcgaugcgugggaauaggcagcagggacuucguggaaggacugucaggagcaacuuggguagauguggugcuggaacauggaaguugugucacuaccauggcaaaagacaaaccaacauuggacauugaacucuugaagacggaagucacaaacccugccguccugcgcaaacuaugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuuauaacgugugcuaaguucaagugugugacaaaacuggaaggaaaaauaguucaguaugaaaacuugaaauauucaguaauagucacuguccacacuggagaccagcaucaggugggaaaugaaagcacagaacaugggacaacugcaacuauaacaccucaagcuccuacgacagaaauacaguugaccgauuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagaaacuuggaacagacaagauuugcuggugacauuuaagacagcucaugcaaagaagcaggaaguagucguacuaggaucacaagaaggagcaaugcacacugcgcugaccggagcgacggaaauccaaacgucuggaacgacaacaauuuuugcaggacacuugaaauguagacuaaagauggacaaacugacucuaaaagggaugucauaugugaugugcacaggcucauucaagcuagagaaagaaguggcugagacccagcauggaaccguucuagugcagaucaaauacgaaggaacagaugcaccaugcaagauuccuuuuucgacccaggaugaaaaaggaguaacccagaaugggagauugauaacagccaaccccauagucacugauaaagaaaaaccagucaacauugaggcagaaccgccuuuuggugagaguuacaucgugauaggagcaggugaaaaagcucugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagaucuuuggaacugcauauggaguuuuguucagcgguguuuccuggaccaugaaaauaggaauagggguucugcugacauggcuaggauuaaacucaaggagcacgucccuuucgaugacgugcauugcaguuggccuaguaacgcuauacuuaggagucaugguucaggcggauucaggauguguaauuaauuggaaagguagagaacucaaauguggaaguggcauuuuugucaccaaugaaguucacacuuggacagagcaauacaaauuucaagcugauuccccaaagagacuaucagcagccauugggaaggcaugggaggaggguguguguggaauucgaucagcaacucgucucgagaacaucauguggaagcaaauaucaaaugaauugaaccacaucuuacuugaaaaugacaugaaauucacagugguuguaggagauguugcugggaucuuggcucaaggaaaaaaaaugauuaggccacaacccauggaacacaaauacucguggaaaagcuggggaaaggcuaaaaucauaggggcagauguacagaacaccaccuuuaucaucgacggcccaaacaccccagaaugcccugaugaucaaagagcauggaacauuugggaaguugaggauuauggauuuggaauuuucacgacaaacauauggcugaaauugcgugacuccuacacccaggugugugaccaccggcuaaugucagcugccaucaaggacagcaaggcaguucacgcugacaugggguacuggauagaaagugaaaagaacgagaccuggaagcuggcaagagccucuuucauagaagucaaaacauguaucuggccaaaaucucacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuuaauuugugugaggguaccacggucguuguggaugaacauuguggaaaucgaggaccaucucuuaggaccacaacagucacaggaaagauaauucaugaaugguguugcagaucuuguacgcuaccacccuuacguuuuagaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguagggcuacuauuccgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuaugcauggaagacaauggcuaugguacugucaauuguaucucucuuccccuuaugccuguccacgaccucccaaaaaacaacauggcuuccggugcuguugggaucucuuggauguaaaccacuaaccauguuucuuauagcagaaaacaaaaucuggggaaggaaaaguuggccccucaaugaaggaaucauggcuguuggaauugucagcauccuacuaagcucacuccucaaaaaugaugugccgcuagcugggccacuaauagcuggaggcaugcuaauagcauguuauguuauaucuggaagcucagccgaucuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaaucaugcagagaggacuguugggcagaucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggcgaaguuggagccauugcccuagauuuuaaacccggcacaucuggaucucccaucgugaacagagaagggaaaauaguaggccuuuauggaaauggaguagugacaacaaguggaaccuacgucagugccauagcucaagcuaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccagcauagcggcuagaggguacaucucaacccgagugggcaugggugaagcagcugcgaucuucaugacagccacucccccaggaucaguggaggccuuuccacagagcaacgcaguuauccaagaugaggaaagagacauuccugagagaucauggaacucaggcuaugaguggaucacugacuucccaggcaaaacaguuugguuuguuccaagcauuaaaucaggaaaugauauugccaacugcuuaagaaagaaugggaaacgggugauccaauugagcaggaaaacuuuugauacagaguaccaaaaaacaaaaaauaacgacugggacuacgucgucacaacagauaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaguuggaaggaaccacaauaaggaaggugaucaguacaucuacaugggacagccuuuaaacaacgaugaagaucacgcucacuggacggaagcaaaaaugcuccuugauaauauaaacacaccagaagggauuaucccagcccucuucgagccggagagagagaagagugcagcaauagacggggaauacagacugcggggugaagcaaggaaaacguuuguggagcucaugagaagaggagaucuaccugucuggcuauccuacaaaguugccucagaaggcuuccaguacucugauagaagauggugcuuugacggggaaaggaacaaccagguguuggaggagaacauggacguggagaucuggacaaaagaaggggaaagaaagaaacuacgaccccguuggcuggaugccagaacauacucagacccacuggcccugcgcgaguuuaaagaguuugcagcaggaagaagaagcgucucaggagaucuaauauuagaaauaggaaaacuuccacagcacuugacgcaaagggcccagaaugccuuggacaaccugguuauguuacacaacuccgaacaaggaggaagagccuauagacaugcaauggaagaacugccagacaccauagaaacguugaugcuccuagcuuugauagcuguguuaacugguggagugacgcuguucuuccuaucaggaaggggcuuagggaaaacaucuaucggccuacucugcgugauggcuucaagcguacugcuauggauggccaguguacagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacuguuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccaucgcaaaccaggcagccauauugaugggacuugacaaaggauggccaauaucgaagauggacauaggaguuccacuucucgccuuggggugcuauucccaagugaauccacugacgcugacagcggcgguauugaugcuaguggcucauuacgcuauaauuggaccuggacugcaagcaaaagcuacuagagaagcucaaaaaaggacagcggccggaauaaugaaaaauccaaccguugauggaaucguugcaauagauuuggacccugugguuuaugaugcgaaauuugagaaacaacuaggccaaauaauguuguugauacuaugcacaucacagauccucuugaugcggacuacaugggccuugugcgaauccaucacacuggccacuggaccucugaccacgcucugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacaccuauaaaaggagugggauuauggaaguggacagauccgaagccaaagagggacugaaaagaggggaaacaaccaaacaugcagugucgagaggaaccgcuaaauugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaagaaccaaucccaauggcgaccuauggauggaaccuaguaaagcugcacuccgggaaagacguauucuuuauaccaccugagaaaugugacacccucuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacauaugaaagagacguggaccuaggcgcuggaacaagacauguggcaguggaaccagagguagccaaccuagauaucaucggccagaggauagagaacauaaaacaugaacacaagucaacauggcauuaugaugaggacaauccauauaaaacaugggccuaucauggaucauaugaggucaagccaucaggaucagccucaucuauggucaaugguguggugaaacugcucaccaaaccaugggaugucauccccauggucacacaaauagccaugacugacacuacacccuuuggacaacagaggguguuuaaagagaaaguugacacacgcacaccaaaagcaaaacgaggcacaacacaaaucauggaggugacagccaggugguuaugggguuuucuuucuagaaacaagaagccaagaauuuguacaagagaggaguuuacaagaaaaguuaggucaaacgcagccaucggagcaguguucguugacgaaaaucaauggaacucagcaaaagaagcaguggaagaugagcgguucugggaccuugugcacagagagagggagcuucacaaacagggaaaaugugcuacguguguuuacaacaugauggggaagagagagaaaaagcuaggagaauuuggaaaggcaaaaggaagucgugcaauaugguacaugugguugggagcacgcuuucuagaguucgaagcucuugguuucaugaacgaagaccacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccaaaauuacugacaucauggaacccgaacaugcccuacuggcuaaggcaaucuucaagcuaaccuaccaaaauaaagugguaaggguacagagaccagcaaaaaauggaaccgugauggaugucauauccagacgugaccagagaggaaguggccaggucggaacuuauggcuuaaacacuuucaccaacauggaagcccagcugauaagacaaauggagucugagggaaucuuuucacccagugaauuagagaccccaaauuuagccgagagaguucucgacuggcuggaaaaauauggcgucgaaaggcuaaaaagaauggcaaucaguggagaugacugcguagugaaaccaauugaugauagguuugcaacagccuuaacagcucugaaugauaugggaaaaguaagaaaagauauaccacaaugggaacccucaaaaggauggaaugauuggcaacaagugccuuuuuguucacaccacuuccaccagcugauuaugaaggaugggagggaaauaguggugccaugccgcaaccaagaugaacuuguggguagagcuagaguaucacaaggugcuggauggagccugagagaaaccgcaugccuaggcaaaucauaugcacaaauguggcagcugauguacuuccacaggagagaccugagacuagccgcuaaugcuaucuguucagccguuccaguugauugggucccaaccagccguaccaccuggucgauccaugcccaucaccaauggaugacaacagaagacaugcugucaguguggaauaggguuuggauagaggaaaacccauggauggaggacaaaacccauauauccaguugggaagauguuccauauuuagggaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6259 - RNA, 9879 nt, Artificial Sequence
  derived and/or modified CDS sequence (wt) from DENV-1__KC762628__SS-prME
ucugugaccaugcuccucaugcugcugcccacagcccuggcguuccaucugaccacccgaggaggagagccgcacaugauagucagcaagcaagaaagaggaaaaucacuuuuguucaagaccucugcaggugucaacauguguacccuuauugcaauggauuugggagaguuaugugaagacacaaugaccuacaaaugcccccggaucacugagacggaaccagaugacguugacuguuggugcaaugccacggagacaugggugaccuauggaacauguucacaaacuggugaacaccgacgagacaaacguuccgucgcauuggcaccacacguagggcuuggucuagaaacaagaaccgaaacguggauguccucugaaggcgcuuggagacaaauacaaaaaguggagacuugggcucuaagacacccaggauucacggugauagcccuuuuucuagcacaugcuauaggaacauccaucacccagaaagggauuauuuuuauuuugcugaugcugguaacuccauccauggccaugcggugcgugggaauaggcaacagagacuucguggaaggacucucaggagcuacguggguggauguggugcuggagcauggaaguugcgucacuaccauggcaaaagacaaaccaacacuggacauugaacuccugaagacggaggucacaaacccugcaguccugcgcaaauugugcauugaagcuaaaauaucaaacaccaccaccgauucgagauguccaacacaaggagaagccacgcugguggaagagcaggacacgaauuuugugugccgacgaacguucguggacagaggcuggggcaaugguugugggcuauucggaaaagguagcuuaauaacgugugccaaguuuaagugugugacaaaacuagaaggaaagauaguccaauaugaaaacuuaaaauauucagucauagucaccguacacacuggagaccaacaccaaguuggaaaugagaccacagaacauggaacaacugcaaccauaacaccucaagcucccacgucggaaauacagcugacagacuacggagcucuaacauuggauuguucaccuagaacaggguuagacuuuaaugagaugguguuguugacaaugaaagaaaaaucauggcucguccacaaacaaugguuucuagacuuaccacugccuuggaccucgggggcuucaacaucccaagagacuuggaacagacaagacuugcuggucacauuuaagacagcucaugcaaaaaagcaggaaguagucguacuaggaucacaagaaggagcaaugcacacugcgcuaacuggagcgacagaaauccaaacgucuggaacgacaacaauuuucgcaggacaccugaaaugcagacuaaaaauggauaaacugaccuuaaaaggggugucauauguaaugugcacagggucauucaagcuagagaaggaaguggcugagacucagcauggaacuguucuagugcaggucaaauacgaaggaacagaugcaccaugcaagauccccuucucgucccaagaugagaagggagugacccagaaugggagauugauaacagccaaccccauagucacugacaaagaaaaaccaguuaacauugaagcggagccaccuuuuggugagagcuaccuugugguaggagcaggugaaaaagcuuugaaacuaagcugguucaagaagggaagcagcauaggaaagauguuugaagcaaccgcucguggagcgcgaaggauggccaucuugggagacaccgcaugggacuucgguucuauaggagggguguuuacgucugugggaaaauugauacaccagauuuuugggacugcguauggaguuuuguucagcgggguuucuuggacuaugaaaauaggaauagggauucugcugacauggcuaggauuaaauucaaggagcacgucccuuucaaugacguguaucgcaguuggcauggucacacuguaccuaggagucaugguucaggcggacucgggauguguaaucaacuggaaaggcagagaacucaaauguggaagcggcaucuuugucaccaaugaaguccacaccuggacagagcaauacaaauuccaagcugacucccccaagagacuaucagcggccauugggaaggcaugggaggaggguguguguggaauccgaucagccacucgccucgaaaacauuauguggaagcaaauaucaaaugaacuaaaccacaucuuacuugaaaaugacaugaaauuuacaguggucguaggagaaguuaauggaaucuuggcccaaggaaagaaaaugauuaggccacaacccauggaacacaaauauucguggaaaagcuggggaaaagccaaagucauaggagcagauguacagaauaccaccuucaucaucgacggcccaaacaccccagaaugcccugauaaucaaagagcauggaacaucugggaagucgaagacuauggauuuggaauuuucacgacaaacauaugguugaaacugcgugacuccuacacucaagugugugaccaccggcuaaugucagcugccaucaaggauagcaaagcaguccaugcugacaugggguacuggauagaaagugaaaagaacgagacuuggaaguuggcaagagccuccuucauagaaguuaagacaugcaucuggccaaaaucccauacccuauggagcaauggaguccuggaaagugaaaugauaaucccaaaaauauauggaggaccaauaucucagcacaacuacagaccaggauauuucacacaaacagcagggccguggcacuugggcaaguuagaacuggauuuugaguugugugaagguaccaccguuguuguggaugaacauuguggaagucgaggaccaucucuuagaaccacaacagucacaggaaagauaauccaugaauggugcugcagaucuugcacguuacccccccuacguuucaaaggagaagacgggugcugguacgguauggaaaucagaccagucaaggagaaggaagagaaccuaguuaaaucaauggucucugcagggucaggagaaguggacaguuuuucacuaggacugcuaugcaugucaauaaugaucgaagaagugaugagauccagauggaguagaaaaaugcugaugacuggaacauuggcuguguuccuccuccuuacaaugggacaauugacauggaaugaucugaucaggcuauguaucaugguuggagccaaugcuucagacaagauggggaugggaacaacgcaccuagcuuugauggccacuuucagaaugagaccaauguucgcagucgggcuacuguuucgcagauuaacgucuagagaaguucuucuucuuacaguuggauugagucuaguggcaucuguagaacuaccaaauuccuuggaggagcuaggggauggacuugcaaugggcaucaugauguugaaauuacuaacugauuuucagucacaccagcuaugggcugccuugcugucucuaacauuuguuaaaacaacuuuaucacugcauuacgcauggaagacaauggcuaugauacugucaauuguaucucucuucccucuaugccuguccacgacuucucaaaaaacaacauggcucccgguguugcugggaucucuuggaugcaaaccauuaaccauguuucuuauaacagaaaacaaaaucuggggaaggaaaagcuggccucucaaugagggaauuauggcuguuggaauaguuaguauucuucuaagcucacuccucaaaaaugaugugccacuagcuggcccacuaauagcuggaggcaugcuaauagcauguuaugucauaucuggaagcucggccgauuuaucauuggagaaagcggcugaggucuccugggaagaagaagcagaacacucuggugccucacacaacauacuaguggagguccaagaugauggaaccaugaagauaaaggaugaagagagagaugacacacuuaccauucuccucaaagcaacuuugcuagcaaucucagggguguacccaaugucaauaccggcgacccucuuugugugguacuuuuggcagaaaaagaaacagagaucaggagugcuaugggacacacccagcccuccagaaguggaaagagcaguccuugaugauggcauuuauagaauucuccaaagaggacuguugggcaagucucaaguaggaguaggaguuuuucaagaagguguguuucacacaauguggcacgucacuaggggagcuguucucauguaucaagggaagagauuggaaccaaguugggccagugucaaaaaagacuugaucucauauggaggagguuggagguuucaaggauccuggaacacgggagaagaagugcaggugauugcuguugaaccggggaagaacccaaaaaacgugcagacagcgccggguaccuuuaagacuccugaaggcgaaguuggagcuauagcucuagacuuuaaacccggcacaucuggaucuccuauugugaacagggagggaaaaauaguaggucuuuauggaaauggaguggugacaacaaguggaaccuacgucagugccauagcucaagccaaagcaucacaagaaggaccucuaccagagauugaggacgagguguuuaggaaaagaaacuuaacaauaauggacuuacacccaggaucgggaaaaacaagaagauaccuuccagccauaguccgugaggcuauaaaaagaaaguuacgcacgcuagucuuagcucccacaagaguugucgccucugaaauggcagaggcgcucaagggaaugccaauaagguaccagacaacagcagugaaaagugaacacacgggaaaggagauaguugaccuuaugugucacgccacuuuuaccaugcgucuccuuuccccugugagaguucccaauuauaauaugauuaucauggaugaagcacauuucacugauccagccagcauagcagccagaggguauaucucaacccgaguggguaugggugaagcagcugcaauuuucaugacagccacuccccccggaucgauagaggccuuuccacagagcaaugcagcuauccaagaugaggaaagagacauuccugaaaggucauggaacucaggcuaugacuggauuaccgauuuuccagguaaaacaguuugguuuguuccaagcaucaaaucaggaaaugauauugccaacuguuuaagaaagaaugggaaacgggugauccaauugagcagaaaaaccuucgacacugaguaccagaagacaaaaaauaacgacugggacuauguugucacaacagacauauccgaaaugggagcaaacuuccgagcagacaggguaauagacccgaggcggugccugaaaccaguaauacuaaaagauggcccagagcgugucauucuagccggaccgaugccagugacuguggcuagcgccgcccagaggagaggaagaauuggaaggaaccaaaauaaggaaggcgaucaguauauuuacaugggacagccucuaaacaaugaugaggaccacgcccauuggacagaagcaaaaaugcuccuugacaacauaaacacaccagaagggauuaucccagcccucuuugagccggagagagaaaagagugcagcaauagacggggaauacagacuacggggugaagcgaggaaaacuuucguggagcuuaugagaagaggagaucuaccugucuggcuauccuacaaaguugccucagaaggcuuccaguacuccgacagaagguggugcuuugauggagaaaggaacaaccaggugcuggaggagaacauggacguggagaucuggacaaaagaaggagaaagaaagaaacuacggccccgcuggcuggaugccagaacauacucugacccacuggcucugcgcgaauucaaagaguucgcagcaggaagaagaagcgucucaggugaccuaauauuagaaauagggaaacuuccacaacauuuaacgcaaagggcccagaaugccuuggacaaccugguuaugcugcacaacucugaacagggaggaaaagccuauagacacgccauggaagaacuaccagacaccauagaaacguuaaugcuucuggcuuugauagcugugcugacugguggggugacgcuguucuuccuaucaggaaggggucuaggaaaaacauccauuggccuacucugcgugauggccucaagugcacuguuauggauggccaguguggaaccccauuggauagcggccucuaucauacuggaguucuuucugaugguguugcuuauuccagaaccggacagacagcgcacuccacaagacaaccagcuagcauacguggugauaggucuauuauucaugauacugacaguggcagccaaugagaugggauuacuggaaaccacaaagaaggaccuagggauuggucaugcagcugcugaaaaccaccaucaugcugcaaugcuggacguagaccuacauccagcuucagccuggacccucuaugcaguggccacaacaauuauuacucccaugaugagacacacaaucgaaaacacaacggcaaauauuucccugacagcuaucgcaaaccaggcagcuauauugaugggacuugacaagggauggccaauaucaaagauggacauaggaguuccacuucucgccuuggggugcuauucucaggugaacccgcugacgcugacagcggcgguauugauguuaguggcucauuacgccauaauuggacccggauugcaagcaaaagcuacuagagaagcucaaaaaaggacagcagcuggaauaaugaaaaacccaacuguugaugggaucguugcaauagauuuggacccuguaguuuacgaugcaaaauuugaaaaacagcuaggccaaauaaugcuguuaauacucugcacaucacagauccuccugaugcggaccacaugggccuugugugaauccaucacacuagccacuggaccucugaccacacucugggagggaucuccaggaaaauucuggaacaccacgauagcgguguccauggcaaacauuuuuaggggaaguuaucuagcaggagcaggucuggccuuuucauuaaugaaaucucuagggggagguaggagagguacgggagcucaaggggaaacgcugggagaaaaauggaaaagacagcuaaaccaauugagcaagucagaauucaacacuuacaaaaggagugggaucauggagguggacagaucugaagccaaagagggguugaaaagaggagaaacgacuaaacacgcggugucgagaggaacggccaaacugaggugguuuguagagagaaaccuugugaaaccagagggaaaagucauagaccucgguuguggaagagguggcuggucauacuauugcgcugggcugaagaaagucacagaagugaaaggauacacgaaaggaggaccugggcaugaagaaccaauuccaauggcaaccuauggauggaaccuaguaaagcuacacuccgggaaagauguauucuuuacaccaccugagaaaugugacacucucuugugugauauuggugaguccucuccgaacccaaccauagaagaaggaagaacauuacguguucuaaggaugguggaaccauggcucagaggaaaccaauuuugcauaaaaguucuaaaucccuauaugccgagugugauagaaacuuuggagcagaugcagagaaaacauggaggaaugcuagugcgaaauccacucucaagaaacuccacucaugaaauguacuggguuucauguggaacaggcaauauugugucagcaguaaacaugacaucuagaaugcugcuaaaucgauucacaauggcucacaggaagccaacauaugaaagagacguggacuuaggcgcuggaacaagacauguggcaguagaaccagagguggccaaccuagauaucauuggccagaggauagagaauauaaaaaaugaacacaaaucaacauggcauuaugaugaggauaauccauacaaaacaugggccuaucauggaucauaugaggucaagccaucaggaucagccucauccauggucaaugguguggugagacugcuaaccaaaccaugggaugucauccccauggucacacaaauagccaugacugacaccacacccuuuggacaacagaggguguucaaagagaaaguugacacgcgcacaccaaaagcgaaacgaggcacagcacaaauuauggaggugacagcuaggugguuaugggguuuucucucuagaaacaaaaaacccagaaucugcacaagagaggaauucacaagaaaagucaggucaaacgcagcuaucggagcaguguucguugaugaaaaucaauggaacucagcaaaagaggcaguggaagaugaacgguucugggaccuugugcacagagagagggagcuucauaaacaaggaaaaugugccacgugugucuacaacaugaugggaaagagagagaaaaaacuaggagaguucggaaaggcaaaaggaagccgcgcaauaugguacaugugguugggagcgcgcuuuuuagaguuugaagcccuugguuucaugaaugaagaucacugguucagcagagagaauucacucaguggaguggagggagaaggacuccacaaacuuggauacauacucagagacauaucaaagauuccagggggaaauauguaugcagaugacacagccggaugggacacaagaauaacagaggaugaucuucagaaugaggccaaaaucacugacaucauggaaccugaacaugcucuauuggccacgucaaucuuuaagcuaaccuaccaaaacaagguaguaagggugcagagaccagcgaaaaauggaaccgugauggaugucauauccagacgugaccagagaggaaguggacagguuggaaccuauggcuuaaacaccuucaccaacauggaggcccaacuaauaagacaaauggagucugagggaaucuuuacacccagcgaauuggaaaccccaaaucuagccgaaagaguucucgacugguuggaaaaacauggcaucgagaggcugaaaagaauggcaaucaguggagaugacuguguggugaaaccaaucgaugacagauucgcaacagcauuaacagcuuugaaugacaugggaaagguaagaaaagacauaccgcaaugggaaccaucaaaaggauggaaugauuggcaacaagugccuuucuguucacaccauuuccaccaacugauuaugaaggaugggagggagauaguggugccaugccgcaaccaagaugaacuuguggguagggccagaguaucacaaggcgcuggauggagccugagagaaacugcaugccuaggcaagucauaugcacaaauguggcagcugauguacuuccacaggagagacuugagauuagcagcuaaugcuaucuguucagccguuccaguugauugggucccaaccagccgcaccaccuggucgauccaugcccaccaccaauggaugacaacagaagacauguuaucaguguggaauaggguuuggauagaggaaaacccauggauggaggacaaaacucacguguccaguugggaagacguuccauaccuaggaaaaagggaagaucaaugguguggaucccuaauaggcuugacagcgcgagccaccugggccacuaacauacaaguggccauaaaccaagugagaaggcucauugggaaugagaauuaucuagauuacaugacaucaaugaagagauucaaaaacgagagugaucccgaaggggcacucugguaa

SEQ ID NO: 6260 - RNA, 9879 nt, Artificial Sequence
  derived and/or modified CDS sequence (wt) from DENV-1__KC762624__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuaugugaggacacacugacuuacaaaugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggaaacuugggcccugagacacccaggauucacggugauagcccuuuuucuagcacaugccauaggaacauccaucacccagaaagggauuaucuucauuuuguuaaugcuggucacaccauccauggccaugcgaugcgugggaauagguagcagggacuucguggaaggacugucaggagcaacuuggguagauguggugcuggaacauggaaguugcgucacuaccauggcaaaagacaaaccaacauuggacauugaacucuugaagacggaagucacaaacccugccguccugcgcaaacuaugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuuauaacgugugcuaaguucaagugugugacaaaacuggaaggaaaaauaguucaguaugaaaacuugaaauauucaguaauagucaccguccacacuggagaccagcaucaggugggaaaugaaagcacagaacaugggacaacugcaacuauaacaccucaagcuccuacgacagaaauacaguugaccgacuacggagcucucacauuggauuguucaccuaggacaggacuagacuuuaaugaaaugguguuguugacaaugaaagaaaaaucauggcuaguccacaaacaaugguuucuagaccuaccacugccuuggaccucgggagcuucaacaucacaagaaacuuggaacagacaagauuugcuggugacauuuaagacagcucaugcaaagaagcaggaaguagucguacuaggaucacaagaaggagcaaugcacacugcgcugaccggagcgacggaaauccaaacgucuggaacgacaacaauuuuugcaggacacuugaaauguagacuaaagauggacaaacugacucuaaaagggaugucauaugugaugugcacaggcucauucaagcuagagaaagaaguagcugagacccagcauggaaccguucuagugcagaucaaauacgaaggaacagaugcaccaugcaagauuccuuuuucgacccaagaugaaaaaggaguaacccagaaugggagauugauaacagccaaccccauagucaccgauaaagaaaaaccagucaacauugaggcagaaccgccuuuuggugagaguuacaucgugauaggagcaggugaaaaagcuuuaaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagaucuuuggaacugcauauggaguuuuguucagcgguguuuccuggaccaugaaaauaggaauagggguucugcugacauggcuaggauuaaacucaaggagcacgucccuuucgaugacgugcauugcaguuggucuaguaacgcuauacuuaggagucaugguucaggcggauucaggauguguaauuaauuggaaagguagagaacucaaauguggaaguggcauuuuugucaccaaugaaguucacaccuggacagagcaauacaaauuucaagcugauuccccaaagagacuaucagcagccauugggaaggcaugggaggaggguguguguggaauucgaucagcaacucgucucgagaacaucauguggaagcaaauaucaaaugaauugaaccacaucuuacuugaaaaugacaugaaauucacagugguuguaggagauguugcugggaucuuggcucaaggaaaaaagaugauuaggccacaacccauggaacacaaauacucguggaaaagcuggggaaaggcuaaaaucauaggggcagauguacagaacaccaccuuuaucaucgacggcccaaacaccccagaaugcccugaugaucaaagagcauggaacauuugggaaguugaggauuauggauuuggaauuuucacgacaaacauauggcugaaauugcgugacuccuacacccaggugugugaccaccggcuaaugucagcugccaucaaggacagcaaggcaguucacgcugacaugggguacuggauagaaagugaaaagaacgagaccuggaagcuggcaagagccucuuucauagaagucaaaacauguaucuggccaaaaucucacacucuauggagcaauggaguucuggaaagugaaaugauaauuccaaagaucuauggaggaccaacaucucagcacaacuacagaccaggauauuucacacaaacggcagggccguggcaccuaggcaaguuggaacuggauuuugauuugugugaggguaccacggucguuguggaugaacauuguggaaaucgaggaccaucucuuaggaccacaacagucacaggaaaaauaauucaugaaugguguugcagaucuuguacgcuaccacccuuacguuucagaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaaugcuuccgacaggauggggaugggaacgacguaccuagcucugauggccacuuuuaaaaugagaccaauguuugcuguagggcuacuauuccgcagacuaacauccagagaaguucuucuucugacaauuggauuaagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcauuaugcauggaagacaauggcuaugguacugucaauuguaucucucuuccccuuaugccuguccacgaccucccaaaaaacaacauggcuuccggugcuguugggaucucuuggauguaaaccacuaaccauguuucuuauagcagaaaacaaaaucuggggaaggaaaaguuggccccucaaugaaggaaucauggcuguuggaauugucagcauccuacuaagcucacuccucaaaaaugaugugccgcuagcugggccacuaauagcuggaggcaugcuaauagcauguuauguuauaucuggaagcucagccgaucuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacacccagcccuccagaaguggaaagagcaguucuugaugaugguaucuauagaaucaugcagagaggacuguugggcagaucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggcgaaguuggagccauugcccuagauuuuaaacccggcacaucuggaucucccaucgugaacagagaagggaaaauaguaggucuuuauggaaauggaguagugacaacaaguggaaccuacgucagugccauagcucaagcuaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaaguugcgcacacuaauucuggcucccacaaggguugucgcuuccgaaauggcagaggcgcuuaagggaaugccaauaagguaccaaacaacagcagugaagagugaacacacaggaaaagagauaguugaccucaugugucacgccacuuucaccaugcgccuccugucucccgugagaguucccaauuauaacaugauuaucauggaugaagcacauuucaccgauccauccagcauagcggcuagaggguacaucucaacccgagugggcaugggugaagcagcugcgaucuucaugacagccacucccccaggaucaguggaggccuuuccacagagcaacgcaguuauccaagaugaggaaagagacauuccugagagaucauggaacucaggcuaugaguggaucacugacuucccaggcaaaacaguuugguuuguuccaagcauuaaaucaggaaaugauauugccaacugcuuaagaaagaaugggaaacgggugauucaauugagcagaaaaaccuuugacacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaguuggaaggaaccacaauaaggaaggugaucaguacaucuacaugggacagccucuaaacaacgaugaagaucacgcucacuggacggaagcaaaaaugcuccuugauaauauaaacacaccagaagggauuaucccagcccucuucgagccggagagagaaaagagugcagcaauagacggggaauacagacugcggggugaagcaaggaaaacguuuguggagcucaugagaagaggagaucuaccugucuggcuauccuacaaaguugccucagaaggcuuccaguacucugauagaagauggugcuuugacggggaaaggaacaaccagguguuggaggagaacauggacguggagaucuggacaaaagaaggagaaagaaagaaacuacgaccccguuggcuggaugccagaacauacucagacccacuggcccugcgcgaguuuaaagaguuugcagcaggaagaagaagcgucucaggagaucuaauauuagaaauagggaaacuuccacaacacuugacgcaaagggcccagaaugccuuggacaaccugguuauguuacacaacuccgaacaaggaggaagagccuauagacaugcaauggaagaacugccagacaccauagaaacuuugaugcuccuagcuuugauagcuguguuaacugguggagugacgcuguucuuccugucaggaaggggcuuaggaaaaacaucuaucggccuacucugcgugauggcuucaagcguacugcuauggauggccaguguagagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagccauauugaugggacuugauaaaggauggccaauaucgaagauggacauaggaguuccacuucucgccuuggggugcuauucccaagugaauccacugacgcugacagcggcgguauugaugcuaguggcucauuacgcuauaauuggaccuggacugcaagcaaaagcuacuagagaagcucaaaaaaggacagcggccggaauaaugaaaaauccaaccguugauggaaucguugcaauagauuuggacccugugguuuaugaugcgaaauuugagaaacaacuaggccagauaauguuguugauacuaugcacaucacagauccucuugaugcggacuacaugggccuugugcgaauccaucacacuggccacuggaccucugaccacgcucugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacaggagcccaaggggaaacacugggagagaaauggaaaagacagcugaaccaacugagcaagucagaauucaacaccuauaaaaggagcgggauuauggaaguggacagauccgaagccaaagagggacugaaaagaggggaaacaaccaaacaugcagugucgagaggaaccgcuaaauugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaagaaccaaucccaauggcgaccuauggauggaaccuagugaagcugcacuccgggaaagacguauucuuuauaccaccugagaaaugugacacccucuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacauaugaaagagacguggaccuaggcgcuggaacaagacauguggcaguggaaccagagguagccaaccuagauaucauuggccagaggauagagaacauaaaacaugaacacaagucaacauggcauuaugaugaggacaauccauauaaaacaugggccuaucauggaucauaugagguuaagccaucaggaucagccucauccauggucaaugguguggugaaacugcucaccaaaccaugggaugucauccccauggucacacaaauagccaugacugacacuacacccuuuggacaacagaggguguuuaaagagaaaguugacacacgcacaccaaaagcaaaacgaggcacaacacaaaucauggaggugacagccaggugguuaugggguuuucuuucuagaaacaagaagccaagaauuuguacaagagaggaguuuacaagaaaaguuaggucaaacgcagccaucggagcaguguucguugacgaaaaucaauggaacucagcaaaagaagcaguggaagaugagcgguucugggaccuugugcacagagagagggagcuucacaaacagggaaaaugugcuacguguguuuacaacaugauggggaagagagagaaaaagcuaggagaauuuggaaaggcaaaaggaagucgugcaauaugguacaugugguugggagcacgcuuucuagaguucgaagcucuugguuucaugaacgaagaccacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccaaaauuacugacaucauggaacccgaacaugcccuacuggcuaaggcaaucuucaagcuaaccuaccaaaauaaagugguaaggguacagagaccagcaaaaaauggaaccgugauggaugucauauccagacgugaccagagaggaaguggccaggucggaacuuauggcuuaaacacuuucaccaacauggaagcccagcugauaagacaaauggagucugagggaaucuuuucacccagugaauuagagaccccaaauuuagccgagagaguucucgacuggcuggaaaaauauggcgucgaaaggcuaaaaagaauggcaaucaguggagaugacugcguagugaaaccaauugaugauagguuugcaacagccuuaacagcucugaaugauaugggaaaaguaagaaaagauauaccacaaugggaacccucaaaaggauggaaugauuggcaacaagugccuuuuuguucacaccacuuccaccagcugauuaugaaggaugggagggaaauaguggugccaugccgcaaccaagaugaacuuguggguagagcuagaguaucacaaggugcuggauggagccugagagaaaccgcaugccuaggcaaaucauaugcacaaauguggcagcugauguacuuccacaggagagaccugagacuagccgcuaaugcuaucuguucagccguuccaguugauugggucccaaccagccguaccaccuggucgauccaugcccaucaccaauggaugacaacagaagacaugcugucaguguggaauaggguuuggauagaggaaaacccauggauggaggacaaaacccauguauccaguugggaggauguuccauauuuagggaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6261 - RNA, 9879 nt, Artificial Sequence
  derived and/or modified CDS sequence (wt) from DENV-1__KC762644__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuaugugaggacacacugacuuacaaaugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccuccgaaggcgcuuggaaacagauacaaagaguggagacuugggcccugagacacccaggauucacggugauagcccuuuuccuagcacaugccauaggaacauccaucacccagaaagggauuaucuucauuuuguuaaugcuggucacaccauccauggccaugcgaugcgugggaauaggcagcagggacuucguggaaggacugucaggagcaacuuggguagauguggugcuggaacauggaaguugcgucacuaccauggcaaaagacaaaccaacauuggacauugaacucuugaagacggaagucacaaacccugccguccugcgcaaacuaugcauugaagcuaaaauaucaaacacuaccaccgacucaagauguccaacacaaggagaagccacacugguggaagaacaagacgcgaacuuugugugucgacgaacguuuguggacagaggcuggggcaauggcugugggcucuucggaaaaggaagccuuauaacgugugcuaaguucaagugugugacaaaacuggaagggaaaauaguucaguaugaaaacuugaaauauucaguaauagucaccguccacacuggagaccagcaucaggugggaaaugaaagcacagaacaugggacaacugcaacuauaacaccucaagcuccuacgacagaaauacaguugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagaaacuuggaacagacaagauuugcuggugacauuuaagacagcucaugcaaagaagcaggaaguagucguacuaggaucacaagaaggagcaaugcacacugcgcugaccggagcgacggaaauccaaacgucuggaacgacaacaauuuuugcaggacacuugaaauguagacuaaagauggacaaacugacucuaaaagggaugucauaugugaugugcacaggcucauucaagcuagagaaagaaguggcugagacccagcauggaaccguucuagugcagaucaaauacgaaggaacagaugcaccaugcaagauuccuuuuucgacccaagaugaaaaaggaguaacccagaaugggagauugauaacagccaaucccauagucacugauaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagaucuuuggaacugcauauggaguuuuguucagcgguguuuccuggaccaugaaaauaggaauagggguucugcugacauggcuaggauuaaacucaaggagcacgucccuuucgaugacgugcauugcaguuggccuaguaacgcuauacuuaggagucaugguucaggcggauucaggauguguaauuaauuggaaagguagagaacucaaauguggaaguggcauuuuugucaccaaugaaguucacacuuggacagagcaauacaaauuucaagcugauuccccaaagagacuaucagcagccauugggaaggcaugggaggaggguguguguggaauucgaucagcaacucgucucgagaacaucauguggaagcaaauaucaaaugaauugaaccacaucuuacuugaaaaugacaugaaauucacagugguuguaggagauguugcugggaucuuggcucaagggaaaaaaaugauuaggccacaacccauggaacacaaauacucguggaaaagcuggggaaaggcuaaaaucauaggggcagauguacagaauaccaccuuuaucaucgacggcccaaacaccccagaaugcccugaugaucaaagagcauggaacauuugggaaguugaggauuauggauuuggaauuuucacgacaaacauauggcugaaauugcgugacuccuacacccaggugugugaccaccggcuaaugucagcugccaucaaggacagcaaggcaguucacgcugacaugggguacuggauagaaagugaaaagaacgagaccuggaagcuggcaagagccucuuucauagaagucaaaacauguaucuggccaaaaucucacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacggucguuguggaugaacauuguggaaaucgaggaccaucucuuaggaccacaacaguuacaggaaagauaauucaugaaugguguuguagaucuuguacgcuaccacccuuacguuucagaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguagggcuacuauuccgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcauuaugcauggaagacaauggcuaugguacugucaauuguaucucucuuccccuuaugccuguccacgaccucccaaaaaacaacauggcuuccggugcuguugggaucucuuggauguaaaccacuaaccauguuucuuauagcagaaaacaaaaucuggggaaggaaaaguuggccccucaaugaaggaaucauggcuguuggaauugucagcauccuacuaagcucacuccucaaaaaugaugugccgcuagcugggccacuaauagcuggaggcaugcuaauagcauguuauguuauaucuggaagcucagccgaucuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguauuuuuggcagaaaaagaaacagagauccggaguguuaugggacacaccuagcccuccagaaguggaaagagcaguucuugaugaugguaucuauagaaucaugcagagaggacuguugggcagaucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacaggagaagaagugcaggugauugcuguugaaccagggaaaaacccaaaaaauguacaaacagcgccgggcaccuuuaagaccccugaaggcgaaguuggagccauugcccuagauuuuaaacccggcacaucuggaucucccaucgugaacagagaagggaaaauaguaggucuuuauggaaauggaguagugacaacaaguggaaccuacgucagugccauagcucaagcuaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuauaauaugauuaucauggaugaagcacauuucaccgauccauccagcauagcggcuagaggguacaucucaacccgagugggcaugggugaagcagcugcgaucuucaugacagccacucccccaggaucaguggaggccuuuccacagagcaacgcaguuauccaagaugaggaaagagacauuccugagagaucauggaacucaggcuaugaguggaucacugacuucccaggcaaaacaguuugguuuguuccaagcauuaaaucaggaaaugauauugccaacugcuuaagaaagaaugggaaacgggugauucaauugagcagaaaaaccuuugacacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaguuggaaggaaccacaauaaggaaggugaucaguacaucuacaugggacagccuuuaaacaacgaugaagaucacgcucacuggacggaagcaaaaaugcuccuugauaauauaaacacaccagaagggauuaucccagcccucuucgagccggagagagaaaagagugcagcaauagacggggaauacagacugcggggugaagcaaggaaaacguuuguggagcucaugagaagaggagaucuaccuguuuggcuauccuacaaaguugccucagaaggcuuccaguacucugauagaagauggugcuuugacggggaaaggaacaaccagguguuggaggagaacauggacguggagaucuggacaaaagaaggagaaagaaagaaacuacgaccccguuggcuggaugccagaacauacucagacccacuggcccugcgcgaguuuaaagaguuugcagcaggaagaagaagugucucaggagauuuaauauuagaaauagggaaacuuccacaacacuugacgcaaagggcccagaaugccuuggacaaccugguuauguuacacaacuccgaacaaggaggaagagccuauagacaugcaauggaagaauugccagacaccauagaaacguugaugcuccuagcuuugauagcuguguuaacugguggagugacgcuguucuuccuaucaggaaggggcuuagggaaaacaucuaucggccuacucugcgugauggcuucaagcguacugcuauggauggccaguguagagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagccauauugaugggacuugacaaaggauggccaauaucgaagauggacauaggaguuccacuucucgccuuggggugcuauucccaagugaauccacugacgcugacagcggcgguauugaugcuaguggcucauuacgcuauaauuggaccuggacugcaagcaaaagccacuagagaagcucaaaaaaggacagcggccggaauaaugaaaaauccaaccguugauggaaucguugcaauagauuuggacccugugguuuaugaugcgaaauuugagaaacaacuaggccaaauaauguuguugauacuaugcacaucacagauccucuugaugcggacuacaugggccuugugcgaauccaucacacuggccacuggaccucugaccacacucugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacaccuauaaaaggagugggauuauggaaguggacagauccgaagccaaagagggacugaaaagaggggaaacaaccaaacaugcagugucgagaggaaccgcuaaauugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaagaaccaaucccaauggcgaccuauggauggaaccuaguaaagcugcacuccgggaaagacguauucuuuauaccaccugagaaaugugacacccucuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacauaugaaagagacguggaccuaggcgcuggaacaagacauguggcaguggaaccagagguagccaaccuagauaucauuggccagaggauagagaacauaaaacaugaacacaagucaacauggcauuaugaugaggacaauccauauaaaacaugggccuaucauggaucauaugaggucaagccaucaggaucagccucauccauggucaaugguguggugaaacugcucaccaaaccaugggaugucauccccauggucacacaaauagccaugacugacacuacacccuuuggacaacagaggguguuuaaagagaaaguugacacacgcacaccaaaagcaaaacgaggcacaacacaaaucauggaggugacagccaggugguuaugggguuuucuuucuagaaacaagaagccaagaauuuguacaagagaggaguuuacaagaaaaguuaggucaaacgcagccaucggagcaguguucguugacgaaaaucaauggaacucagcaaaagaagcaguggaagaugagcgguucugggaccuugugcacagagagagggagcuucacaaacagggaaaaugugcuacguguguuuacaacaugauggggaagagagagaaaaagcuaggagaauuuggaaaggcaaaaggaagucgugcaauaugguacaugugguugggagcacgcuuucuagaguucgaagcucuugguuucaugaacgaagaccacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccaaaauuacugacaucauggaacccgaacaugcccuacuggcuaaggcaaucuuugagcuaaccuaccaaaauaaagugguaaggguacagagaccagcaaaaaauggaaccgugauggaugucauauccagacgugaccagagaggaaguggccaggucggaacuuauggcuuaaacacuuucaccaacauggaagcccagcugauaagacaaauggagucugagggaaucuuuucacccagugaauuagagaccccaaauuuagccgagagaguucucgacuggcuggaaaaauauggcgucgaaaggcuaaaaagaauggcaaucaguggagaugacugcguagugaaaccaauugaugauagguuugcaacagccuuaacagcucugaaugauaugggaaaaguaagaaaagauauaccacaaugggaacccucaaagggauggaaugauuggcaacaagugccuuuuuguucacaccacuuccaccagcugauuaugaaggaugggagggaaauaguggugccaugccgcaaccaagaugaacuuguggguagagcuagaguaucacaaggugcuggauggagccugagagaaaccgcaugccuaggcaaaucauaugcacaaauguggcagcugauguacuuccacaggagagaccugagacuagccgcuaaugcuaucuguucagccguuccaguugauugggucccaaccagccguaccaccuggucgauccaugcccaucaccaauggaugacaacagaagacaugcugucaguguggaauaggguuuggauagaggaaaacccauggauggaggacaaaacccauauauccaguugggaggauguuccauauuuagggaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagcgaucccgaaggggcacucugguga

SEQ ID NO: 6262 - RNA, 9879 nt, Artificial Sequence
  derived and/or modified CDS sequence (wt) from DENV-1__KC762630__SS-prME
ucugugaccgugcuguucaugcugcugcccacagcccuggcguuccaucugaccacccgagggggagaaccgcacaugauaguuagcaagcaggaaagaggaaagucacuuuuguucaagaccucugcaggugucaacauguguacccuuauugcaauggacuugggagaguugugugaggacacaaugaccuacaaaugcccccggaucacugaaacggaaccagaugacguugacuguuggugcaacgccacggagacaugggugacuuauggaacauguucucaaacuggugaacaccgacgagacaaacguucuguugcacuggcaccacacguagggcuuggucuagaaacaagaaccgaaacguggauguccucugaaggcgcuuggaaacaaauacaaaaaguggagaccugggcucugagacacccaggauucacggugauagcucuuuuccuagcacaugccauaggaacauccauuacccagaaaggaauuauuuucauuuuacugaugcugguaacuccauccauggccaugcggugcguaggaauaggcaacagagacuucguggaaggacugucaggagcuacguggguggaugugguacuggagcauggaaguugugucacuacaauggcaaaaaacaaaccaacacuggauauugaacucuuaaagacggagguuacaaacccagccauccugcgcaaacugugcauugaagccaaaauaucaaauacuaccaccgauucgagauguccaacacaaggagaagccacgcugguggaagaacaagacacgaacuucgugugucgacgaacguucguggacagaggcuggggcaaugguugugggcuauuuggaaaagguagcuuaauaacgugugcuaaguuuaagugugugacaaaauuggaaggaaagauaguccaauaugaaaauuuaaaauauucagugauagucaccguccacacuggagaccagcaccaaguugggaaugagacuacagaacauggaacaacugcaaucauaacaccucaagcuccuacgucggaaauacagcugacagacuacggagcuuuaacacuggacuguucaccuagaacagggcuagacuucaaugagaugguguuguugacaaugaaagaaaaaucauggcucguccacaaacaaugguuucuagacuuaccgcugccuuggaccucgggggcuucaacaucccaagagacuuggaauagacaagacuugcuggucacauucaagacagcucaugcaaagaagcaggaaguaguuguacuaggaucacaagaaggagcgaugcacacugcgcugacuggagcaacagaaauccaaacgucuggaacgacaacaauuuucgcaggacaccugaaaugcagacugaaaauggauaaacuaacuuuaaaagggguaucauacguaaugugcacaggcucauucaagcuagaaaaggaaguggcugagacccagcauggaacuguucuagugcagguuaaguacgaaggaacagaugcaccauguaagauccccuucucaucccaagaugagaagggaguaauccagaaugggagauugauaacagccaaccccauagucacugacaaagaaaaaccagucaacauugaggcggagccaccuuuuggugagagcuacaucgugguaggagcaggugagaaagcuuugaaacuaagcugguucaagaagggaagcaguauagggaaaauguuugaagcaacugcccguggagcacgaaggauggccauucugggagacacugcaugggacuuugguucuauaggaggaguguucacguccgugggaaaacugguacaccagauuuuuggaacugcguacggaguuuuguucagcgguguuucuuggaccaugaaaauaggaauagggauucugcugacauggcuaggauuaaauucaaggagcacgucccuuucaaugacguguaucgcaguuggcauggucacacuguaccuaggagucaugguucaggcggacucgggauguguaauuaacuggaaaggcagagaacucaaaugcggaagcggcauuuuugucacuaaugaaguucacaccuggacagagcaauacaaauuccaggccgacuccccaaagagacuaucagcagccauugggaaggcaugggaggaggguguguguggaauucggucagccacucgucucgaaaacaucauguggaagcaaauaucaaaugaauuaaaccacaucuuacuugaaaaugacaugaaauucacaguggucguaggagaugucagugggaucuuggcccaaggaaagaaaaugauuaggccacaacccauggaacacaaauacucguggaaaagcuggggaaaagccaagaucauaggagcagauguacagaacaccaccuucaucaucgacggcccaaacaccccagaaugcccugauaaccaaagagcauggaacaucugggaaguugaagacuauggauuuggaauuuucacgacaaacauaugguuaaaauugcgugacucuuauacccaaguaugugaccaccggcuaaugucagcugccauuaaggauagcaaagcaguccaugcugacaugggguacuggauagaaagugaaaagaacgagacuuggaaguuggcaagagccuccuucauagaagucaagacaugcaucuggccaaaaucccacacucuauggagcaauggaguccuugaaagugagaugauaaucccaaagauauauggaggaccaguaucucagcacaacuacagaccaggauauuucacacaaacagcagggccauggcacuuaggcaaguuggaacuagauuuugauuugugugaagguaccacaguuguuguggaugaaaauuguggaaaucgaggaccaucucuuagaaccacaacagucacaggaaagacaauccaugaauggugcuguagaucuugcacguuacccccucuacguuucaaaggggaagacgggugcugguacgguauggaaaucagaccagucaaggagaaggaagagaaccuaguuaagucaauggucucugcagggucaggagaaguggauagcuuuucacuaggacugcuaugcauaucaauaaugaucgaagagguaaugagauccagauggagcagaaagaugcugaugacuggaacauuggcuguguuccuccuucucacaaugggacaauugacauggaaugaucugaucaggcuauguaucauggucggagccaaugcuucagacaugauggggaugggaacaacguaccuagcuuugauggccacuuucagaaugagaccaauguucgcagucggacucuuauuucgcagauuaacaucuagagaaauucuucuucuuacaguuggauugagccugguggcaucuguagaacuaccaaauuccuuagaagagcuaggggauggacuugcaaugggcaucaugauguugaaauuauugacugauuuucagccacaucagcuaugggcuaccuugcugucuuuaacauuugucaaaacaacucuuucauugcacuaugcauggaagacaauggccaugauacuaucaauugugucucuccucccuuugugccuguccacgacaucucaaaaaacgacauggcuuccggugcugcugggaucucuuggaugcaaaccacuaaccauguuucuuauaacagaaaacaaaauuugggggaggagaaguuggccccucaaugaaggaauuauggcuauuggaauaguaagcauccuacuaaguucacuucucaaaaaugauguaccacuagcuggcccacuaauagcuggaggcaugcuaauagcauguuaugucauaucuggaagcucggccgaccuaucacuggagaaagcggcugagguuuccugggaagaugaagcagaacacucuggugccucacacaacauacuaguggagguccaagaugacggaaccaugaagauaaaagaugaagagagagaugacacacucaccauucuccucaaagcaacucuguuaguaaucucagggguauacccaaugucaguaccggcgacccucuuugugugguauuuuuggcagaaaaagaaacagagaucaggagugcuaugggacacacccagcccuccagaaguggaaagagcaguccuugacaauggcauuuauagaauucuccaaagaggauuguugggcaggucucaaguaggaguaggaguuuuucaagaagguguguuccacacaauguggcacgucaccaggggagcuguucucauguaccaagggaagagauuggaaccaaguugggcuagugucaaaaaagacuugaucucauauggaggagguuggagguuucaaggauccuggaacacgggagaagaagugcaggugauugcuguugaaccggggaagaaccccaaaaauguacagacaacgccaggcaccuucaagaccccugaaggugaaauuggagcuaucgcucuagacuucaaacccggcacaucuggaucuccuaucgugaacagagagggaaaaauagugggucuuuauggaaauggaguggugacaacaaguggaaccuacgucagugccauagcucaagcuaaaguaucacaagaagggccccuaccagagauugaggacgagguguuuaggaaaaggaauuuaacaauaauggaccuacauccaggaucagggaaaacaagaagauaccuuccagccauaguccgugaggccauaaaaagaaaguugcgcacgcuagucuuggcccccacaagaguugucgcuucugaaauggcagaagcgcuuaagggaaugccaauaagguaucagacaacagcagugaaaagugaacacacgggaaaggagauaguugaucucaugugccacgccacuuucacuaugcgucuccugucuccugugagaguccccaauuauaacaugauuaucauggaugaagcacauuucaccgauccagccaguauagcagccagaggguacaucucaacccgaguagguaugggcgaagcagcugcgaucuucaugacagccacuccccccggaucgguggaggccuuuccacagagcaaugcaguuauccaagaugaggaaagagacauuccugaaagaucauggaacucaggcuaugaauggaucacugauuucccaggaaaaacagucugguuuguuccaagcaucaaaucaggaaaugacauugccaacuguuuaagaaagaaugggaaacgggugguccaauugagcaggaaaacuuuugacacugaguaccagaaaacaaaaaacaacgacugggacuauguugucacaacagacauauccgaaaugggagcaaacuuccgagccgacaggguaauagacccaaggcggugccugaaaccaguaauacuaaaagaugguccagagcgugucauccuagccggaccgaugccagugacuguggcuagugccgcccagaggagaggaagaauuggaaggaacccaaauaaggaaggugaucaguacguguacaugggacagccucuaaacaaugaugaggaccacgcccauuggacagaagcaaaaaugcuccuugacaacauaaacacaccagaagggaucaucccagcccucuuugagccggagagagaaaagagugcagcaauagacggggaauacagauuacggggugaagcaaggaaaacguucguggagcucaugagaagaggagaucuaccugucuggcuauccuacaaaguugccucagaaggcuuccaguacuccgacagaagguggugcuuugauggggaaaggaacaaccagguguuggaggagaacauggacguggaaauuuggacaaaagaaggagaaagaaagaaacuacgaccccgcuggcuggaugccagaacauauucugacccacuggcucugcgcgaauucaaagaguucgcagcaggaagaagaagugucucaggugaccuaauauuagaaauagggaaacuuccacaacauuuaacgcuaaaagcucagaaugcuuuggauaaucuggucaugcugcacaacucugaacagggaggaaaggccuacagacacgccauggaagaacuaccagauaccauagaaacguuaaugcuccuagcucugauagcugugcugacugguggagugacgcuguucuuccuaucaggaagaggucuaggaaaaacauccauuggccuacucugugugauggccucaagugcacuguuguggauggccaguguggagccucauuggauagcggccucuaucauacuggaguucuuucugaugguguugcuuauuccagagccagaccgacagcgcacuccacaagacaaccagcuagcauauguggugauagguuuguuauucaugauauugacaguggcugccaaugagaugggauuguuggaaaccacaaagaaagaccuggggauuggucaugcagcugcugaaaaccaccaccaugcugcaaugcuggacguggaccuacauccagcuucagccuggacucucuaugcaguggccacaacaauuaucacucccaugaugagacacacaauugaaaacacaacggcaaauauuucccugacagcuaucgcaaaccaggcagcuauauugaugggacuugacaagggauggccaauaucaaagauggacauaggaguuccacuucucgccuuggggugcuauucucaggugaacccgcugacgcugacagcggcgguauugaugcuaguggcucacuaugccauaauuggaccuggacugcaggcaaaagcuacuagagaagcucaaaaaaggacagcagcuggaauaaugaaaaacccaacugucgacgguaucguugcaauagauuuggacccuguaauuuacgaugcaaaauuugaaaaacagcugggccaaauaauguuguugauacuuugcacaucacagauucuccuaaugcggaccacaugggccuugugugaauccaucacauuggccacuggaccucugaccacgcuuugggagggaucuccaggaaaauucuggaauacaacuauagcgguguccauggcaaacaucuucaggggaaguuaucuagcgggagcaggucuggccuuuucauugaugaaaucucuaggaggagguaggagaggcacaggagcccaaggagaaacgcugggagaaaaauggaaaagacagcuaaaccaauugagcaaaucagaauuuaacauuuacaagaggagugggauuauagagguggauagaucugaagccaaagagggguugaaaagaggagaaacaaccaaacaugcagugucgagaggaacggccaaauugaggugguuuguggagaggaaccuugugaaaccagaagggaaagucauugaccucgguuguggaagagguggcuggucauauuacugcgcugggcugaagaaagucacagaaguaaaaggauacacgaaaggaggaccuggacaugaggaaccaaucccaauggcaaccuauggauggaaccuaguaaagcuacacuccggaaaagauguauucuuuacaccaccugagaaaugugacacccuuuugugugauaucggugaguccucuccgaacccaacuauagaagaaggaagaacauuacguguucuaaagaugguggaaccauggcucagaggaaaucaauuuugcauaaaaauucuaaaucccuacaugccgagugugguagaaacccuggagcaaaugcaaaggaagcauggaggaaugcuagugcgaaauccacucucaagaaacuccacucaugaaauguacuggguuucauguggaacaggaaacauugugucagcagugaacaugacaucuagaaugcugcuaaaucgauucacaauggcucacaggaaaccaacauaugaaagagacguggacuuaggcgcuggaacaagacauguggcaguggaaccagagguggccaacuuagauaucauuggccagaggauagagaauauaaaaaaugaacacaaaucaacauggcauuaugaugaggacaauccauacaaaacaugggccuaucauggaucauaugaggucaagccaucaggaucagcuucauccauggucaaugguguggugagacugcuaaccaaaccaugggaugucauucccauggucacacaaauagccaugacugacaccacacccuuuggacaacagaggguguuuaaagagaaaguugauacgcgcacaccaaaagcgaaacgaggcacagcgcaaauuauggagguaacagccaggugguuaugggguuuucucucuagaaacaaaaaacccagaaucugcacaagggaggaguucacaagaaaaguuaggucaaacgcagccauuggagcaguguucguugaugaaaaucaguggaacucagcaaaagaggcaguggaagaugaacgguuuugggaccuugugcacagagagagagagcuucauaaacaaggaaaaugugccacgugcgucuacaacaugaugggaaagagagagaaaaaauuaggagaguucggaaaggcaaaaggaagucgcgcaauaugguacaugugguugggagcgcgcuuuuuagaguuugaagcccuagguuucaugaaugaggaucauugguucagcagagagaauucacuuaguggaguggaaggagaaggacuccacaaacuuggauacauacuuagagacauaucaaagauuccagggggaaauauguaugcagaugacacagccggaugggacacaagaauaacagaggaugaucuucagaaugaggcaaaaaucacugacaucauggaaccugaacaugcccuauuggccacgucaaucuuuaagcuaaccuaccaaaacaagguaguaagggugcagagaccaggaaaaaauggaaccgugauggaugucauauccagacgugaccagagaggaaguggacagguuggaaccuauggcuuaaacaccuucacuaacauggaggcccaacuaauaagacaaauggagucugagggaaucuuuucaccuagcgaauuggaaaccccaaaccuagcugaaagagucuucgacugguuggaaaaacauggcaucgagaggcugaaaagaauggcaauuaguggagaugacuguguggugaaaccaauugaugacagauuugcaacagccuuaacagccuugaaugacaugggaaagguaagaaaagacauaccgcaaugggaacccucaaaaggauggaacgauuggcaacaagugccuuuuuguucacaccauuuccaccagcugauuaugaaggaugggagggagauaguggugccaugccgcaaccaagaugaacuuguggguagggccagagucucacaaggcgccggauggagcuuaagagaaacugcaugccuaggcaagucauaugcacaaauguggcagcugauguacuuccacaggagagauuugagacuagcggcuaaugccaucuguucagccguuccaguugacugggucccaaccagccgcaccaccuggucgauccaugcccaccaucaguggaugacaacagaagacauguugucaguauggaauaggguuuggauagaggaaaauccauggauggaggacaaaacucauguguccaguugggaagacguuccauaccuaggaaaaagggaagaucaaugguguggaucccuaauaggcuuaacagcacgagccaccugggccaccaacauacaaguggccauaaaccaagugagaaggcucauugggaacgagaacuaucuagacuauaugacaucaaugaagagauucaaaaacgagagugauccugaaggggcacucugguaa

SEQ ID NO: 6263 - RNA, 9879 nt, Artificial Sequence
  derived and/or modified CDS sequence (wt) from DENV-1__KC762641__SS-prME
ucugugaccaugcuccuuaugcugaugccuacagccuuggcguuccauuugacuacacgagggggagagccgcacaugauagucagcaagcaggaaagaggaaagucacuuuuguuuaagacuucagcaggugucaacaugugcacccuuauagcgauggauuugggagaguuaugugaggacacacugacuuacaaaugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccuccgaaggcgcuuggaaacagauacaaagaguggagacuugggcccugagacacccaggauucacggugauagcccuuuuucuagcacaugccauaggaacauccaucacccagaaagggauuaucuucauuuuguuaaugcuggucacaccauccauggccaugcgaugcgugggaauaggcagcagggacuucguggaaggacugucaggagcaacuuggguagauguggugcuggaacauggaaguugcgucacuaccauggcaaaagacaaaccaacauuggacauugaacucuugaagacggaagucacaaacccugccguccugcgcaaacuaugcauugaagcuaaaauaucaaacacuaccaccgacucaagauguccaacacaaggagaagccacacugguggaagaacaagacgcgaacuuugugugucgacgaacguuuguggacagaggcuggggcaauggcugugggcucuucggaaaaggaagccuuauaacgugugcuaaguucaagugugugacaaaacuggaaggaaaaauaguucaguaugaaaacuugaaauauucaguaauagucaccguccacacuggagaccagcaucaggugggaaaugaaagcacagaacaugggacaacugcaacuauaacaccucaagcuccuacgacagaaauacaguugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagaaacuuggaacagacaagauuugcuggugacauuuaagacagcucaugcaaagaagcaggaaguagucguacuaggaucacaagaaggagcaaugcacacugcgcugaccggagcgacggaaauccaaacgucuggaacgacaacaauuuuugcaggacacuugaaauguagacuaaagauggacaaacugacucuaaaagggaugucauaugugaugugcacaggcucauucaagcuagagaaagaaguggcugagacccagcauggaaccguucuagugcagaucaaauacgaaggaacagaugcaccaugcaagauuccuuuuucgacccaagaugaaaaaggaguaacccagaaugggagauugauaacagccaaccccauagucacugauaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagaucuuuggaacugcauauggaguuuuguucagcgguguuuccuggaccaugaaaauaggaauagggguucugcugacauggcuaggauuaaacucaaggagcacgucccuuucgaugacgugcauugcaguuggccuaguaacgcuauacuuaggagucaugguucaggcggauucaggauguguaauuaauuggaaagguagagaacucaaauguggaaguggcauuuuugucaccaaugaaguucacacuuggacagagcaauacaaauuucaagcugauuccccaaagagacuaucagcagccauugggaaggcaugggaggaggguguguguggaauucgaucagcaacucgucucgagaacaucauguggaagcaaauaucaaaugaauugaaccacaucuuacuugaaaaugacaugaaauucacagugguuguaggagauguugcugggaucuuggcucaaggaaaaaaaaugauuaggccacaacccauggaacacaaauacucguggaaaagcuggggaaaggcuaaaaucauaggggcagauguacagaauaccaccuuuaucaucgacggcccaaacaccccagaaugcccugaugaucaaagagcauggaacauuugggaaguugaggauuauggauuuggaauuuucacgacaaacauauggcugaaauugcgugacuccuacacccaggugugugaccaccggcuaaugucagcugccaucaaggacagcaaggcaguucacgcugacaugggguacuggauagaaagugaaaagaacgagaccuggaagcuggcaagagccucuuucauagaagucaaaacauguaucuggccaaaaucucacacucuauggagcaauggaguucuggaaagugaaaugauaaucccaaagaucuauggaggaccaauaucucagcacaacuacagaccaggauauuucacacaaacggcagggccguggcaccuaggcaaguuggaacuggauuuugauuugugugaggguaccacggucguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguucgcuguagggcuacuauuccgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcauuaugcauggaagacaauggcuaugguacugucaauuguaucucucuuccccuuaugccuguccacgaccucccaaaaaacaacauggcuuccggugcuguugggaucucuuggauguaaaccacuaaccauguuucuuauagcagaaaacaaaaucuggggaaggaaaaguuggccccucaaugaaggaaucauggcuguuggaauugucagcauccuacuaagcucacuccucaaaaaugaugugccgcuagcugggccacuaauugcuggaggcaugcuaauagcauguuauguuauaucuggaagcucagccgaucuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagauccggaguguuaugggacacaccuagcccuccagaaguagaaagagcaguucuugaugaugguaucuauagaaucaugcagagaggacuguugggcagaucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggcgaaguuggagccauugcccuagauuuuaaacccggcacaucuggaucucccaucgugaacagagaagggaaaauaguaggucuuuauggaaauggaguagugacaacaaguggaaccuacgucagugccauagcucaagcuaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuauaacaugauuaucauggaugaagcacauuucaccgauccauccagcauagcggcuagaggguacaucucaacccgagugggcaugggugaagcagcugcgaucuucaugacagccacucccccaggaucaguggaggccuuuccacagagcaacgcaguuauccaagaugaggaaagagacauuccugagagaucauggaacucaggcuaugaguggaucacugacuucccaggcaaaacaguuugguuuguuccaagcauuaaaucaggaaaugauauugccaacugcuuaagaaagaaugggaaacgggugauucaauugagcagaaaaaccuuugacacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaguuggaaggaaccacaauaaggaaggugaucaguacaucuacaugggacagccuuuaaacaacgaugaagaucacgcucacuggacggaagcaaaaaugcuccuugauaauauaaacacaccagaagggauuaucccagcccucuucgagccggagagagaaaagagugcagcaauagacggggaauacagacugcggggugaagcaaggaaaacguuuguggagcucaugagaagaggagaucuaccugucuggcuauccuacaaaguugccucagaaggcuuccaguacucugauagaagauggugcuuugacggggaaaggaacaaccagguguuggaggagaacauggacguggagaucuggacaaaagaaggagaaagaaagaaacuacgaccccguuggcuggaugccagaacauacucagacccacuggcccugcgcgaguuuaaagaguuugcagcaggaagaagaagcgucucaggagaucuaauauuagaaauagggaaacuuccacaacacuugacgcaaagggcccagaaugccuuggacaaccugguuauguuacacaacuccgaacaaggaggaagagccuauagacaugcaauggaagaauugccagacaccauagaaacguugaugcuccuagcuuugauagcuguguuaacugguggagugacgcuguucuuccuaucaggaaggggcuuagggaaaacaucuaucggccuacucugcgugauggcuucaagcguacugcuauggauggccaguguagagccccauuggauagcggccuccaucauacuggaguucuuccugauggugcugcuuauuccagagccagacagacaacgcacuccgcaggacaaccagcuggcauauguggugauagguuuguuauucaugauacugacaguaacagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagccauauugaugggacuugacaaaggauggccaauaucgaagauggacauaggaguuccacuucucgccuuggggugcuauucccaagugaauccacugacgcugacagcggcgguauugaugcuaguggcucauuacgcuauaauuggaccuggacugcaagcaaaagcuacuagagaagcucaaaaaaggacagcggccggaauaaugaaaaauccaaccguugauggaaucguugcaauagauuuggacccugugguuuaugaugcgaaauuugagaaacaacuaggccaaauaauguuguugauacuaugcacaucacagauccucuugaugcggacuacaugggccuugugcgaauccaucacacuggccacuggaccucugaccacgcucugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacaccuauaaaaggagugggauuauggaaguggacagauccgaagccaaagagggacugaaaagaggggaaacaaccaaacaugcagugucgagaggaaccgcuaaauugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaagaaccaaucccaauggcgaccuauggauggaaccuaguaaagcugcacuccgggaaagacguauucuuuauaccaccugagaaaugugacacccucuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacauaugaaagagacguggaccuaggcgcuggaacaagacauguggcaguggaaccagagguagccaaccuagauaucauuggccagaggauagagaacauaaaacaugaacacaagucaacauggcauuaugaugaggacaauccauauaaaacaugggccuaucauggaucauaugaggucaagccaucaggaucagccucauccauggucaaugguguggugaaacugcucaccaaaccaugggaugucauccccauggucacacaaauagccaugacugacacuacacccuuuggacaacagaggguguuuaaagagaaaguugacacacgcacaccaaaagcaaaacgcggcacaacacaaaucauggaggugacagccaggugguuaugggguuuucuuucuagaaacaagaagccaagaauuuguacaagagaggaguuuacaagaaaaguuaggucaaacgcagccaucggagcaguguucguugacgaaaaucaauggaacucagcaaaagaagcaguggaagaugagcgguucugggaccuugugcacagagagagggagcuucacaaacagggaaaaugugcuacguguguuuacaacaugauggggaagagagagaaaaagcuaggagaauuuggaaaggcaaaaggaagucgugcaauaugguacaugugguugggagcacgcuuucuagaguucgaagcucuugguuucaugaacgaagaccacugguucagcagagagaauucacucagcggaguggaaggagaaggacuccacaaacuuggauauauacucagagacauaucaaagauuccaggaggaaacauguaugcagaugacacagccggaugggauacaaggauaacagaggaugaccuucagaaugaggccaaaauuacugacaucauggaacccgaacaugcccuacuggcuaaggcaaucuucaagcuaaccuaccaaaauaaagugguuaggguacagagaccagcaaaaaauggaaccgugauggaugucauauccagacgagaccagagaggaaguggccaggucggaacuuauggcuugaacacuuucaccaacauggaagcccagcugauaagacaaauggagucugagggaaucuuuucacccagugaauuagagaccccaaauuuagccgagagaguucucgacuggcuggaaaaauauggcgucgaaaggcuaaaaagaauggcaaucaguggagaugacugcguagugaaaccaauugaugauagguuugcaacagccuuaacagcucugaaugauaugggaaaaguaagaaaagauauaccacaaugggaacccucaaaaggauggaaugauuggcaacaagugccuuuuuguucacaccacuuccaccagcugauuaugaaggaugggagggaaauaguggugccaugccgcaaccaagaugaacuuguggguagagcuagaguaucacaaggugcuggauggagccugagagaaaccgcaugccuaggcaaaucauaugcacaaauguggcagcugauguacuuccacaggagagaccugagacuagccgcuaaugcuaucuguucagccguuccaguugauugggucccaaccagccguaccaccuggucgauccaugcccaucaccaauggaugacaacagaagacaugcugucaguguggaauaggguuuggauagaggaaaacccauggauggaggacaaaacccauauauccaguugggaggauguuccauauuuagggaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6264 - RNA, 9879 nt, Artificial Sequence
  derived and/or modified CDS sequence (wt) from DENV-1__KC762648__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggcgucaacaugugcacccuuauagcgauggauuugggagaguuaugugaggacacacugacuuacaaaugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccuccgaaggcgcuuggaaacagauacaaagaguggagacuugggcccugagacacccaggauucacggugauagcccuuuuucuagcacaugccauaggaacauccaucacccagaaagggauuaucuucauuuuguuaaugcuggucacaccauccauggccaugcgaugcgugggaauaggcagcagggacuucguggaaggacugucaggagcaacuuggguagauguggugcuggaacauggaaguugcgucacuaccauggcaaaagacaaaccaacauuggacauugaacucuugaagacggaagucacaaacccugccguccugcgcaaacuaugcaucgaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuuauaacaugugcuaaguucaagugugugacaaaacuggaaggaaaaauaguucaguaugaaaacuugaaauauucaguaauagucaccguccacacuggagaucagcaucaggugggaaaugaaagcacagaacaugggacaacugcaacuauaacaccucaagcuccuacgacagaaauacaguugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagaaacuuggaacagacaagauuugcuggugacauuuaagacagcucaugcaaagaagcaggaaguagucguacuaggaucacaagaaggagcaaugcacacugcgcugaccggagcgacggaaauccaaacgucuggaacgacaacaauuuuugcaggacacuugaaauguagacuaaagauggacaaacugacucuaaaagggaugucauaugugaugugcacaggcucauucaagcuagagaaagaaguggcugagacccagcauggaaccguucuagugcagaucaaauacgaaggaacagaugcaccaugcaagauuccuuuuucgacccaagaugaaaaaggaguaacccagaaugggagauugauaacagccaaccccauagucacugauaaagaaaaaccagucaacaucgaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagaucuuuggaacugcauauggaguuuuguucagcgguguuuccuggaccaugaaaauaggaauagggguucugcugacauggcuaggauuaaacucaaggagcacgucccucucgaugacgugcauugcaguuggccuaguaacgcuauacuuaggagucaugguucaggcggauucaggauguguaauuaauuggaaagguagagaacucaaauguggaaguggcauuuuugucaccaaugaaguucacacuuggacagagcaauacaaauuucaagcugauuccccaaagagacuaucagcagccauugggaaggcaugggaggaggguguguguggaauucgaucagcaacucgucucgagaacaucauguggaagcaaauaucaaaugaauugaaccacaucuuacuugaaaaugacaugaaauucacagugguuguaggagaugucgcugggaucuuggcucaagggaaaaaaaugauuaggccacaacccauggaacacaaauacucguggaaaagcuggggaaaggcuaaaaucauaggggcagauguacagaacaccaccuuuaucaucgacggcccaaacaccccagaaugcccugaugaucaaagagcauggaacauuugggaaguugaggauuauggauuuggaauuuucacgacaaacauauggcugaaauugcgugacuccuacacccaggugugugaccaccggcuaaugucagcugccaucaaggacagcaaggcaguucacgcugacaugggguacuggauagaaagugaaaagaacgagaccuggaagcuggcaagagccucuuucauagaagucaaaacauguaucuggccaaaaucucacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacggucguuguggaugaacauuguggaaaucgaggaccaucucuuaggaccacaacagucacaggaaagauaauucaugaaugguguugcagaucuuguacgcuaccacccuuacgcuucagaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguagggcuacuauuccgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcauuaugcauggaagacaauggcuauggugcugucaauuguaucucucuuccccuuaugccuguccacgaccucccaaaaaacaacauggcuuccggugcuguugggaucucuuggauguaaaccacuaaccauguuucuuauagcagaaaacaaaaucuggggaaggaaaaguuggccccucaaugaaggaaucauggcuguuggaauugucagcauccuacuaagcucacuccucaaaaaugaugugccgcuagcugggccacuaauagcuggaggcaugcuaauagcauguuauguuauaucuggaagcucagccgaucuaucacuagagaaagcggcugaggucuccugggaagaagaagcagaacacucuggugccucacacaacauauuaguggagguccaagaugauggaaccaugaagauaaaggaugaggagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaaucaugcagagaggacuguugggcagaucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggcgaaguuggagccauugcccuagauuuuaaacccggcacaucuggaucucccaucgugaacagagaagggaaaauaguaggucuuuauggaaauggaguagugacaacaaguggaaccuacgucagugccauagcucaagcuaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaaguugcgcacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuauaacaugauuaucauggaugaagcacauuucaccgauccauccagcauagcggcuagaggguacaucucaacccgagugggcaugggugaagcagcugcgaucuucaugacagccacucccccaggaucaguggaggccuuuccacagagcaacgcaguuauccaagaugaggaaagagacauuccugagagaucauggaacucaggcuaugaguggaucacugacuucccaggcaaaacaguuugguuuguuccaagcauuaaaucaggaaaugauauugccaacugcuuaagaaagaaugggaaacgggugauucaauugagcagaaaaaccuuugacacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaguuggaaggaaccacaauaaggaaggugaucaguacaucuacaugggacagccuuuaaacaacgaugaagaucacgcucacuggacggaagcaaaaaugcuccuugauaauauaaacacaccagaagggauuaucccagcccucuucgagccggagagagaaaagagugcagcaauagacggggaauacagacugcggggugaagcaaggaaaacguuuguggagcucaugagaagaggagaucuaccugucuggcuauccuacaaaguugccucagaaggcuuccaguacucugauagaagauggugcuuugacggggaaaggaacaaccagguguuggaggagaacauggacguggagaucuggacaaaagaaggagaaagaaagaaacuacgaccccguuggcuggaugccagaacauacucagacccacuggcccugcgcgaguuuaaagaguuugcagcaggaagaagaagcgucucaggagaucuaauauuagaaauagggaaacuuccacaacacuugacgcaaagggcccagaaugccuuggacaaccugguuauguuacacaacuccgaacaaggaggaagagccuauagacaugcaauggaagaacugccagacaccauagaaacguugaugcuccuagcuuugauagcuguguuaacugguggagugacgcuguucuuccuaucaggaaggggcuuaggaaaaacaucuaucggccuacucugcgugauggcuucaagcgcacugcuauggauggccaguguagagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggaucggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagccauauugaugggacuugacaaaggauggccaauaucaaagauggacauaggaguuccacuucucgccuuggggugcuauucccaagugaauccacugacgcugacagcggcgguauugaugcuaguggcucauuacgcuauaauuggaccuggacugcaagcaaaagcuacuagagaagcucaaaaaaggacagcggccggaauaaugaaaaauccaaccguugauggaaucguugcaauagauuuggacccugugguuuaugaugcgaaauuugagaaacaacuaggccaaauaauguuguugauacuaugcacaucacagauccucuugaugcggacuacaugggccuugugcgaauccaucacacuggccacuggaccucugaccacgcucugggagggaucuccaggaaaguuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacaccuauaaaaggagugggauuauggaaguggacagauccgaagccaaagagggacugaaaagaggggaaacaaccaaacaugcagugucgagaggaaccgcuaaauugaggugguuuguggagaggaaccuugugaaaccagaagggaaagucauagaccucgguuguggaagagguggcuggucauacuauugcgcuggguugaagaaagucacagaagugaagggauauacaaaaggaggaccuggacaugaagaaccaaucccaauggcgaccuauggauggaaccuaguaaagcugcacuccgggaaagacguauucuuuauaccaccugagaaaugugacacccucuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcggaauccacuuucaagaaauucuacucaugaaauguauuggguuucauguggaacaggaaacauugugucagcaguaaacaugacauccagaauguugcuaaaucgauucacaauggcucacaggaaaccaacauaugaaagagacguggaccuaggcgcuggaacaagacauguggcaguggaaccagagguagccaaccuagauaucauuggccagaggauagagaacauaaaacaugaacacaagucaacauggcauuaugaugaggacaauccauauaaaacaugggccuaucauggaucauaugaggucaagccaucaggaucagccucauccauggucaaugguguggugaaacugcucaccaaaccaugggaugucauccccauggucacacaaauagccaugacugacacuacacccuuuggacaacagaggguguuuaaagagaaaguugacacacgcacaccaaaagcaaaacgaggcacaacacaaaucauggaggugacagccaggugguuaugggguuuucuuucuagaaacaagaagccaagaauuuguacaagagaggaguuuacaagaaaaguuaggucaaacgcagccaucggagcaguguucguugacgaaaaucaauggaacucagcaaaagaagcaguggaagaugagcgguucugggaccuugugcacagagagagggagcuucacaaacagggaaaaugugcuacguguguuuacaacaugauggggaagagagagaaaaagcuaggagaauuuggaaaggcaaaaggaagucgugcaauaugguacaugugguugggagcacgcuuucuagaguucgaagcucuugguuucaugaacgaagaccacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccaaaauuacugacaucauggaacccgaacaugcccuacuggcuaaggcaaucuucaagcuaaccuaccaaaauaaagugguaaggguacagagaccagcaaaaaauggaaccgugauggaugucauauccagacgugaccagagaggaaguggccaggucggaacuuauggcuuaaacaccuucaccaacauggaagcccagcuaauaagacaaauggagucugaggaaaucuuuucacccagugaauuagagaccccaaauuuagccgagagaguucucgacuggcuggaaaaauauggcgucgaaaggcuaaaaagaauggcaaucaguggagaugacugcguagugaaaccaauugaugauagguuugcaacagccuuaacagcucugaaugauaugggaaaaguaagaaaagauauaccacaaugggaacccucaaaaggauggaaugauuggcaacaagugccuuuuuguucacaccacuuccaccagcugauuaugaaggaugggagggaaauaguggugccaugccgcaaccaagaugaacuuguggguagagcuagaguaucacaaggugcuggauggagcuugagagaaaccgcaugccuaggcaaaucauaugcacaaauguggcagcugauguacuuccacaggagagaccugagacuagccgcuaaugcuaucuguucagccguuccaguugauugggucccaaccagccguaccaccuggucgauccaugcccaucaccaauggaugacaacagaagacaugcugucaguguggaauaggguuuggauagaggaaaacccauggauggaggacaaaacccauauauccaguugggaggauguuccauauuuagggaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6265 - RNA, 9879 nt, Artificial Sequence
  derived and/or modified CDS sequence (wt) from DENV-1__KC762622__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuaugugaggacacacugacuuacaaaugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauggcccuuuuucuagcacaugccauaggaacauccaucacccagaaagggauuaucuucauuuuguuaaugcuggucacaccauccauggccaugcgaugcgugggaauaggcagcagggacuucguggaaggacugucaggagcaacuuggguagauguggugcuggaacauggaaguugcgucacuaccauggcaaaagacaaaccaacauuggacauugaacucuugaagacggaagucacaaacccugccguccugcgcaaacuaugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuuauaacgugugcuaaguucaagugugugacaaaacuggaaggaaaaauaguucaguaugaaaacuugaaauauucaguaauagucaccguccacacuggagaccagcaucaggugggaaaugaaagcacagaacaugggacaacugcaacuauaacaccucaagcuccuacgacagaaauacaguugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagaaacuuggaacagacaagauuugcuggugacauuuaagacagcucaugcaaagaagcaggaaguagucguacuaggaucacaagaaggagcaaugcacacugcgcugaccggagcgacggaaauccaaacgucuggaacgacaacaauuuuugcaggacacuugaaauguagacuaaagauggacaaacugacucuaaaagggaugucauaugugaugugcacaggcucauucaagcuagagaaagaaguggcugagacccagcauggaaccguucuagugcagaucaaauacgaaggaacagaugcaccaugcaagauuccuuuuucgacccaagaugaaaaaggaguaacccagaaugggagauugauaacagccaaccccauagucacugauaaagaaaaaccagucaacauugaggcagaaccgccuuuuggugagaguuacaucgugauaggagcaggugaaaaagcuuugaaacuaagcugguucaagaaaggaagcagcauaggaaaaauguuugaggcaacugccagaggagcacgaaggauggccauacugggagacaccgcaugggacuuugguucuauaggaggaguguucacgucuguuggaaaauuaguacaccagaucuuuggaacugcauauggaguuuuguucagcgguguuuccuggaccaugaaaauaggaauagggguucugcugacauggcuaggauuaaacucaaggagcacgucccuuucgaugacgugcauugcaguuggucuaguaacacuauacuuaggagucaugguucaggcggauucaggauguguaauuaauuggaaagguagagaacucaaauguggaaguggcauuuuugucaccaaugaaguucacaccuggacagagcaauacaaauuucaagcugauuccccaaagagacuaucagcagccauugggaaggcaugggaggaggguguguguggaauucgaucagcaacucgucucgagaacaucauguggaagcaaauaucaaaugaauugaaccacaucuuacuugaaaaugacaugaaauucacagugguuguaggagauguugcugggaucuuggcucaaggaaaaaagaugauuaggccacaacccauggaacacaaauacucguggaaaagcuggggaaaggcuaaaaucauaggggcagauguacagaacaccaccuuuaucaucgacggcccaaacaccccagaaugcccugaugaucaaagagcauggaacauuugggaaguugaggauuauggauuuggaauuuucacgacaaacauauggcugaaauugcgugacuccuacacccaggugugugaccaccggcuaaugucagcugccaucaaggacagcaaggcaguucacgcugacaugggguacuggauagaaagugaaaagaacgagaccuggaagcuggcaagagccucuuucauagaagucaaaacauguaucuggccaaaaucucacacucuauggagcaauggaguucuggaaagugaaaugauaauuccaaagaucuauggaggaccaacaucucagcacaacuacagaccaggauauuucacacaaacggcagggccguggcaccuaggcaaguuggaacuggauuuugauuugugugaggguaccacggucguuguggaugaacauuguggaaaucgaggaccaucucuuaggaccacaacagucacaggaaaaauaauucaugaaugguguugcagaucuuguacgcuaccacccuuacguuucagaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaaugcuuccgacaggauggggaugggaacgacguaccuagcucugauggccacuuuuaaaaugagaccaauguuugcuguagggcuacuauuccgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcauuaugcauggaagacaauggcuaugguacugucaauuguaucccucuuccccuuaugccuguccacgaccucccaaaaaacaacauggcuuccggugcuguugggaucucuuggauguaaaccacuaaccauguuucuuauagcagaaaacaaaaucuggggaaggaaaaguuggccccucaaugaaggaaucauggcuguuggaauugucagcauccuacuaagcucacuccucaaaaaugaugugccgcuagcugggccacuaauagcuggaggcaugcuaauagcauguuauguuauaucuggaagcucagccgaucuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucaggaguguacccauuaucaauaccagcgacccuuuuugugugguacuuuuggcagaaaaagaaacagagaucuggaguguuaugggacacacccagcccuccagaaguggaaagagcaguucuugaugaugguaucuauagaaucaugcagagaggacuguugggcagaucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggcgaaguuggagccauugcccuagauuuuaaacccggcacaucuggaucucccaucgugaacagagaggggaaaauaguaggucuuuauggaaauggaguagugacaacaaguggaaccuacgucagugccauagcucaagcuaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaaguugcgcacacuaauucuggcucccacaaggguugucgcuuccgaaauggcagaggcgcuuaagggaaugccaauaagguaccaaacaacagcagugaagagugaacacacaggaaaagagauaguugaccucaugugucacgccacuuucaccaugcgccuccugucucccgugagaguucccaauuauaacaugauuaucauggaugaagcacauuucaccgauccauccagcauagcggcuagaggguacaucucaacccgagugggcaugggugaagcagcugcgaucuucaugacagccacucccccaggaucaguggaggccuuuccacagagcaacgcaguuauccaagaugaggaaagagacauuccugagagaucauggaacucaggcuaugaguggaucacugacuucccaggcaaaacaguuugguuuguuccaagcauuaaaucaggaaaugauauugccaacugcuuaagaaagaaugggaaacgggugauucaauugagcagaaaaaccuuugacacagaguaccaaaaaacaaaaaauaacgacugggacuacguugucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaguuggaaggaaccacaauaaggaaggugaucaguacaucuacaugggacagccuuuaaacaacgaugaagaucacgcucacuggacggaagcaaaaaugcuccuugauaauauaaacacaccagaagggauuaucccagcccucuucgagccggagagagaaaagagugcagcaauagacggggaauacagacugcggggugaagcaaggaaaacguuuguggagcucaugagaagaggagaucuaccugucuggcuauccuacaaaguugccucagaaggcuuccaguacucugauagaagauggugcuuugacggggaaaggaacaaccagguguuggaggagaacauggacguggagaucuggacaaaagaaggagaaagaaagaaacuacgaccccguuggcuggaugccagaacauacucagacccacuggcccugcgcgaguuuaaagaguuugcagcaggaagaagaagcgucucaggagaucuaauauuagaaauagggaaacuuccacaacacuugacgcaaagggcccagaaugccuuggacaaccugguuauguuacacaacuccgaacaaggaggaagagccuauagacaugcaauggaagaacugccagacaccauagaaacuuugaugcucuuagcuuugauagcugugcuaacugguggagugacgcuguucuuccuaucaggaaggggcuuagggaaaacaucuaucggccuacucugcgugauggcuucaagcguacugcuauggauggccaguguagagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagccauauugaugggacuugauaaaggauggccaauaucgaagauggacauaggaguuccacuucucgccuuggggugcuauucccaagugaauccacugacgcugacagcggcgguguugaugcuaguggcucauuacgcuauaauuggaccuggacugcaagcaaaagcuacuagagaagcucaaaaaaggacagcggccggaauaaugaaaaauccaaccguugauggaaucguugcaauagauuuggacccugugguuuaugaugcgaaauuugagaaacaacuaggccagauaauguuguugauacuaugcacaucacagauccucuugaugcggacuacaugggccuugugcgaauccaucacacuggccacuggaccucugaccacgcucugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacaggagcccaaggggaaacacugggagagaaauggaaaagacagcugaaccaacugagcaagucagaauucaacaccuauaaaaggagcgggauuauggaaguggacagauccgaagccaaagagggacugaaaagaggggaaacaaccaaacaugcagugucgagaggaaccgcuaaauugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaagaaccaaucccaauggcgaccuauggauggaaccuaguaaagcugcacuccgggaaagacguauucuuuauaccaccugagaaaugugacacccucuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacauaugaaagagacguggaccuaggcgcuggaacaagacauguggcaguggaaccagagguagccaaccuagauaucauuggccagaggauagagaacauaaaacaugaacacaagucaacauggcauuaugaugaggacaauccauauaaaacaugggccuaucauggaucauaugagguuaagccaucaggaucagccucauccauggucaaugguguggugaaacugcucaccaaaccaugggaugucauccccauggucacacaaauagccaugacugacacuacacccuuuggacaacagaggguguuuaaagagaaaguugacacacgcacaccaaaagcaaaacgaggcacaacacaaaucauggaggugacagccaggugguugugggguuuucuuucuagaaacaagaagccaagaauuuguacaagagaggaguuuauaagaaaaguuaggucaaacgcagccaucggagcaguguucguugacgaaaaucaauggaacucagcaaaagaagcaguggaagaugagcgguucugggaccuugugcacagagagagggagcuucacaaacagggaaaaugugcuacguguguuuacaacaugauggggaagagagagaaaaagcuaggagaauuuggaaaggcaaaaggaagucgugcaauaugguacaugugguugggagcacgcuuucuagaguucgaagcucuugguuucaugaacgaagaccacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccaaaauuacugacaucauggaacccgaacaugcccuacuggcuaaggcaaucuucaagcuaaccuaccaaaauaaagugguaaggguacagagaccagcaaaaaauggaaccgugauggaugucauauccagacgugaccagagaggaaguggccaggucggaacuuauggcuuaaacacuuucaccaacauggaagcccagcugauaagacaaauggagucugagggaaucuuuucacccagugaauuagagaccccaaauuuagccgagagaguucucgacuggcuggaaaaauauggcgucgaaaggcuaaaaagaauggcaaucaguggagaugacugcguagugaaaccaauugaugauagguuugcaacagccuuaacagcucugaaugauaugggaaaaguaagaaaagauauaccacaaugggaacccucaaaaggauggaaugauuggcaacaagugccuuuuuguucacaccacuuccaccagcugauuaugaaggaugggagggaaauaguggugccaugccgcaaccaagaugaacuuguggguagagcuagaguaucacaaggugcuggauggagccugagagaaaccgcaugccuaggcaaaucauaugcacaaauguggcagcugauguacuuccacaggagagaccugagacuagccgcuaaugcuaucuguucagccguuccaguugauugggucccaaccagccguaccaccuggucgauccaugcccaucaccaauggaugacaacagaagacaugcugucaguguggaauaggguuuggauagaggaaaacccauggauggaggacaaggcccauguauccaguugggaggauguuccauauuuagggaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6266 - RNA, 9879 nt, Artificial Sequence
  derived and/or modified CDS sequence (wt) from DENV-1__KC762629__SS-prME
ucugugaccaugcuccuuaugcugaugccuacagccuuggcguuccauuugacuacacgagggggagagccgcacaugguagucagcaagcaggaaagaggaaagucacuuuuguuuaagaccucagcaggugucaacaugugcacccuuauagcgauggauuugggagaguuaugugaggacacacugacuuacaaaugcccucgaaucacugaggcggaaccagaugacguugauugcuggugcaaugccacagacacaugggugaccuauggaacaugcucccaaacuggcgagcaccgacgagacaaacguuccgucgcacuggccccacacgugggacuugguuuggaaacaagaaccgaaacguggauguccuccgaaggcgcuuggagacagauacaaagaguggagacuugggcccugagacacccaggauucacggugauagcccuuuuucuagcacaugccauaggaacauccaucacccagaaagggauuaucuucauuuuguuaaugcuggucacaccauccauggccaugcgaugcgugggaauaggcagcagggacuucguggaaggacugucaggagcaacuuggguagauguggugcuggaacauggaaguugugucacuaccauggcaaaagacaaaccaacauuggacauugaacucuugaagacggaagucacaaacccugccguccugcgcaaacuaugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuuauaacgugugcuaaguucaagugugugacaaaacuggaaggaaaaauaguucaguaugaaaacuugaaauauucaguaauagucaccguccacacuggagaccagcaucaggugggaaaugaaagcacagaacaugggacaacugcaacuauaacaccucaagcucccacgacagaaauacaguugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagaaacuuggaacagacaagauuugcuggugacauuuaagacagcucaugcaaagaagcaggaaguagucguacuaggaucacaagaaggagcaaugcacacugcgcugaccggagcgacggaaauccaaacgucuggaacgacaacaauuuuugcaggacacuugaaauguagacuaaagauggacaaacugacucuaaaagggaugucauaugugaugugcacaggcucauucaagcuagagaaagaaguggcugagacccagcauggaaccguucuagugcagaucaaauacgaaggaacagaugcaccaugcaagauuccuuuuucgacccaagaugaaaaaggaguaacccaaaaugggagauugauaacagccaaccccauagucacugauaaagaaaaaccagucaacauugaggcagaaccgccuuuuggugagaguuacaucgugauaggagcaggugaaaaaacucugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagaucuuuggaacugcauauggaguuuuguucagcgguguuuccuggaccaugaaaauaggaauagggguucugcugacauggcuaggauuaaacucaaggagcacgucccuuucgaugacgugcauugcaguuggccuaguaacgcuauacuuaggagucaugguucaggcggauucaggauguguaauuaauuggaaagguagagaacucaaauguggaaguggcauuuuugucaccaaugaaguucacacuuggacagagcaauacaaauuucaagcugauuccccaaagagacuaucagcagccauugggaaggcaugggaggaggguguguguggaauucgaucagcaacucgucucgaaaacaucauguggaagcaaauaucaaaugaauugaaccacaucuuacuugaaaaugacaugaaauucacagugguuguaggagauguugcugggaucuuggcucaaggaaaaaaaaugauuaggccacaacccauggaacacaaauacucguggaaaagcuggggaaaggcuaaaaucauaggggcagauguacagaacaccaccuuuaucaucgacggcccaaacaccccagaaugcccugaugaucaaagagcauggaacauuugggaaguugaggauuauggauuuggaauuuucacgacaaacauauggcugaaauugcgugacuccuacacccaggugugugaccaccggcuaaugucagcugccaucaaggacagcaaggcaguucacgcugacaugggguacuggauagaaagugaaaagaacgagaccuggaagcuggcaagagccucuuucauagaagucaaaacauguaucuggccaaaaucucacacucuauggagcaauggaguucuggaaagugaaaugauaauuccaaagaucuauggaggaccaauaucucagcacaacuacagaccaggauauuucacacaaacggcagggccguggcaccugggcaaguuggaacuggauuuuaauuugugugaggguaccacggucguuguggaugaacauuguggaaaucgaggaccaucucuuaggaccacaacaguaacaggaaagauaauucaugaaugguguugcagaucuuguacgcuaccacccuuacguuuuagaggagaagaugggugcugguacgguauggaaaucagaccagucaaggaaaaggaagagaaucuagucaaaucaauggucucugcagggucaggggaaguggacaguuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguagggcuacuauuccgcagacuaacauccagagaaguucuucuucuaacaauuggauugagucuaguggcaucuguagaguuaccaaauuccuuggaggagcugggggauggacuugcaaugggcauuaugauuuuaaaacuauugacugacuuucaaucacaucagcugugggcuaccuugcuguccuugacauuuaucaaaacaacguuuuccuugcacuaugcauggaagacaauggcuaugguacugucaauuguaucucucuuccccuuaugccuguccacgaccucccaaaaaacaacauggcuuccggugcuguugggaucucuuggaugcaaaccacuaaccauguuucuuauagcagaaaacaaaaucuggggaaggaaaaguuggccccucaaugaaggaaucauggcuguuggaauugucagcauccuacuaagcucacuccucaaaaaugaugugccgcuagcugggccacuaauagcuggaggcaugcuaauagcauguuauguuauaucuggaagcucagcagaucuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaaucaugcagagaggacuguugggcagaucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacaggagaagaagugcaggugauugcugucgaaccagggaaaaaccccaaaaauguacaaacagcgccgggcaccuuuaagaccccugaaggcgaaguuggagccauugcccuagauuuuaaacccggcacaucuggaucucccaucgugaacagagaagggaaaauaguaggccuuuauggaaauggaguagugacaacaaguggaaccuacgucagugcuauagcucaagcuaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccgugagaguucccaauuacaacaugauuaucauggaugaagcacauuucaccgauccauccagcauagcggcuagaggguacaucucaacccgagugggcaugggugaagcagcugcgaucuucaugacagccacucccccaggaucaguggaggccuuuccacagagcaacgcaguuauccaagaugaggaaagagacauuccugagagaucauggaacucaggcuaugaguggaucacugacuucccaggcaaaacagucugguuuguuccaagcauuaaaucaggaaaugauauugccaacugcuuaagaaagaaugggaaacgggugauccaauugagcagaaaaaccuuugauacagaguaccaaaaaacaaaaaauaacgacugggacuacgucgucacaacagauaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaguuggaaggaaccacaauaaggaaggugaucaguacaucuacaugggacagccuuuaaacaacgaugaagaucacgcucacuggacggaagcaaaaaugcuccuugauaauauaaacacaccagaagggauuaucccagcccucuucgagccggagagagagaagagugcagcaauagacggggaauacagacugcggggugaagcaaggaaaacguuuguggagcucaugagaagaggagaucuaccugucuggcuauccuacaaaguugccucagaaggcuuccaguacucugauagaagauggugcuuugacggggaaaggaacaaccagguguuggaggagaacauggacguggagaucuggacaaaagaaggggaaagaaagaaacuacgaccccguuggcuggaugccagaacauacucagacccacuggcccugcgcgaguuuaaagaguuugcagcaggaagaagaagcgucucaggagaucuaauauuagaaauaggaaaacuuccacaacacuugacgcaaagggcccagaaugccuuggacaaccugguuauguuacacaacuccgaacaaggaggaagagccuauagacaugcaauggaagaacugccagacaccauagaaacguugaugcuccuagcuuugauagcuguguuaacugguggagugacgcuguucuuccuaucaggaaggggcuuagggaaaacaucuaucggccuacucugcgugauggcuucaagcguacugcuauggauggccaguguagagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacuguuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccaucgcaaaccaggcagccauauugaugggacuugacaaaggauggccaauaucgaagauggacauaggaguuccacuucucgccuuggggugcuauucccaagugaauccacugacgcugacagcggcgguauugaugcuaguggcucauuacgcuauaauuggaccuggacugcaagcaaaagcuacuagagaagcucaaaaaaggacagcggccggaauaaugaaaaauccaaccguugauggaaucguugcaauagauuuggacccugugguuuaugaugcgaaauuugagaaacaacuaggccaaauaauguuguugauacuaugcacaucacagauccucuugaugcggacuacaugggccuugugcgaauccaucacacuggccacuggaccucugaccacgcucugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacaccuauaaaaggagugggauuauggaaguggacagauccgaagccaaagagggacugaaaagaggggaaacaaccaaacaugcagugucgagaggaaccgcuaaauugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaagaaccaaucccaauggcgaccuauggauggaaccuaguaaagcugcacuccgggaaagacguauucuuuauaccaccugagaaaugugacacccucuugugugauauuggugaguccucuccaaacccaacuauagaggaaggaagaacacuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacauaugaaagagacguggaccuaggcgcuggaacaagacauguggcaguggaaccagagguagccaaccuagauaucaucggccagaggauagagaacauaaaacaugaacacaagucaacauggcauuaugaugaggacaauccauauaaaacaugggccuaucauggaucauaugaggucaagccaucaggaucagccucauccauggucaaugguguggugaaacugcucaccaaaccaugggaugucauccccauggucacacaaauagccaugacugacacuacacccuuuggacaacagaggguguuuaaagagaaaguugacacacgcacaccaaaagcaaaacgaggcacaacacaaaucauggaggugacagccaggugguuaugggguuuucuuucuagaaacaagaagccaagaauuuguacaagagaggaguuuacaagaaaaguuaggucaaacgcagccaucggagcaguguucguugacgaaaaucaauggaacucagcaaaagaagcaguggaagaugagcgguucugggaccuugugcacagagagagggagcuucacaaacagggaaaaugugcuacguguguuuacaacaugauggggaagagagagaaaaagcuaggagaauuuggaaaggcaaaaggaagucgugcaauaugguacaugugguugggagcacgcuuucuagaguucgaagcucuugguuucaugaacgaagaccacugguucagcagagggaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccaaaauuacugacaucauggaacccgaacaugcccuacuggcuaaggcaaucuucaagcuaaccuaccaaaauaaagugguaaggguacagagaccagcaaaaaauggaaccgugauggaugucauauccagacgugaccagagaggaaguggccaggucggaacuuauggcuuaaacacuuucaccaacauggaagcccagcugauaagacaaauggagucugagggaaucuuuucacccagugaauuagagaccccaaauuuagccgagagaguucucgacuggcuggaaaaauauggcgucgaaaggcuaaaaagaauggcaaucaguggagaugacugcguagugaaaccaauugaugauagguuugcaacagccuuaacagcucugaaugauaugggaaaaguaagaaaagauauaccacaaugggaacccucaaaaggauggaaugauuggcaacaagugccuuuuuguucacaccacuuccaccagcugauuaugaaggaugggagggaaauaguggugccaugccgcaaccaagaugaacuuguggguagagcuagaguaucacaaggugcuggauggagccugagagaaaccgcaugccuaggcaaaucauaugcacaaauguggcagcugauguacuuccacaggagagaccugagacuagccgcuaaugcuaucuguucagccguuccaguugauugggucccaaccagccguaccaccuggucgauccaugcccaucaccaauggaugacaacagaagacaugcugucaguguggaauaggguuuggauagaggaaaacccauggauggaggacaaaacccauauauccaguugggaagauguuccauauuuagggaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6267 - RNA, 9879 nt, Artificial Sequence
  derived and/or modified CDS sequence (wt) from DENV-1__KC762627__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuaugugaggacacacugacuuacaaaugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccuccgaaggcgcuuggaaacagauacaaagaguggagacuugggcccugagacacccaggauucacggugauagcccuuuuucuagcacaugccauaggaacauccaucacccagaaagggauuaucuucauuuuguuaaugcuggucacaccauccauggccaugcgaugcgugggaauaggcagcagggacuucguggaaggacugucaggagcaacuuggguagauguggugcuggaacauggaaguugugucacuaccauggcaaaagacaaaccaacauuggacauugaacucuugaagacggaagucacaaacccugccguccugcgcaaacuaugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuuauaacgugugcuaaguucaagugugugacaaaacuggaaggaaaaauaguucaguaugaaaacuugaaauauucaguaauagucaccguccacacuggagaccagcaucaggugggaaaugaaagcacagaacaugggacaacugcaacuauaacaccucaagcuccuacgacagaaauacaguugaccgacuacggagcucuuacauuggauuguucaccuagaacaggacuagacuucaaugaaaugguguuguugacaaugaaagaaaaaucauggcuaguccacaaacaaugguuucuagaccuaccauugccuuggaccucgggagcuucaacaucacaagaaacuuggaacagacaagauuugcuggugacauuuaagacagcucaugcaaagaagcaggaaguagucguacuaggaucacaagaaggagcaaugcacacugcgcugaccggagcgacggaaauccaaacguccggaacgacaacaaucuuugcaggacacuugaaauguagacuaaagauggacaaacugacccuaaaagggaugucauaugugaugugcacaggcucauucaagcuagagaaagaaguggcugagacccagcacggaaccguucuagugcagaucaaauacgaaggaacagaugcaccaugcaagauuccuuuuucgacccaagaugaaaaaggaguaacccagaaugggagauugauaacagccaaccccauagucacugauaaagaaaaaccagucaacauugaggcagaaccgccuuuuggugagaguuacaucgugauaggagcaggugaaaaagcucugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaauacaccagaucuuuggaacugcauauggaguuuuguucagcgguguuuccuggaccaugaaaauaggaauagggguucugcugacauggcuaggauuaaacucaaggagcacgucccuuucgaugacgugcauugcaguuggccuaguaacgcuauacuuaggagucaugguucaggcggauucaggauguguaauuaauuggaaagguagagaacucaaguguggaaguggcauuuuugucaccaaugaaguucacacuuggacagagcaauacaaauuucaagcugauuccccaaagagacuaucagcagccauugggaaggcaugggaggaggguguguguggaauucgaucagcaacucgucucgagaacaucauguggaagcaaauaucaaaugaauugaaccacaucuuacuugaaaaugacaugaaauucacagugguuguaggagauguugcugggaucuuggcucaaggaaaaaaaaugauuaggccacaacccauggaacacaaauacucguggaaaagcuggggaaaggcuaaaaucauaggggcagauguacagaacaccaccuuuaucaucgacggcccaaacaccccagaaugcccugaugaucaaagagcauggaacauuugggaaguugaggauuauggauuuggaauuuucacgacaaacauauggcugaaauugcgugacuccuacacccaggugugugaccaccggcuaaugucagcugccaucaaggacagcaaggcaguucacgcugacaugggguacuggauagaaagugaaaagaacgagaccuggaagcuggcaagagccucuuucauagaagucaaaacauguaucuggccaaaaucucacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacggucguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccagucaaggaaaaggaagagaaucuagucaaaucaauggucucugcagggucaggggaaguggacagcuuuucacuaggacugcuaugcauaucaaugaugaucgaagaggugaugagauccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguagggcuacuauuccgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcugucccugacauuuaucaaaacaacguuuuccuugcacuaugcauggaagacaauggcuaugguacugucaauuguaucucucuuccccuuaugccuguccacgaccucccaaaaaacaacauggcuuccggugcuguugggaucucuuggauguaaaccacuaaccauguuucuuauagcagaaaacaaaaucuggggaaggaaaaguuggccccucaaugaaggaaucauggcuguuggaauugucagcauccuacuaagcucacuccucaaaaaugaugugccgcuagcugggccacuaauagcuggaggcaugcuaauagcauguuauguuauaucuggaagcucagccgaccuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaaucaugcagagaggacuguugggcagaucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggcgaaguuggagccauugcccuagauuuuaaacccggcacaucuggaucucccaucgugaacagagaagggaaaauaguaggucuuuauggaaauggaguagugacaacaaguggaaccuacgucagugccauagcucaagcuaaagcaucacaagaagggccccuaccagagauugaagacgagguguuuaggaaaagaaacuuaacaauaauggaccuacauccaggaucggggaaaacaagaagauaccuuccagccauaguccgugaagccauaaaaaggaagcugcgcacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccagcauagcggcuagaggguacaucucaacccgagugggcaugggugaagcagcugcgauuuucaugacagccacucccccaggaucaguggaggccuuuccacagagcaacgcaguuauccaagaugaggaaagagacauuccugagagaucauggaacucaggcuaugaguggaucacugacuucccaggcaaaacaguuugguuuguuccaagcauuaaaucaggaaaugauauugccaacugcuuaagaaagaaugggaaacgggugauucaauugagcagaaaaaccuuugacacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaguuggaaggaaccacaauaaggaaggugaucaguacaucuacaugggacagccuuuaaacaacgaugaagaucacgcccacuggacggaagcaaaaaugcuccuugauaauauaaacacaccagaagggauuaucccagcccucuucgagccggagagagaaaaaagugcagcaauagacggggaauacagacugcggggugaagcaaggaaaacguuuguggagcucaugagaagaggagaucuaccugucuggcuauccuacaaaguugccucagaaggcuuccaguacucugauagaagauggugcuuugacggggaaaggaacaaccagguguuggaggagaacauggacguggagaucuggacaaaagaaggggaaagaaagaaacuacgaccccguuggcuggaugccagaacauacucagacccacuggcccugcgcgaguuuaaagaguuugcagcaggaagaagaagcgucucaggagaucuaauauuagaaauagggaaacuuccacaacacuugacgcaaagggcccagaaugccuuggacaaccugguuauguuacacaacuccgaacaaggaggaagagccuauagacaugcaauggaagaacugccagacaccauagaaacguugaugcuccuagcuuugauagcuguguuaacugguggagugacgcuguucuuccuaucaggaaggggcuuagggaaaacaucuaucggccuacucugcgugauggcuucaagcguacugcuauggauggccaguguagagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacuguuggaaaccacaaagaaagacuuagggauuggucauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccaucgcaaaccaggcagccauauugaugggacuugacaaaggauggccaauaucgaagauggacauaggaguuccacuucucgccuuggggugcuauucccaagugaauccacugacgcugacagcggcgguauugaugcuaguggcucauuacgcuauaauuggaccuggacugcaagcaaaagcuacuagagaagcucaaaaaaggacagcggccggaauaaugaaaaauccaaccguugauggaaucguugcaauagauuuggacccugugguuuaugaugcgaaauuugagaaacaacuaggccaaauaauguuguugauacuaugcacaucacagauccucuugaugcggacuacaugggccuugugcgaauccaucacacuggccacuggaccucugaccacgcucugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacaccuauaaaaggagugggaucauggaaguggacagauccgaagccaaagagggacugaaaagaggggaaacaaccaaacaugcagugucgagaggaaccgcuaaauugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaagaaccaaucccaauggcaaccuauggauggaaccuaguaaagcugcacuccgggaaagacguauucuuuauaccaccugagaaaugugacacccucuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacauaugaaagagacguggaccuaggcgcuggaacaagacauguggcaguggaaccagagguagccaaccuagauaucauuggccagaggauagagaacauaaaacaugaacacaagucaacauggcauuaugaugaggacaauccauauaaaacaugggccuaucauggaucauaugaggucaagccaucaggaucagccucauccauggucaaugguguggugaaacugcucaccaaaccaugggaugucauccccauggucacacaaauagccaugacugacacuacacccuuuggacaacagaggguguuuaaagagaaaguugacacacgcacaccaaaagcaaaacgagguacaacacaaaucauggaggugacagccaggugguuauggaguuuucuuucuagaaacaagaagccaagaauuugcacaagagaggaguuuacaagaaaaguuaggucaaacgcagccaucggagcaguguucguugacgaaaaucaauggaacucagcaaaagaagcaguggaagaugagcgguucugggaccuugugcacagagagagggagcuucacaaacagggaaaaugugcuacguguguuuacaacaugauggggaagagagagaaaaagcuaggagaauuuggaaaggcaaaaggaagucgugcaauaugguacaugugguugggagcacgcuuucuagaguucgaagcucuugguuucaugaacgaagaccacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccaaaauuacugacaucauggaacccgaacaugcccuacuggcuaaggcaaucuucaagcuaaccuaccaaaauaaagugguaaggguacagagaccagcaaaaaauggaaccgugauggaugucauauccagacgugaccagagaggaaguggccaggucggaacuuauggcuuaaacacuuucaccaacauggaagcccagcugauaagacaaauggagucugagggaaucuuuucacccagcgaauuagagaccucaaacuuagccgagagaguucucgacuggcuggaaaaauauggcgucgaaaggcuaaaaagaauggcaaucaguggagaugacugcguagugaaaccaauugaugauagguuugcaacagccuuaacagcucugaaugauaugggaaaaguaagaaaagauauaccacaaugggaacccucaaaaggauggaaugauuggcaacaagugccuuuuuguucacaccacuuccaccagcugauuaugaaggaugggagggaaauaguggugccaugccgcaaccaagaugaacuuguggguagagcuagaguaucacaaggugcuggauggagccugagagaaaccgcaugccuaggcaaaucauaugcacaaauguggcagcugauguacuuccacaggagagaccugagacuagccgcuaaugcuaucuguucagccguuccaguugauugggucccaaccagccguaccaccuggucgauccaugcccaucaccaauggaugacaacagaagacaugcugucaguguggaauaggguuuggauagaggaaaacccauggauggaggacaaaacccauauauccaguugggaagauguuccauauuuagggaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6268 - RNA, 9879 nt, Artificial Sequence
  derived and/or modified CDS sequence (wt) from DENV-1__KC762647__SS-prME
ucugugaccaugcuccuuaugcugacgccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuaugugaggacacacugacuuacaaaugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccuccgaaggcgcuuggaaacagauacaaagaguggagacuugggcccugagacacccaggauucacggugauagcccuuuuucuagcacaugccauaggaacauccaucacccagaaagggauuaucuucauuuuguuaaugcuggucacaccauccauggccaugcgaugcgugggaauaggcagcagggacuucguggaaggacugucaggagcaacuuggguagauguggugcuggaacauggaaguugcgucacuaccauggcaaaagacaaaccaacauuggacauugaacucuugaagacggaagucacaaacccugccguccugcgcaaacuaugcauugaagcuaaaauaucaaacacuaccaccgacucaagauguccaacacaaggagaagccacacugguggaagaacaagacgcgaacuuugugugucgacgaacguuuguggacagaggcuggggcaauggcugugggcucuucggaaaaggaagccuuauaacgugugcuaaguucaagugugugacaaaacuggaaggaaaaauaguucaguaugaaaacuugaaauauucaguaauagucaccguccacacuggagaccagcaucaggugggaaaugaaagcacagaacaugggacaacugcaacuauaacaccucaagcuccuacgacagaaauacaguugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagaaacuuggaacagacaagauuugcuggugacauuuaagacagcucaugcaaagaagcaggaaguagucguacuaggaucacaagaaggagcaaugcacacugcgcugaccggagcgacggaaauccaaacgucuggaacgacaacaauuuuugcaggacacuuaaaauguagacuaaagauggacaaacugacucuaaaagggaugucauaugugaugugcacaggcucauucaagcuagagaaagaaguggcugagacccagcauggaaccguucuagugcagaucaaauacgaaggaacagaugcaccaugcaagauuccuuuuucgacccaagaugaaaaaggaguaacccagaaugggagauugauaacagccaaccccauagucacugauaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucucuuucgaugacgugcauugcaguuggccuaguaacgcuauacuuaggagucaugguucaggcggauucaggauguguaauuaauuggaaagguagagaacucaaauguggaaguggcauuuuugucaccaaugaaguucacacuuggacagagcaauacaaauuucaagcugauuccccaaagagacuaucagcagccauugggaaggcaugggaggaggguguguguggaauucgaucagcaacucgucucgagaacaucauguggaagcaaauaucaaaugaauugaaccacaucuuacuugaaaaugacaugaaauucacagugguuguaggagauguugcugggaucuuggcucaagggaaaaaaaugauuaggccacaacccauggaacacaaauacucguggaaaagcuggggaaaggcuaaaaucauaggggcagauguacagaacaccaccuuuaucaucgacggcccaaacaccccagaaugcccugaugaucaaagagcauggaacauuugggaaguugaggauuauggauuuggaauuuucacgacaaacauauggcugaaauugcgugacuccuacacccaggugugugaccaccggcuaaugucagcugccaucaaggacagcagggcaguucacgcugacaugggguacuggauagaaagugaaaagaacgagaccuggaagcuggcaagagccucuuucauagaagucaaaacaugugucuggccaaaaucucacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacggucguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguucgcuguagggcuacuauuccgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcauuaugcauggaagacaauggcuaugguacugucaauuguaucucucuuccccuuaugccuguccacgaccucccaaaaaacaacauggcuuccggugcuguugggaucucuuggauguaaaccacuaaccauguuucuuauagcagaaaacaaaaucuggggaaggaaaaguuggccccucaaugaaggaaucauggcuguuggaauugucagcauccuacuaagcucacuccucaaaaaugaugugccgcuagcugggccacuaauagcuggaggcaugcuaauagcauguuauguuauaucuggaagcucagccgaucuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagauccggaguguuaugggacacaccuagcccuccagaaguggaaagagcaguucuugaugaugguaucuauagaaucaugcagagaggacuguugggcagaucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggcgaaguuggagccauugcccuagauuuuaaacccggcacaucuggaucucccaucgugaacagagaagggaaaauaguaggucuuuauggaaauggaguagugacaacaaguggaaccuacgucagugccauagcucaagcuaaagcaucacaagaagggccccuaccagagauugaagacgaaguguuuaggaaaagaaacuuaacaauaauggaucuacauccaggaucggggaaaacaagaagauaccuuccagccauaguccgugaggccauaaaaaggaagcugcgcacacuaauucuggcccccacaaggguugucgcuuccgaaauggcagaggcgcucaaaggaaugccaauaagguaucaaacaacagcagugaagagugaacacacaggaaaagagauaguugaccucaugugucacgccacuuucaccaugcgccuccugucucccgugagaguucccaauuauaacaugauuaucauggaugaagcacauuucaccgauccauccagcauagcggcuagaggguacaucucaacccgagugggcaugggugaagcagcugcgaucuucaugacagccacucccccaggaucaguggaggccuuuccacagagcaacgcaguuauccaagaugaggaaagagacauuccugagagaucauggaacucaggcuaugaguggaucacugacuucccaggcaaaacaguuugguuuguuccaagcauuaaaucaggaaaugauauugccaacugcuuaagaaagaaugggaaacgggugauucaauugagcagaaaaaccuuugacacagaguaccaaaaaacaaaaaauaacgacugggacuacgucgucacaacagacaucuccgaaaugggagcaaauuuccgggccgauagggugauagacccaagacggugucugaaaccgguaauacuaaaagaugguccagagcgugucauuuuagcaggaccgaugccagugacuguggccagugccgcccagaggagaggaagaguuggaaggaaccacaauaaggaaggugaucaguacaucuacaugggacagccuuuaaacaacgaugaagaucacgcucacuggacggaagcaaaaaugcuccuugauaauauaaacacaccagaagggauuaucccagcccucuucgagccggagagagaaaagagugcagcaauagacggggaauacagacugcggggugaagcaaggaaaacguuuguggagcucaugagaagaggagaucuaccugucuggcuauccuacaaaguugccucagaaggcuuccaguacucugauagaagauggugcuuugacggggaaaggaacaaccagguguuggaggagaacauggacguggagaucuggacaaaagaaggagagagaaagaaacuacgaccccguuggcuggaugccagaacauacucagacccacuggcccugcgcgaguuuaaagaguuugcagcaggaagaagaagcgucucaggagaucuaauauuagaaauagggaaacuuccacaacacuugacgcaaaaggcccagaaugccuuggacaaccugguuauguuacacaacuccgaacaaggaggaagagccuauagacaugcaauggaagaauugccagacaccauagaaacguugaugcuccuagcuuugauagcuguguuaacugguggagugacgcuguucuuccuaucaggaaggggcuuagggaaaacaucuaucggccuacucugcgugauggcuucaagcguacugcuauggauggccaguguagagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagccauauugaugggacuugacaaaggauggccaauaucgaagauggacauaggaguuccacuucuagccuuggggugcuauucccaagugaauccacugacgcugacagcggcgguauugaugcuaguggcucauuacgcuauaauuggaccuggacugcaagcaaaagcuacuagagaagcucaaaaaaggacagcggccggaauaaugaaaaauccaaccguugauggaaucguugcaauagauuuggacccugugguuuaugaugcgaaauuugagaaacaacuaggccaaauaauguuguugauacuaugcacaucacagauccucuugaugcggacuacaugggccuugugcgaauccaucacacuggccacuggaccucugaccacgcucugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacaccuauaaaaggagugggauuauggaaguggacagauccgaagccaaagagggacugaaaagaggggaaacaaccaaacaugcagugucgagaggaaccgcuaaauugaggugguuuguggagaggaaccuugugaaaccagaagggaaagucauagaccucgguuguggaagagguggcuggucauacuauugcgcugggcugaagaaagucacagaagugaaaggauauacaaaaggaggaccuggacaugaagaaccaaucccaauggcgaccuauggauggaaccuaguaaagcugcacuccgggaaagacguauucuuuauaccaccugagaaaugugacacccucuugugugauauuggugaguccucuccaaacccaacuauagaggaaggaagaacgcuacgcguccuaaagaugguggaaccauggcucagaggaaaccaauuuugcauaaaaguucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacauaugaaagagacguggaccuaggcgcuggaacaagacauguggcaguggaaccagagguagccaaccuagauaucauuggccagaggauagagaacauaaaacaugaacacaagucaacauggcauuaugaugaggacaauccauauaaaacaugggccuaucauggaucauaugaggucaagccaucgggaucagccucauccauggucaaugguguggugaaacugcucaccaaaccaugggaugucauccccauggucacacaaauagccaugacugacacuacacccuuuggacaacagaggguguuuaaagagaaaguugacacacgcacaccaaaagcaaaacgaggcacaacacaaaucauggaggugacagccaggugguuaugggguuuucuuucuagaaacaagaagccaagaauuuguacaagagaggaguuuacaagaaaaguuaggucaaacgcagccaucggagcaguguucguugacgaaaaucaauggaacucagcaaaagaagcaguggaagaugagcgguucugggaccuugugcacagagagagggagcuucacaaacagggaaaaugugcuacguguguuuacaacaugauggggaagagagagaaaaagcuaggagaauuuggaaaggcaaaaggaagucgugcaauaugguacaugugguugggagcacgcuuucuagaguucgaagcucuugguuucaugaacgaagaccacugguucagcagagagaauucacucagcggaguggaaggagaaggacuccauaaacuuggauauauacucagagacauaucaaagauuccaggaggaaacauguaugcagaugacacagccggaugggauacaaggauaacagaggaugaccuucagaaugaggccaaaauuacugacaucauggaacccgaacaugcccuacuggcuaaggcaaucuucaaacuaacuuaccaaaauaaagugguaaggguacagagaccagcaaaaaauggaaccgugauggaugucauauccagacgugaccagagaggaaguggccaggucggaacuuauggcuuaaauacuuucaccaacauggaagcccagcugauaagacaaauggagucugagggaaucuuuucacccagugaauuagagaccccaaauuuagccgagaggguucucgacuggcuggaaaaauauggcgucgaaaggcuaaaaagaauggcaaucaguggagaugacugcguagugaaaccaauugaugauagguuugcaacagccuuaacagcucugaaugauaugggaaaaguaagaaaagauauaccacaaugggaacccucaaaaggauggaaugauuggcaacaagugccuuuuuguucacaccacuuccaccagcugauuaugaaggaugggagggaaauuguggugccaugccgcaaccaagaugaacuuguggguagagcuagaguaucacaaggugcuggauggagccugagagaacccgcaugccuaggcaaaucauaugcacaaauguggcagcugauguacuuccacaggagagaccugagacuagccgcuaaugcuaucuguucagccguuccaguugauugggucccaaccagccguaccaccuggucgauccaugcccaccaccaauggaugacaacagaagacaugcugucaguguggaauaggguuuggauagaggaaaacccauggauggaggacaaaacccauauauccaguugggaggauguuccauauuuagggaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6269 - RNA, 9879 nt, Artificial Sequence
  derived and/or modified CDS sequence (wt) from DENV-1__KC762639__SS-prME
ucugugaccaugcuccuuaugcugacgccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuaugugaggacacacugacuuacaaaugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccuccgaaggcgcuuggaaacagauacaaagaguggagacuugggcccugagacacccaggauucacggugauagcccuuuuucuagcacaugccauaggaacauccaucacccagaaagggauuaucuucauuuuguuaaugcuggucacaccauccauggccaugcgaugcgugggaauaggcagcagggacuucguggaaggacugucaggagcaacuuggguagauguggugcuggaacauggaaguugcgucacuaccauggcaaaagacaaaccaacauuggacauugaacucuugaagacggaagucacaaacccugccguccugcgcaaacuaugcauugaagcuaaaauaucaaacacuaccaccgacucaagauguccaacacaaggagaagccacacugguggaagaacaagacgcgaacuuugugugucgacgaacguuuguggacagaggcuggggcaauggcugugggcucuucggaaaaggaagccuuauaacgugugcuaaguucaagugugugacaaaacuggaaggaaaaauaguucaguaugaaaacuugaaauauucaguaauagucaccguccacacuggagaccagcaucaggugggaaaugaaagcacagaacaugggacaacugcaacuauaacaccucaagcuccuacgacagaaauacaguugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagaaacuuggaacagacaagauuugcuggugacauuuaagacagcucaugcaaagaagcaggaaguagucguacuaggaucacaagaaggagcaaugcacacugcgcugaccggagcgacggaaauccaaacgucuggaacgacaacaauuuuugcaggacacuuaaaauguagacuaaagauggacaaacugacucuaaaagggaugucauaugugaugugcacaggcucauucaagcuagagaaagaaguggcugagacccagcauggaaccguucuagugcagaucaaauacgaaggaacagaugcaccaugcaagauuccuuuuucgacccaagaugaaaaaggaguaacccagaaugggagauugauaacagccaaccccauagucacugauaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucucuuucgaugacgugcauugcaguuggccuaguaacgcuauacuuaggagucaugguucaggcggauucaggauguguaauuaauuggaaagguagagaacucaaauguggaaguggcauuuuugucaccaaugaaguucacacuuggacagagcaauacaaauuucaagcugauuccccaaagagacuaucagcagccauugggaaggcaugggaggaggguguguguggaauucgaucagcaacucgucucgagaacaucauguggaagcaaauaucaaaugaauugaaccacaucuuacuugaaaaugacaugaaauucacagugguuguaggagauguugcugggaucuuggcucaagggaaaaaaaugauuaggccacaacccauggaacacaaauacucguggaaaagcuggggaaaggcuaaaaucauaggggcagauguacagaacaccaccuuuaucaucgacggcccaaacaccccagaaugcccugaugaucaaagagcauggaacauuugggaaguugaggauuauggauuuggaauuuucacgacaaacauauggcugaaauugcgugacuccuacacccaggugugugaccaccggcuaaugucagcugccaucaaggacagcagggcaguucacgcugacaugggguacuggauagaaagugaaaagaacgagaccuggaagcuggcaagagccucuuucauagaagucaaaacaugugucuggccaaaaucucacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacggucguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguucgcuguagggcuacuauuccgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcauuaugcauggaagacaauggcuaugguacugucaauuguaucucucuuccccuuaugccuguccacgaccucccaaaaaacaacauggcuuccggugcuguugggaucucuuggauguaaaccacuaaccauguuucuuauagcagaaaacaaaaucuggggaaggaaaaguuggccccucaaugaaggaaucauggcuguuggaauugucagcauccuacuaagcucacuccucaaaaaugaugugccgcuagcugggccacuaauagcuggaggcaugcuaauagcauguuauguuauaucuggaagcucagccgaucuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagauccggaguguuaugggacacaccuagcccuccagaaguggaaagagcaguucuugaugaugguaucuauagaaucaugcagagaggacuguugggcagaucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggcgaaguuggagccauugcccuagauuuuaaacccggcacaucuggaucucccaucgugaacagagaagggaaaauaguaggucuuuauggaaauggaguagugacaacaaguggaaccuacgucagugccauagcucaagcuaaagcaucacaagaagggccccuaccagagauugaagacgaaguguuuaggaaaagaaacuuaacaauaauggaucuacauccaggaucggggaaaacaagaagauaccuuccagccauaguccgugaggccauaaaaaggaagcugcgcacacuaauucuggcccccacaaggguugucgcuuccgaaauggcagaggcgcucaaaggaaugccaauaagguaucaaacaacagcagugaagagugaacacacaggaaaagagauaguugaccucaugugucacgccacuuucaccaugcgccuccugucucccgugagaguucccaauuauaacaugauuaucauggaugaagcacauuucaccgauccauccagcauagcggcuagaggguacaucucaacccgagugggcaugggugaagcagcugcgaucuucaugacagccacucccccaggaucaguggaggccuuuccacagagcaacgcaguuauccaagaugaggaaagagacauuccugagagaucauggaacucaggcuaugaguggaucacugacuucccaggcaaaacaguuugguuuguuccaagcauuaaaucaggaaaugauauugccaacugcuuaagaaagaaugggaaacgggugauucaauugagcagaaaaaccuuugacacagaguaccaaaaaacaaaaaauaacgacugggacuacgucgucacaacagacaucuccgaaaugggagcaaauuuccgggccgauagggugauagacccaagacggugucugaaaccgguaauacuaaaagaugguccagagcgugucauuuuagcaggaccgaugccagugacuguggccagugccgcccagaggagaggaagaguuggaaggaaccacaauaaggaaggugaucaguacaucuacaugggacagccuuuaaacaacgaugaagaucacgcucacuggacggaagcaaaaaugcuccuugauaauauaaacacaccagaagggauuaucccagcccucuucgagccggagagagaaaagagugcagcaauagacggggaauacagacugcggggugaagcaaggaaaacguuuguggagcucaugagaagaggagaucuaccugucuggcuauccuacaaaguugccucagaaggcuuccaguacucugauagaagauggugcuuugacggggaaaggaacaaccagguguuggaggagaacauggacguggagaucuggacaaaagaaggagagagaaagaaacuacgaccccguuggcuggaugccagaacauacucagacccacuggcccugcgcgaguuuaaagaguuugcagcaggaagaagaagcgucucaggagaucuaauauuagaaauagggaaacuuccacaacacuugacgcaaaaggcccagaaugccuuggacaaccugguuauguuacacaacuccgaacaaggaggaagagccuauagacaugcaauggaagaauugccagacaccauagaaacguugaugcuccuagcuuugauagcuguguuaacugguggagugacgcuguucuuccuaucaggaaggggcuuagggaaaacaucuaucggccuacucugcgugauggcuucaagcguacugcuauggauggccaguguagagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagccauauugaugggacuugacaaaggauggccaauaucgaagauggacauaggaguuccacuucuagccuuggggugcuauucccaagugaauccacugacgcugacagcggcgguauugaugcuaguggcucauuacgcuauaauuggaccuggacugcaagcaaaagcuacuagagaagcucaaaaaaggacagcggccggaauaaugaaaaauccaaccguugauggaaucguugcaauagauuuggacccugugguuuaugaugcgaaauuugagaaacaacuaggccaaauaauguuguugauacuaugcacaucacagauccucuugaugcggacuacaugggccuugugcgaauccaucacacuggccacuggaccucugaccacgcucugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacaccuauaaaaggagugggauuauggaaguggacagauccgaagccaaagagggacugaaaagaggggaaacaaccaaacaugcagugucgagaggaaccgcuaaauugaggugguuuguggagaggaaccuugugaaaccagaagggaaagucauagaccucgguuguggaagagguggcuggucauacuauugcgcugggcugaagaaagucacagaagugaaaggauauacaaaaggaggaccuggacaugaagaaccaaucccaauggcgaccuauggauggaaccuaguaaagcugcacuccgggaaagacguauucuuuauaccaccugagaaaugugacacccucuugugugauauuggugaguccucuccaaacccaacuauagaggaaggaagaacgcuacgcguccuaaagaugguggaaccauggcucagaggaaaccaauuuugcauaaaaguucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacauaugaaagagacguggaccuaggcgcuggaacaagacauguggcaguggaaccagagguagccaaccuagauaucauuggccagaggauagagaacauaaaacaugaacacaagucaacauggcauuaugaugaggacaauccauauaaaacaugggccuaucauggaucauaugaggucaagccaucgggaucagccucauccauggucaaugguguggugaaacugcucaccaaaccaugggaugucauccccauggucacacaaauagccaugacugacacuacacccuuuggacaacagaggguguuuaaagagaaaguugacacacgcacaccaaaagcaaaacgaggcacaacacaaaucauggaggugacagccaggugguuaugggguuuucuuucuagaaacaagaagccaagaauuuguacaagagaggaguuuacaagaaaaguuaggucaaacgcagccaucggagcaguguucguugacgaaaaucaauggaacucagcaaaagaagcaguggaagaugagcgguucugggaccuugugcacagagagagggagcuucacaaacagggaaaaugugcuacguguguuuacaacaugauggggaagagagagaaaaagcuaggagaauuuggaaaggcaaaaggaagucgugcaauaugguacaugugguugggagcacgcuuucuagaguucgaagcucuugguuucaugaacgaagaccacugguucagcagagagaauucacucagcggaguggaaggagaaggacuccauaaacuuggauauauacucagagacauaucaaagauuccaggaggaaacauguaugcagaugacacagccggaugggauacaaggauaacagaggaugaccuucagaaugaggccaaaauuacugacaucauggaacccgaacaugcccuacuggcuaaggcaaucuucaaacuaacuuaccaaaauaaagugguaaggguacagagaccagcaaaaaauggaaccgugauggaugucauauccagacgugaccagagaggaaguggccaggucggaacuuauggcuuaaauacuuucaccaacauggaagcccagcugauaagacaaauggagucugagggaaucuuuucacccagugaauuagagaccccaaauuuagccgagaggguucucgacuggcuggaaaaauauggcgucgaaaggcuaaaaagaauggcaaucaguggagaugacugcguagugaaaccaauugaugauagguuugcaacagccuuaacagcucugaaugauaugggaaaaguaagaaaagauauaccacaaugggaacccucaaaaggauggaaugauuggcaacaagugccuuuuuguucacaccacuuccaccagcugauuaugaaggaugggagggaaauuguggugccaugccgcaaccaagaugaacuuguggguagagcuagaguaucacaaggugcuggauggagccugagagaaaccgcaugccuaggcaaaucauaugcacaaauguggcagcugauguacuuccacaggagagaccugagacuagccgcuaaugcuaucuguucagccguuccaguugauugggucccaaccagccguaccaccuggucgauccaugcccaccaccaauggaugacaacagaagacaugcugucaguguggaauaggguuuggauagaggaaaacccauggauggaggacaaaacccauauauccaguugggaggauguuccauauuuagggaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6270 - RNA, 9879 nt, Artificial Sequence
  derived and/or modified CDS sequence (wt) from DENV-1__KC762642__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuaugugaggacacacugacuuacaaauguccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccuccgaaggcgcuuggaaacagauacaaagaguggagacuugggcccugagacacccaggauucacggugauagcccuuuuucuagcacaugccauaggaacauccaucacccagaaagggauuaucuucauuuuguuaaugcugguuacaccauccauggccaugcgaugcgugggaauaggcagcagggacuucguggaaggacugucaggagcaacuuggguagauguggugcuggaacauggaaguugcguuacuaccauggcaaaagacaaaccaacauuggacauugaacucuugaagacggaagucacaaacccugccguccugcgcaaacugugcauugaagcuaaaauaucaaacacuaccaccgacucaagauguccaacacaaggagaagccacacugguggaagaacaagacgcgaacuuugugugucgacgaacguuuguggacagaggcuggggcaauggcugugggcucuucggaaaaggaagccuuauaacgugugcuaaguucaagugugugacaaaacuggaaggaaaaauaguucaauaugaaaacuugaaauauucaguaauagucaccguccacacuggagaccagcaucaggugggaaaugaaagcacagaacaugggacaacugcaacuauaacaccucaagcuccuacgacagaaauacagcugaccgacuacggagcucuuacauuggauuguucaccuagaacaggacuagacuucaaugaaaugguguuguugacaaugaaagaaaaaucauggcuaguccacaaacaaugguuucuagaccuaccacugccuuggaccucgggagcuucaacaacacaagaaacuuggaacagacaagauuugcuggugacauuuaagacagcucaugcaaagaagcaggaaguagucguacuaggaucacaagaaggagcaaugcacacugcgcugaccggagcgacagaaauccaaacaucuggaacgacaacaauuuuugcaggacacuugaaauguagacuaaagauggacaaacugacucuaaaagggaugucauaugugaugugcacaggcucauucaagcuagagaaggaaguggcugagacccagcauggaaccguucuagugcagaucaaauacgaaggaacagaugcaccaugcaagaucccuuuuucgacccaagaugaaaaaggagugacccagaaugggagauugauaacagccaaccccauagucacugacaaagaaaaaccagucaacauugaggcagaaccgccuuuuggugagaguuacaucgugauaggagcaggugaaaaagcuuugaaauuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagaucuuuggaacugcauauggaguuuuguucagcgguguuuccuggaccaugaaaauaggaauagggguucuguugacauggcuaggauuaaacucaaggagcacgucccuuucgaugacgugcauugcaguuggccuaguaacgcuauacuuaggagucaugguucaggcggauucaggauguguaauuaauuggaaagguagagaacucaaauguggaaguggcauuuuugucaccaaugaaguucacacuuggacagagcaauacaaauuucaagcugauuccccaaagagacuaucagcagccauugggaaggcaugggaggagggugugugugguauucgaucagcaacucgucucgagaacaucauguggaagcaaauaucaaaugaauugaaccacaucuugcuugaaaaugacaugaaauucacagugguuguaggagauguugcugggaucuuggcucaaggaaaaaaaaugauuaggccacaacccauggaacacaaauacucguggaaaagcuggggaaaggcuaaaauuauaggggcagauguacagaacaccaccuuuaucaucgacggcccaaacaccccagaaugcccugaugaucaaagagcauggaacauuugggaaguugaggauuauggauuuggaauuuucacgacaaacauauggcugaaauugcgugacuccuacacccaggugugugaccaccggcuaaugucagcugccaucaaggacagcaaggcaguucacgcugacaugggguacuggauagaaagugaaaagaacgagaccuggaagcuggcaagagccucuuucauagaagucaaaacauguaucuggccaaaaucucacacucuauggagcaauggaguucuggaaagugaaaugauaauuccaaagaucuauggaggaccaauaucucagcacaacuacagaccaggauauuucacacaaacggcagggccguggcaccuaggcaagcuggaacuggauuuugauuugugugaggguaccacgguuguuguggaugaacauuguggaaaucgaggaccaucucuuaggaccacaacagucacaggaaagauaauccaugaaugguguugcagaucuuguacgcuaccacccuuacguuucagaggagaagaugggugcugguacgguauggaaaucaggccagucaaggagaaggaagagaaucuagucaaaucaauggucuccgcagggucaggggaaguggacagcuuuucacuaggacugcuaugcauaucaauaaugaucgaagaggugaugagauccagauggaguagaaaaaugcugauaacuggaacacuggcuguguucuuccuucucauaaugggacaagugacauggaaugaucugaccagauuaugcaucaugguuggagccaacgcuuccgacaggauggggaugggaacgacguaccuagcucugauggccacuuuuaaaaugagaccaauguuugcuguagggcuacuauuccgcagacuaacauccagagaaguucuucuucuaacaauuggacugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuaugcauggaagacaauggcuaugguacugucaauuguaucucucuuccccuuaugccuguccacgaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauugucagcauccuacuaaguucacuccucaaaaaugaugugccgcuagcuggaccacuaauagcuggaggcaugcuaauagcauguuauguuauaucuggaagcucagccgaucuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguugugggacacaccuagcccuccagaaguggaaagagcaguucuugaugaugguaucuauagaaucaugcagagaggacuguugggcaggucccaaguagggguaggaguuuuucaagaaaauguguuccacacaauguggcaugucaccaggggagcuguacucauguaucaagggaagagacuggaaccgagcugggccagugucaaaaaagaccugaucucauauggaggagguuggaggcuucaaggauccuggaacacgggagaagaagugcaggugauugcuguugaaccagggaaaaaccccaaaaauguacaaacagcgccgggcaccuuuaagaccccugaaggcgaaguuggagccauugcccuagauuuuaaacccggcacaucuggaucucccaucgugaacagagaagggaaaauaguaggucuuuauggaaauggaguagugacaacaaguggaaccuacgucagugccauagcucaagcuaaagcaucacaagaagggccccuaccagagauugaagacgagguguuuaggaaaagaaacuuaacaauaauggaccuacauccaggaucgggaaaaacaagaagauaccuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacacacaggaagagagauaguugaccucaugugucacgccacuuucaccaugcgccuccugucucccgugagaguucccaauuacaacaugauuaucauggaugaagcacauuucaccgauccauccagcauagcggcuagaggguacaucucaacccgagugggcaugggugaagcagcugcgaucuucaugacagccacucccccaggaucaguggaggccuuuccacagagcaacgcaguuauccaagaugaggaaagagacauuccugagagaucauggaacucaggcuaugaguggaucacugacuucccaggcaaaacaguuugguuugucccaagcauuaaaucaggaaaugauauugccaacugcuuaagaaagaaugggaaacgggugauucaauugagcagaaaaaccuuugacacagaguaccaaaaaacaaaaaauaacgacugggacuacgucgucacaacagacaucucugaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucacgcucacuggacggaagcaaaaaugcuccuugauaauauaaacacaccagaagggauuaucccagcccucuucgagccggagagagaaaagagugcagcaauagacggggaauacagacugcggggugaagcaaggaaaacguuuguggagcucaugagaagaggagaucuaccugucuggcuauccuacaaaguugccucagaaggcuuccaguacucugauagaagauggugcuuugacggggaaaggaacaaccagguguuggaggagaacauggacguggagaucuggacaaaagaaggagaaagaaagaaacuacgaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaccugguuauguugcacaacuccgaacaaggaggaagagccuauagacaugcaauggaagaacuaccagacaccauagaaacguugaugcuccuagcuuugauagcuguguuaacugguggagugacgcuguucuuccuaucaggaaggggcuuagggaaaacaucuaucggccuacucugcgugauggcuucaagcguacugcuauggauggccaguguagagccccauuggauagcggccuccaucauacuggaguucuuccugauggugcugcuuauuccagagccagacagacaacgcacuccgcaggacaaccagcuggcauauguggugauaggcuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuaucuugaugggacuugacaaaggauggccaauaucgaagauggacauaggaguuccacuucucgccuuggggugcuauucccaagugaauccacugacgcugacagcggcgguauugaugcuaguggcucauuacgcuauaaucggaccuggacugcaagcaaaagcuacuagagaagcucaaaaaaggacagcggccggaauaaugaaaaauccaaccguugauggaaucguugcaauagauuuggacccugugguuuaugaugcgaaauuugagaaacaacuaggccaaauaauguuguugauacuaugcacaucacagauccucuugaugcggacuacaugggccuugugcgaauccaucacacuggccacuggaccucugaccacgcucugggagggaucuccaggaaaauuuuggaacaccacgauagcgguuuccauggcaaacauuuucagaggaaguuaucuagcaggagcaggucuggccuucucauuaaugaaaucccuaggaggagguaggagaggcacgggagcccaaggggaaacacugggagagaaauggaaaagacagcugaaccaauugagcaagucagaauucaacaccuauaaaaggagugggauuauggaaguggacagaucugaagccaaagagggacugaaaagaggagaaacaaccaagcaugcagugucgagaggaaccgcuaaauugaggugguuuguggagaggaaccuugugaaaccagaagggaaagucauagaccucgguuguggaagagguggcuggucauacuauugcgcugggcugaagaaaguuacagaagugaaaggauauacaaaaggaggaccuggacaugaagaaccaaucccaauggcgaccuauggauggaaccuaguaaagcugcacucugggaaagacguguucuuuauaccaccugagaaaugugacacccucuugugugauauuggugaguccucuccaaacccaacuauagaggaaggaagaacgcuacgcguccuaaagaugguggaaccauggcucagaggaaaccaauucugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaauaugaacacaagucaacauggcauuaugaugaggacaauccauauaaaacaugggccuaucauggaucauaugaggucaagccaucaggaucagccucauccauggucaaugguguggugaaacugcucaccaaaccaugggaugucauccccauggucacacaaauagccaugacagacacuacacccuuuggacaacagaggguguucaaagagaaaguugacacacgcacaccaaaagcaaaacgaggcacagcacaaaucauggaagugacagccaggugguuaugggguuuucuuucuagaaacaagaagccaagaaucuguacaagagaggaguuuacaagaaaaguuaggucaaacgcagccaucggagcaguguucguugacgaaaaucaauggaacucagcaaaagaagcaguggaagaugagcgguucugggaccuugugcacagagagagggagcuucacaaacagggaaaaugugcuacguguguuuacaacaugauggggaagagagagaaaaagcuaggagaauuuggaaaggcaaaaggaagucgugcaauaugguacaugugguugggagcacgcuuucuagaguucgaagcucuugguuucaugaacgaagaccacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggcuaaaauuacugacaucauggaacccgaacaugcccuacuggcuaaggcagucuucaagcuaaccuaccaaaacaaagugguaaggguacagagaccagcaaaaaauggaacugugauggaugucauauccagacgugaccagagaggaaguggccaggucggaacuuauggcuuaaacacuuucaccaacauggaagcccagcugauaagacaaauggagucugagggaaucuuuucacccagugaauuagagaccccaaauuuagccgagagaguucucuacuggcuggaaaaauauggcgucgaaaggcuaaaaagaauggcaaucaguggagaugacugcguagugaaaccaauugaugauagguuugcaacagcccuaacagcucugaaugauaugggaaaaguaagaaaagauauaccgcaaugggaacccucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaaccgcaugccuaggcaaaucauacgcacaaauguggcagcugauguacuuccacaggagagaccugagacuagcugcuaaugcuaucuguucagccguuccaguugauugggucccaaccagccguaccaccuggucgauccaugcccaucaccaauggaugacaacagaagacaugcugucaguguggaauaggguuuggauagaggaaaacccauggauggaggacaaaacccauauauccaguugggaagauguuccauauuuagggaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6271 - RNA, 9879 nt, Artificial Sequence
  derived and/or modified CDS sequence (wt) from DENV-1__JQ915077__SS-prME
ucugugaccaugcuccucaugcugcugcccacaguccugacguuccauuugaccacccgagggggagagccucacaugauaguuagcaaacaggaaagaggaaagucacuuuuguuuaagaccucugcaggugucaacaugugcacccuuauugcaauggaccugggagaguuaugugaugacacgaugaccuacaaauguccccggaucacugagacggaaccagaugacguugacuguuggugcaaugccacggagacaugggugaccuauggaacauguucucaaacuggugaacaccgacgagacaaacguuccguugcacuggcaccacacguagggcuuggucuagaaacaagaaccgaaacguggauguccucugaaggcgcuuggagacaaauacaaaaaguggagacaugggcucugagacacccaggauuuacggugauagcccuuuuucuagcacaugccauaggaacauccaucacccagaaagggauuauuuucauuuugcugaugcuggugacuccauccauggccaugcggugcgugggaauaggaaacagagacuucguggaaggacugucaggagcuacguggguggauguaguucuggagcauggaaguugcgucacuaccauggcaaaagacaaaccaacacuggacauugaacuccugaagacggaggucacaaacccugccguccugcgcaaacuguguauagaagcuaaaauaucaaauaccaccacugacucgagauguccgacacaaggagaagccacgcugguggaagaacaagacacgaacuuugugugucgacgaacauucguggacagaggcuggggcaaugguuguggacuauucggaaaggguagcuuaauaacgugugcuaaguuuaagugugugacaaaauuggaaggaaagauaguccaauaugaaaacuuaaaauauucugugaucguuaccguccacacuggagaccagcaccaaguuggaaaugagaccacagaacauggaacaauugcaaccauaacaccucaagcucccacgucggaaauacaacugacagacuacggagcucuaacacuggauuguucaccuagaacagggcuagacuuuaaugagaugguguugcugacaaugaaagaaaaaucauggcucguccacaaacaaugguuucuagacuuaccacugccuuggaccucaggggccucaacgucccaagagacuuggaacagacaagacuugcuggucacguuuaagacagcucaugcaaagaagcaggaaguagucguacuaggaucacaagaaggagcaaugcacacugcguugacuggagcgacagaaauccaaacgucuggaacgacaacaauuuuugcaggccaccugaaauguagauuaaaaauggacaaacuaacucuaaaaggaauaucauauguaaugugcacaggcucauucaaguuagagaaggaaguggcugagacccagcauggaacuguucuaguacaggucaaauacgaaggaacagaugcaccaugcaagauccccuucucgucccaagaugagaagggaguaacccagaaugggagauugguaacagccaaccccauagucacugacaaagaaaaaccagucaacauugaagcggagccacccuuuggugagagcuacaucgugguaggagcaggugaaaaagcuuugaaacuaagcugguucaagaagggaagcaguauagggaaaauguuugaagcaacugcccguggagcacgaaggauggccauccugggagacaccgcaugggacuucggcucuauaggaggaguguucacgucugugggaaaacugguacaccagaucuuuggaacugcguauggaguuuuguucagcgguguuucuuggaccaugaaaauaggaauagggauucugcugacauggcugggauuaaacucaaggagcacgucccuuucaaugacguguaucgcaguuggcauggucacacuguaccuaggagucaugguccaggcggacucgggauguguaaucaacuggaaaggcagagaacucaaauguggaagcggcauuuuugucacuaaugaaguucacaccuggacagagcaauacaaauuccaggcugacuccccaaagagacuaucagcagccauugggaaggcaugggaggaggguguguguggaauucgaucagccacucgucucgagaacaucauguggaagcaaauaucaaaugaauuaaaccacaucuuacuugaaaaugacaugaaauuuacagugguaguaggagacguuaguggaaucuuggcccaaggaaagaaaacgauuaggccacaacccauggaacacaaauacucguggaaaaguuggggaaaagccaaaaucauuggagcagauguucagaacacuaccuucaucaucgacggcccaaacaccccagaaugccccgaugaccaaagagcauggaacaucugggaaguugaagacuauggauuuggaauuuucacgacaaacauaugguugaaauugcgugauuccuacacccaagugugugaccaucgacuaaugucggcugccaucaaggauagcaaagcaguccaugcugacaugggguacuggauagaaagugaaaagaacgagacuuggaaguuggcaagagccuccuucauagaagucaagacaugcgucuggccaaaaucucacacucuauggagcaauggaguccuggaaagugagaugauaaucccaaagauauauggaggaccaauaucucagcacaauuacagaccaggauauuucacacaaacagcagggccguggcacuuaggcaaguuggaacuagauuuugauuugugugaagguaccacagugguuguggaugaacauuguggaaaucgcggaccaucucucagaaccacaacagucacaggaaagauaauccaugaauggugcugcagaucuugcacguuacccccucuacguuucaaaggagaagacgggugcugguacggcauggaaauuagaccagucaaggagaaggaagagaaccuaguuaagucaauggucucugcagggucaggagaaguggacaguuuuucacuaggacuguuaugcauaucaauaaugaucgaagagguaaugagauccagauggagcaggaaaaugcugaugacuggaacauugguuguguuccuccuucucacauugggacaauugacauggaacgaucugaucaggcuaugcaucaugguuggagccaaugcuucagacaauauggggaugggaacaacguacuuagcuuugauggccacuuucagaaugagaccaauguucgcagucgggcuauuauuucgcagauuaacaucuagagaaguucuucuucucacgguuggauugagucugguggcaucuguagaacuaccaaauuccuuagacgagcuaggggauggacuugcaaugggcaucaugauauugaaauuacugacugauuuucaaucacaucagcuaugggccauuuugcugucucuaacauuugucaaaacaacucuuucacugcacuaugcauggaagacaauggccaugauacugucaauuguaucccuccucccuuuaugccuguccacgacuucucaaaaaacgacauggcuuccagugcuucugggaucucuuggaugcaaaccacuaaccauguuucucauaacagaaaacaaaaucuggggaaggaaaaguuggccucucaaugaaggaaucauggcuguuggaauaguuagcauucuacuaagcucacuucucaaaaaugaugugccacuagcuggcccauuaauagcuggaggcaugcuaauagcauguuaugucauauccggaagcucggccgauuuaucacuggagaaagcagcuaaggucuccugggaagaagaagcagaacacucuggcgccucacacaauauacuagucgagauccaagaugauggaaccaugaagauaaaggaugaagagagagaugacacgaucaccauccuccucaaagcaacccugcuggcaaucucagggguguauccaaugucaauaccggcgacucucuuuguguggcauuuuuggcagaaaaagaaacagagaucaggaguguuaugggacacacccagcccuccagaaguggaaaaagcaguccuugaugauggcauuuauagaauucuccaaagaggauuguugggcaggucucagguaggaguaggaguuuuccaagaaggcguauuccacacaauguggcacgucaccaggggagcuguucucauguaccaagggaagagauuggaaccaaguugggccagugucaaaaaagacuugaucucauauggaggagguuggagguuucaaggauccuggaacacgggagaagaagugcaggugauugcuguugaaccggggaagaacccaaaaaauguacagacagcgccagguaccuucaagacuucugaaggcgaaguuggagccauagcucuagacuucaaacccggcacaucuggaucuccuaucgugaacagagagggaaaaauaguaggucuuuauggaaauggaguggugacaacaaguggaaccuaugucagugcuauagcucaagcuaaagcaucacaagaagggccuuugccagagauugaggacgagguguuuaggaaaagaaacuuaacaauaauggaccuacacccaggaucgggaaaaacaagaagauaccuuccagccauaguccgugaggccauaaaaagaaagcugcgcacgcuaguucuagcucccacaagaguugucgccucugaaauggcagaggcgcucaagggaaugccaauaagguaucagacaacagcagugaagagugaacacacgggaaaggagauaguugaccuuaugugucacgccacuuucacuaugcgucuccuuucuccugugagaguucccaauuauaacaugauaaucauggaugaagcacauuuuaccgauccagccagcauagcagccagaggguacaucucaacccgaguggguaugggugaagcagcugcgauuuucaugacagccaccccccccggaucgguggaggccuuuccacagagcaaugcaguuauccaagaugaggaaaaagacauuccugaaagaucauggaacucaggcuaugacuggaucacugacuucccaggcaaaacagucugguuuguuccaagcaucaaaucaggaaaugacauugccaacuguuuaagaaagaaugguaaacgggugauccaauuaagcaggaaaacuuuugacacugaguaucagaaaacaaaaaauaacgacugggacuauguugucacaacagacauauccgaaaugggagcaaacuuucgagcugacaggguaauagacccaaggcggugccugaaaccgguuauacugaaagaugguccagagcgugucauucuagccggaccgaugccagugacuguggcuagugccgcccagaggagaggaagaauuggaaggaaccaaaauaaggaaggugaucaguauauuuacaugggacagccucuaaauaaugaugaggaccacgcccauuggacagaagcaaaaaugcuccuugacaacauaaacacaccagaagggaucaucccagcccucuuugagccggaaagagaaaagagugcugcaauagacggggaguacagacuacggggugaagcgaggaaaacguuuguggagcucaugagaagaggagaucuaccugucuggcuaucuuacaaagucgccucagaaggcuuccaauacuccgacagaagguggugcuuugauggggagaggaacaaccagguguuggaggagaacauggacguggagaucuggacaaaagaaggagaaagaaagaaacugcgaccccgcuggcuggaugccagaacauacucugacccacuggcucugcgcgaauucaaagaguucgcagcaggaagaagaagcgucucaggugaccuaauauuagaaauagggaaacuuccacaacaucuaacgcaaagggcccagaaugcuuuagauaaucugguuaugcugcacaacucugaacaagggggaaaagcuuauagacacgccauggaagaauugccagacaccauagagacaauaaugcuccuagcuuugauagcugugcugacugguggagugacgcuguucuuccuaucaggaagaggcuuagggaaaacauccauaggccuacucugcgugacguccucaaguguacuguuauggauggccaguguggagccccauuggauagcggccucuauuauacuagaguucuuucugaugguguugcuuauuccagagccagauagacagcgcacuccacaagacaaccaguuagcauauguggugauagguuugcuauuuaugauauugacaguggcagccaaugagaugggauuauuggaaaccacaaagaaagaccuggggauuggucaugcagcugcugaaaaccaccaccacgccgcaaugcuggacguagaccuccauccagcuucagccuggacccucuacgcaguggccacaacgauuaucacucccaugaugagacacacaauugaaaacacaacggcaaauauuucccugacagcuauugcaaaccaggcagcuauauugaugggacuugauaagggauggccaauaucaaagauggacauaggaguuccacuucucgccuuggggugcuauucucaagugaacccgcugacgcugacagcagcgguacugaugcuaguagcccauuaugccauaauuggaccaggacugcaagcaaaagccacuagagaagcucaaaaaaggacggcagccggaauaaugaaaaacccaacugucgacgggaucguugcaauagauuuagacccugugguuuaugaugcaaaauuugaaaaacagcuaggccaaauaauguuguugauacuuugcacaucucagauucucuugaugcggaccacaugggccuugugugaauccaucacacuggccacaggaccucugaccacgcuuugggagggaucuccaggaaaauucuggaacaccacgauagcgguguccauggcaaacauuuuuagggguaguuaucuagcaggagcgggucuggccuuuucauuaaugaaaucucugggaggagguaggagagggacgggagcccaaggggaaacauugggagaaaaguggaaaagacagcugaaccaauugagcaagucagaauuuaacacuuacaagaggagugggauuauagaaguggauagaucugaagccaaggagggguugaaaagaggagaaacaaccaaacacgcagugucgagaggaacggccaaacugaggugguuuguggagaggaaccuugugaaaccagaagggaaagucauagaccucgguuguggaagagguggcuggucauauuauugcgcugggcugaagaaagucacagaagugaaaggauacacaaaaggaggaccuggacaugaggaaccgaucccaauggcaaccuauggauggaaccuaguaaagcuacacuccgggaaagauguauucuuuauaccaccugagaaaugugacacucuuuugugugauauuggugaguccucuccgaacccgacuauagaagaaggaagaacguuacguguucuaaagaugguagaaccauggcucagaggaaaccaauuuugcauaaaaauucuaaaucccuauaugccgagugugguagaaacucuggagcaaaugcaaagaaaacauggaggaauguuagugcgaaauccacucucaagaaauuccacucaugaaauguacuggguuucauguggaacaggaaacauugugucagcaguaaauaugacaucuagaaugcugcuaaaccgauucacaauggcucacaggaagccaacauaugaaagagauguggacuugggcgcuggaacgagacauguggcaguagaaccagagguggccaaccuagacaucauuggccagaggauagagaacauaaaaaaugaacacaaaucaacauggcauuaugaugaggauaauccguacaaaacaugggccuaucauggaucauaugaggucaagccaucaggaucagccucauccauggucaaugguguggugagacugcuaaccaaaccaugggaugucauucccauggucacacaaauagccaugacugacaccacacccuuuggacaacaaaggguguuuaaagagaaaguugauacgcguacaccaaaagcgaaacgaggcacagcacaaaucauggaggugacggccaagugguuaugggguuuccucucuagaaacaaaaaacccagaaucugcacaagagaagaguuuacaagaaaagucaggucaaaugcagcuauuggagcaguguucguugaugaaaaucaauggaacucagcaaaagaagcaguggaagaugaaagguucugggaccuugugcgcagagagagggagcuucauaaacaaggaaaaugugcuacaugugucuacaacaugaugggaaagagagaaaaaaaauuaggagaguucggaaaggcaaaaggaagucgcgcaauaugguacaugugguugggagcgcgcuucuuagaguuugaagcccuuggcuucaugaaugaagaucacugguucagcagagagaauucacucaguggaguggagggagaaggacuccacaaacuuggauacauacucagagauauaucaaagauuccagggggaaauauguaugcagaugacacagccggaugggacacaagaauaacagaggaugaucuucagaaugaggccaaaaucacugacaucauggaaccugaacaugcccuacuggccacgucaaucuuuaagcuaaccuaccaaaauaagguuguaaggguacagagaccagcaaaaaauggaaccgugauggaugucauauccaggcgugaccagagaggaaguggacagguuggaacuuauggcuuaaacaccuucaccaacauggaggcccaacuaauaagacaaauggagucugaaggaaucuuuucacccagcgaauuggaaaccccaaauuuagccggaagaguccuugacugguuggaaaaacauggcaccgagaggcugagaagaauggcaaucaguggagaugacuguguggugaaaccaauugaugacagauuugcaacagccuuaacagccuugaaugacaugggaaagguaagaaaagacauaccgcaaugggaaccuucaaaaggauggaaugauuggcaacaagugcccuucugcucacaccacuuccaccagcugauuaugaaggaugggagggagauaguggugccaugccgcaaccaagaugaauugguagguagggccagagugucacaaggcgccggauggagcuugagagaaacugcaugucuaggcaagucguaugcacaaauguggcagcugauguacuuccacaggagagacuugagacuagcggcuaaugcuaucuguucagccguuccaguugauugggucccaaccagucgcaccaccuggucgauccaugcccaccaucaauggaugacaacagaagacauguugucaguguggaauagggucuggauagaggaaaacccauggauggaggauaaaacucauguguccagcugggaagacguuccauaccuagggaaaagggaagaucaaugguguggaucccuaauaggcuuaacagcacgagccaccugggccaccaacauacaaguggccauaaaccaagugagaaggcucauugggaaugagaauuaucuagacuacaugacaucaaugaagagauucaaaaacgagagugaucccgaaggggcacucugguaa

SEQ ID NO: 6272 - RNA, 9879 nt, Artificial Sequence
  derived and/or modified CDS sequence (wt) from DENV-1__JQ915079__SS-prME
ucugugaccaugcuccucaugcugcugcccacaguccugacguuccauuugaccacccgagggggagagccucacaugauaguuagcaaacaggaaagaggaaagucacuuuuguucaagaccucugcaggugucaacaugugcacccuuauugcaauggaccugggagaguuaugugaugacacgaugaccuacaaauguccccggaucacugagacggaaccagaugacguugacuguuggugcaaugccacggagacgugggugaccuauggaacauguucucaaacuggugaacaccgacgagacaaacguuccguugcacuggcaccacacguagggcuuggucuagaaacaagaaccgaaacguggauguccucugaaggcgcuuggagacaaauacaaaaaguggagacaugggcucugagacacccaggauuuacggugauagcccuuuuucuagcacaugccauagggacauccaucacccagaaaggaauuauuuucauuuugcugaugcuggugacuccauccauggccaugcggugcgugggaauaggaaacagagacuucguggaaggacugucaggagcuacguggguggauguaguucuggaacauggaaguugcgucacuaccauggcaaaagacaaaccaacacuggacauugaacuccugaagacggaggucacaaacccugccguccugcgcaaacuguguauagaagcuaaaauaucaaauacuaccacugacucgagauguccgacacaaggagaagccacgcugguggaagaacaagacacgaacuuugugugucgacgaacauucguugacagaggcuggggcaaugguuguggacuauucggaaaggguagcuuaauaacgugugcuaaguuuaagugugugacaaaauuggaaggaaagauaguccaauaugaaaacuuaaaauauucugugaucguuacuguccacacuggagaccagcaccaaguuggaaaugagaccacagaacauggaacaauugcaaccauaacaccccaagcucccacgucggaaauacaacugacagacuacggagcucuaacacuggauuguucaccuagaacagggcuagacuuuaaugagaugguguugcugacaaugaaagaaaaaucauggcucguccacaaacaaugguuucuagacuuaccacugccuuggaccacaggggccucaacgucccaagagacuuggaacagacaagacuugcuggucacguuuaagacagcucaugcaaagaagcaggaaguagucguacuaggaucacaagaaggagcaaugcacacugcguugacuggagcgacagaaauccaaacgucuggaacgacaacaauuuuugcaggccaccugaaaugcagauuaaaaauggacaaacuaacucuaaaaggaauaucauauguaaugugcacaggcucauucaaguuagagaaggaaguggcugagacccagcauggaacuguucuaguacaggucaaauacgaaggaacagaugcaccaugcaagauccccuucucgucccaagaugagaagggaguaacccagaaugggagauugguaacagccaaccccauagucacugacaaagaaagaccagucaacauugaagcggagccacccuuuggugagagcuacaucgugguaggagcaggugaaaaagcuuugaaacuaaguugguucaagaagggaagcaguauagggaaaauguuugaagcaacugcccguggagcacgaaggauggccauccugggagacaccgcaugggacuucggcuccauaggaggaguguucacgucugugggaaaacugguacaccagaucuuuggaacugcguauggaguuuuguucagcgguguuucuuggaccaugaaaauaggaauagggauucugcugacauggcugggauuaaacucaaggaguacgucucuuucaaugacguguaucgcaguuggcauggucacacuguaccuaggagucaugguccaggcggacucgggauguguaaucaacuggaaaggcagagaacucaaauguggaaguggcauuuuugucacuaaugaaguucacaccuggacagagcaauacaaauuccaggcugacuccccaaagagacuaucagcagccauugggaaggcaugggaggaggguguguguggaauucgaucagccacucgucucgagaacaucauguggaagcaaauaucaaaugaauuaaaccacaucuuacuugaaaaugacaugaaauuuacagugguaguaggagacguuaguggaaucuuggcccaaggaaagaaaacgauuaggccacaacccauggaacacaaauacucguggaaaaguuggggaaaagccaaaaucauuggagcagauguucagaacacuaccuucaucaucgacggcccaaacaccccagaaugccccgaugaccaaagagcguggaacaucugggaaguugaagacuauggauuuggaauuuucacgacaaacauaugguugaaauugcgcgauuccuacacccaagugugugaccaucgacuaaugucggcugccaucaaggauagcaaagcaguucaugcugacaugggguacuggauagaaagugaaaagaacgagacuuggaaguuggcaagagccuccuucauagaagucaagacaugcgucuggccaaaaucucacacucuauggagcaauggaguccuggaaagugagaugguaaucccaaagauauauggaggaccaauaucucagcacaauuacagaccaggauauuucacacaaacagcagggccguggcacuuaggcaaguuggaacuagauuuugauuugugugaagguaccacagugguuguggaugaacauuguggaaaucgcggaccaucucuuagaaccacaacagucacaggaaagauaauccaugaauggugcugcagaucuugcacguuacccccucuacguuucaaaggagaagacgggugcugguacggcauggaaauuagaccagucaaggagaaggaagagaaccuaguuaagucaauggucucugcagggucaggagaaguggacaguuuuucacuaggacuguuaugcauaucaauaaugaucgaagagguaaugagauccagauggagcaggaaaaugcugaugacuggaacauugguuguguuccuccuucucacauugggacaauugacauggaacgaucugaucaggcuaugcaucaugguuggagccaaugcuucagacaauauggggaugggaacaacguacuuagcuuugauggccacuuucagaaugagaccaauguucgcagucgggcuauuauuucgcagauuaacaucuagagaaguucuccuucucacgguuggauugagucugguggcaucuguagaacuaccaaauuccuuagacgagcuaggggauggacuugcaaugggcaucaugauauugaaauuacugacugauuuucaaucacaucagcuaugggcuacuuugcugucuuuaacauuugucaaaacaacucuuucacugcacuaugcauggaagacaauggccaugauacugucaauuguaucccuccucccuuuaugccuguccacgacuucucaaaaaacgacauggcuuccagugcuucugggaucucuuggaugcaaaccacuaaccauguuucucauaacagaaaacaaaauuuggggaaggaaaaguuggccucucaaugaaggaaucauggcuguuggaauaguuagcauucuacuaagcucacuucucaaaaaugaugugccacuagcuggcccauuaauagcuggaggcaugcuaauagcauguuaugucauauccggaagcucggccgauuuaucacuggagaaagcagcuaaggucuccugggaagaagaagcagaacacucuggcgccucacacaauauacuagucgagauccaagaugauggaaccaugaagauaaaggaugaagagagagaugacacgaucaccauucuccucaaagcaacccugcuggcaauuucagggguguauccaaugucaauaccggcgacucucuuuguguggcauuuuuggcagaaaaagaaacagagaucaggaguguuaugggacacacccagcccuccagaaguggaaaaagcaguccuugaugauggcauuuauagaauucuccaaagaggauuguugggcaggucucagguaggaguaggaguuuuccaagaaggcguauuccacacaauguggcacgucaccaggggagcuguucucauguaccaagggaagagauuggaaccaaguugggccagugucaaaaaagacuugaucucauauggaggagguuggagguuccaaggauccuggaacaugggagaagaagugcaggugauugcuguugaaccggggaagaacccaaaaaauguacagacagcgccagguaccuucaagacuucugaaggcgaaguuggagccauagcucuagacuucaaacccggcacaucuggaucuccuaucgugaacagagagggaaaaauaguaggucuuuacggaaauggaguggugacaacaaguggaaccuaugucagugccauagcucaagcuaaagcaucacaagaagggccuuugccagagauugaggacgagguguuuaggaaaagaaacuuaacaauaauggaccuacacccaggaucgggaaaaacaagaagauaccuuccagccauaguccgugaggccauaaaaagaaagcugcggacguuaguucuagcucccacaagaguugucgccucugaaauggcagaggcgcucaagggaaugccaauaagguaucagacaacagcagugaagagugaacacacgggaaaggagauaguugaccuuaugugucacgccacuuucacuaugcgucuccuuucuccugugagaguucccaauuauaacaugauaaucauggaugaagcacauuuuaccgauccagccagcauagcagccagaggguacaucucaacccgaguggguaugggugaagcagcugcgauuuucaugacagccaccccccccggaucgguggaggcuuuuccacagagcaaugcaguuauccaagaugaggaaaaagacauuccugaaagaucauggaacucaggcuaugacuggaucacugacuucccaggcaaaacagucugguuuguuccaagcaucaaaucaggaaaugacauugccaacuguuuaagaaagaaugguaaacgggugauccaauuaagcaggaaaacuuuugacacugaguaucagaaaacaaaaaauaacgacugggacuauguugucacaacagacauauccgaaaugggagcaaacuuucgagcugacaggguaauagacccaaggcggugccugaaaccgguuauacugaaagaugguccagagcgugucauucuagccggaccgaugccagugacuguggcuagugccgcccagaggagaggaagaauuggaaggaaccaaaauaaggaaggugaucaguauauuuacaugggacagccucuaaauaaugaugaggaccacgcccauuggacagaagcaaaaaugcuccuugacaacauaaacacaccagaagggaucaucccagcccucuuugagccggaaagagaaaagagugcugcaauagacggggaguacagacuacggggugaagcgaggaaaacguuuguggagcucaugagaagaggagaucuaccugucuggcuaucuuacaaagucgccucagaaggcuuccaauacuccgacagaagauggugcuuugauggggaaaggaacaaccagguguuggaggagaacauggacguggagaucuggacaaaggaaggagaaagaaagaaacugcgaccccgcuggcuggaugccagaacauacucugacccacuggcucugcgcgaauucaaagaguucgcagcaggaagaagaagcgucucaggugaccuaauauuggaaauagggaaacuuccacaacaucuaacgcaaagggcccagaaugcuuuggauaaucugguuaugcugcacaacucugaacaaggaggaaaagcuuauagacacgccauggaagaauugccagacaccauagagacaauaaugcuccuagcucugauagcugugcugacuggcggagugacgcuguucuuccuaucaggaagaggcuuagggaaaacauccauaggccuacucugcgugacguccucaagugcacuguuauggauggccaguguggagccccauuggauagcggccucuauuauacuagaguucuuucugaugguguugcucauuccagagccagauagacagcgcacuccacaagacaaccaguuagcauauguggugauagguuugcuauucaugauauugacaguggcagccaaugagaugggauuauuggaaaccacaaagaaagaccuggggauuggucauacagcugcugaaaaccaccaccacgccgcaauguuggacguggaccuccauccagcuucagccuggacccucuacgcaguagccacaacgauuaucacucccaugaugagacacacaauugaaaacacaacggcaaauauuucccugacagcuauugcaaaccaggcagccauauugaugggacuugauaagggauggccaauaucaaagauggacauaggaguuccacuucucgccuuggggugcuauucucaagugaacccgcugacgcugacagcagcgguacugaugcuaguagcccauuaugccauaauuggaccaggacugcaagcaaaagccacuagagaagcgcaaaaaaggacggcagccggaauaaugaaaaacccaacugucgacgggaucguugcaauagauuuagacccugugguuuaugaugcaaaauuugaaaaacagcuaggccaaauaauguugcugauacuuugcacaucucagauucucuugaugcggaccacaugggccuugugugaauccaucacacuggccacaggaccucugaccacgcuuugggagggaucuccaggaaaauucuggaacaccacgauagcgguguccauggcaaacauuuuuagggguaguuaucuagcaggagcgggucuggccuuuucauuaaugaaaucucugggaggagguaggagagggacgggagcccaaggggaaacauugggagaaaaguggaaaagacagcugaaccaauugagcaagucacaauuuaacaccuacaagaggagugggauuauagaaguagauagaucugaagccaaggagggguugaaaagaggagaaacaaccaaacacgcagugucgagaggaacggccaaacugaggugguuuguggagaggaaccuugugaaaccagaagggaaagucauagaccucgguuguggaagagguggcuggucauauuauugcgcugggcugaagaaagucacagaagugaaaggauacacaaaaggaggaccuggacaugaggaaccgaucccaauggcaaccuauggauggaaucuaguaaagcuacacuccgggaaagauguauucuuuauaccaccugagaaaugugacacucuuuugugugauauuggugaguccucuccgaacccgacuauagaagaaggaagaacguuacguguucuaaagaugguagaaccauggcucagaggaaaccaauuuugcauaaaaauucuaaaucccuauaugccgagugugguagaaacucuggagcaaaugcaaaggaaacauggaggaauguuagugcgaaauccacucucaagaaauuccacucaugaaauguacuggguuucauguggaacaggaaacauugugucagcaguaaauaugacaucuagaaugcugcuaaaccgauucacaauggcucacaggaagccaacauaugaaagagauguggacuugggcgcuggaacgagacauguggcaguagaaccagagguggccaaccuagacaucauuggccagaggauagagaacauaaaaaaugaacacaaaucaacauggcauuaugaugaggacaauccguacaaaacaugggccuaucauggaucauaugaggucaagccaucaggaucagccucauccauggucaaugguguggugagacugcuaaccaaaccaugggaugucauucccauggucacacaaauagccaugacugacaccacacccuuuggacaacaaaggguguuuaaagagaaaguugauacgcgcacaccaaaagcgaaacgaggcacagcacaaaucauggaggugacggccaagugguuaugggguuuccucucuagaaacaaaaaacccagaaucugcacaagagaagaguuuacaagaaaagucaggucaaaugcagcuauuggagcaguguucguugaugaaaaucaauggaacucagcaaaagaagcaguggaagaugaaagguucugggaccuugugcgcagagagagggagcuucauaaacaaggaaaaugugcuacaugugucuacaacaugaugggaaagagagaaaaaaaauuaggagaguucggaaaggcaaaaggaagucgcgcaauaugguacaugugguugggagcgcgcuucuuagaguuugaagcccuuggcuucaugaaugaagaucacugguucagcagagagaauucacucaguggaguggagggagaaggacuccacaaacuuggauacauacucagagauauaucaaagauuccagggggaaauauguaugcagaugacacagccggaugggacacaagaauaacagaggaagaucuucagaaugaggccaaaauuacugacaucauggaaccugaacaugcccuacuggccacgucaaucuuuaagcuaaccuaccaaaauaagguuguaaggguacagagaccagcaaaaaauggaaccgugauggaugucauauccaggcgugaccagagaggaaguggacagguuggaacuuauggcuuaaacaccuucaccaacauggaggcccaacuaauaagacaaauggagucugaaggaaucuuuucaccuagcgaauuggaaaccccaaauuuagccggaagaguccuugacugguuggaaaaacauggcaucgagaggcugagaagaauggcaaucaguggagaugacuguguggugaaaccaauugaugacagauuugcaacagccuuaacagccuugaaugacaugggaaagguaagaaaagacauaccgcaaugggaaccuucaaaaggauggaaugauuggcaacaagugcccuucugcucacaccacuuccaccagcugauuaugaaggaugggagggagauaguggugccaugccgcaaccaagaugaauugguagguagggccagagugucacaaggcgccggauggagcuugagagaaacugcaugucuaggcaagucguaugcacaaauguggcagcugauguacuuccacagaagagacuugagacuagcggcuaaugcuaucuguucagccguuccaguugauugggucccaaccagucgcaccaccuggucgauccaugcccaccaucaauggaugacaacagaagacauguugucaguguggaauagggucuggauagaggaaaacccauggauggaggauaaaacucauguguccaguugggaagacguuccauaccuagggaagagggaagaucaaugguguggaucccuaauaggcuuaacagcacgagccaccugggccaccaacauacagguggccauaaaccaagugagaaggcucauugggaaugagaauuaucuagacuacaugacaucaaugaagagauucaaaaacgagagugauccugaaggggcacucugguaa

SEQ ID NO: 6273 - RNA, 9879 nt, Artificial Sequence
  derived and/or modified CDS sequence (wt) from DENV-1__JQ915080__SS-prME
ucugugaccaugcuccuuaugcugcugcccacaguccugacguuccauuugaccacccgagggggagagccucacaugauaguuagcaaacaggaaagaggaaagucacuuuuguucaagaccucugcaggugucaacaugugcacccuuauugcaauggaccugggagaguuaugugaugacacgaugaccuacaaauguccccggaucacugagacggaaccagaugacguugacuguuggugcaaugccacggagacgugggugaccuauggaacauguucucaaacuggugaacaccgacgagacaaacguuccguugcacuggcaccacacguagggcuuggucuagaaacaagaaccgaaacguggauguccucugaaggcgcuuggagacaaauacaaaaaguggagacaugggcucugagacacccaggauuuacggugauagcccuuuuucuagcacaugccauagggacauccaucacccagaaaggaauuauuuucauuuugcugaugcuggugacuccauccauggccaugcggugugugggaauaggaaacagagacuucguggaaggacugucaggagcuacguggguggauguaguucuggaacauggaaguugcgucacuaccauggcaaaagacaaaccaacacuggacauugaacuccugaagacggaggucacaaacccugccguccugcgcaaacuguguauagaagcuaaaauaucaaauacuaccacugacucgagauguccgacacaaggagaagccacgcugguggaagaacaagacacgaacuuugugugucgacgaacauucguugacagaggcuggggcaaugguuguggacuauucggaaaggguagcuuaauaacgugugcuaaguuuaagugugugacaaaauuggaaggaaagauaguccaauaugaaaacuuaaaauauucugugaucguuacuguccacacuggagaccagcaccaaguuggaaaugagaccacagaacauggaacaauugcaaccauaacaccccaagcucccacgucggaaauacaacugacagacuacggagcucuaacacuggauuguucaccuagaacagggcuagacuuuaaugagaugguguugcugacaaugaaagaaaaaucauggcucguccacaaacaaugguuucuagacuuaccacugccuuggaccacaggggccucaacgucccaagagacuuggaacagacaagacuugcuggucacguuuaagacagcucaugcaaagaagcaggaaguagucguacuaggaucacaagaaggagcaaugcacacugcguugacuggagcgacagaaauccaaacgucuggaacgacaacaauuuuugcaggccaccugaaaugcagauuaaaaauggacaaacuaacucuaaaaggaauaucauauguaaugugcacaggcucauucaaguuagagaaggaaguggcugagacccagcauggaacuguucuaguacaggucaaauacgaaggaacagaugcaccaugcaagauccccuucucgucccaagaugagaagggaguaacccagaaugggagauugguaacagccaaccccauagucacugacaaagaaagaccagucaacauugaagcggagccacccuuuggugagagcuacaucgugguaggagcaggugaaaaagcuuugaaacuaaguugguucaagaagggaagcaguauagggaaaauguuugaagcaacugcccguggagcacgaaggauggccauccugggagacaccgcaugggacuucggcuccauaggaggaguguucacgucugugggaaaacugguacaccagaucuuuggaacugcguauggaguuuuguucagcgguguuucuuggaccaugaaaauaggaauagggauucugcugacauggcugggauuaaacucaaggaguacgucucuuucaaugacguguaucgcaguuggcauggucacacuguaccuaggagucaugguccaggcggacucgggauguguaaucaacuggaaaggcagagaacucaaauguggaaguggcauuuuugucacuaaugaaguucacaccuggacagagcaauacaaauuccaggcugacuccccaaagagacuaucagcagccauugggaaggcaugggaggaggguguguguggaauucgaucagccacucgucucgagaacaucauguggaagcaaauaucaaaugaauuaaaccacaucuuacuugaaaaugacaugaaauuuacagugguaguaggagacguuaguggaaucuuggcccaaggaaagaaaacgauuaggccacaacccauggaacacaaauacucguggaaaaguuggggaaaagccaaaaucauuggagcagauguucagaacacuaccuucaucaucgacggcccaaacaccccagaaugccccgaugaccaaagagcguggaacaucugggaaguugaagacuauggauuuggaauuuucacgacaaacauaugguugaaauugcgcgauuccuacacccaagugugugaccaucgacuaaugucggcugccaucaaggauagcaaagcaguucaugcugacaugggguacuggauagaaagugaaaagaacgagacuuggaaguuggcaagagccuccuucauagaagucaagacaugcgucuggccaaaaucucacacucuauggagcaauggaguccuggaaagugagaugguaaucccaaagauauauggaggaccaauaucucagcacaauuacagaccaggauauuucacacaaacagcagggccguggcacuuaggcaaguuggaacuagauuuugauuugugugaagguaccacagugguuguggaugaacauuguggaaaucgcggaccaucucuuagaaccacaacagucacaggaaagauaauccaugaauggugcugcagaucuugcacguuacccccucuacguuucaaaggagaagacgggugcugguacggcauggaaauuagaccagucaaggagaaggaagagaaccuaguuaagucaauggucucugcagggucaggagaaguggacaguuuuucacuaggacuguuaugcauaucaauaaugaucgaagagguaaugagauccagauggagcaggaaaaugcugaugacuggaacauugguuguguuccuccuucucacauugggacaauugacauggaacgaucugaucaggcuaugcaucaugguuggagccaaugcuucagacaauauggggaugggaacaacguacuuagcuuugauggccacuuucagaaugagaccaauguucgcagucgggcuauuauuucgcagauuaacaucuagagaaguucuccuucucacgguuggauugagucugguggcaucuguagaacuaccaaauuccuuagacgagcuaggggauggacuugcaaugggcaucaugauauugaaauuacugacugauuuucaaucacaucagcuaugggcuacuuugcugucuuuaacauuugucaaaacaacucuuucacugcacuaugcauggaagacaauggccaugauacugucaauuguaucccuccucccuuuaugccuguccacgacuucucaaaaaacgacauggcuuccagugcuucugggaucucuuggaugcaaaccacuaaccauguuucucauaacagaaaacaaaauuuggggaaggaaaaguuggccucucaaugaaggaaucauggcuguuggaauaguuagcauucuacuaagcucacuucucaaaaaugaugugccacuagcuggcccauuaauagcuggaggcaugcuaauagcauguuaugucauauccggaagcucggccgauuuaucacuggagaaagcagcuaaggucuccugggaagaagaagcagaacacucuggcgccucacacaauauacuagucgagauccaagaugauggaaccaugaagauaaaggaugaagagagagaugacacgaucaccauccuccucaaagcaacccugcuggcaaucucagggguguauccaaugucaauaccggcgacucucuuuguguggcauuuuuggcagaaaaagaaacagagaucaggaguguuaugggacacacccagcccuccagaaguagaaaaagcaguccuugaugauggcauuuauagaauucuccaaagaggauuguugggcaggucucagguaggaguaggaguuuuccaagaaggcguauuccacacaauguggcacgucaccaggggagcuguucucauguaccaagggaagagauuggaaccaaguugggccagugucaaaaaagacuugaucucauauggaggagguuggagguuccaaggauccuggaacaugggagaagaagugcaggugauugcuguugaaccggggaagaacccaaaaaauguacagacagcgccggguaccuucaagacuucugaaggcgaaguuggagccauagcucuagacuucaaacccggcacaucuggaucuccuaucgugaacagagagggaaaaauaguaggucuuuacggaaauggaguggugacaacaaguggaaccuaugucagugccauagcucaagcuaaagcaucacaagaagggccuuugccagagauugaggacgagguguuuaggaaaagaaacuuaacaauaauggaccuacacccaggaucgggaaaaacaagaagauaccuuccagccauaguccgugaggccauaaaaagaaagcugcggacguuaguucuagcucccacaagaguugucgccucugaaauggcagaggcacucaagggaaugccaauaagguaucagacaacagcagugaagagugaacacacgggaaaggagauaguugaccuuaugugucacgccacuuucacuaugcgucuccuuucuccugugagaguucccaauuauaacaugauaaucauggaugaagcacauuuuaccgauccagccagcauagcagccagaggguacaucucaacccgaguggguaugggugaagcagcugcgauuuucaugacagccaccccccccggaucaguggaggcuuuuccacagagcaaugcaguuauccaagaugaggaaaaagacauuccugaaagaucauggaacucaggcuaugacuggaucacugacuucccaggcaaaacagucugguuuguuccaagcaucaaaucaggaaaugacauugccaacuguuuaagaaagaaugguaaacgggugauccaauuaagcaggaaaacuuuugacacugaguaucagaaaacaaaaaauaacgacugggacuauguugucacaacagacauauccgaaaugggagcaaacuuucgagcugacaggguaauagacccaaggcggugccugaaaccgguuauacugaaagaugguccagagcgugucauucuagccgggccgaugccagugacuguggcuagugccgcccagaggagaggaagaauuggaaggaaccaaaauaaggaaggugaucaguauauuuacaugggacagccucuaaauaaugaugaggaccacgcccauuggacagaagcaaaaaugcuccuugacaacauaaacacaccagaagggaucaucccagcccucuuugagccggaaagagaaaagagugcugcaauagacggggaguacagacuacggggugaagcgaggaaaacguuuguggagcucaugagaagaggagaucuaccugucuggcuaucuuacaaagucgccucagaaggcuuccaauacuccgacagaagauggugcuuugauggggaaaggaacaaccagguguuggaagagaacauggacguggagaucuggacaaaggaaggagaaagaaagaaacugcgaccccgcuggcuggaugccagaacauacucugacccacuggcucugcgcgaauucaaagaguucgcagcaggaagaagaagcgucucaggugaccuaauauuggaaauagggaaacuuccacaacaucuaacgcaaagggcccagaaugcuuuggauaaucugguuaugcugcacaacucugaacaaggaggaaaagcuuauagacacgccauggaagaauugccagacaccauagagacaauaaugcuccuagcucugauagcugugcugacuggcggagugacgcuguucuuccuaucaggaagaggcuuagggaaaacauccauaggccuacucugcgugacguccucaagugcacuguuauggauggccaguguggagccccauuggauagcggccucuauuauacuagaguucuuucugauggugcugcucauuccagagccagauagacagcgcacuccacaagacaaccaguuagcauauguggugauagguuugcuauucauaauauugacaguggcagccaaugagaugggauuauuggaaaccacaaagaaagaccuggggauuggucauacagcugcugaaaaccaccaccacgccgcaauguuggacguggaccuccauccagcuucagccuggacccucuacgcaguagccacaacgauuaucacucccaugaugagacacacaauugaaaacacaacggcaaauauuucccugacagcuauugcaaaccaggcagccauauugaugggacuugauaagggauggccaauaucaaagauggacauaggaguuccacuucucgccuuggggugcuauucucaagugaacccgcugacgcugacagcagcgguacugaugcuaguagcccauuaugccauaauuggaccaggacugcaagcaaaagccacuagagaagcgcaaaaaaggacggcagccggaauaaugaaaaacccaacugucgacgggaucguugcaauagauuuagacccugugguuuaugaugcaaaauuugaaaaacagcuaggccaaauaauguugcugauacuuugcacaucucagauucucuugaugcggaccacaugggccuugugugaauccaucacacuggccacaggaccucugaccacgcuuugggagggaucuccaggaaaauucuggaacaccacgauagcgguguccauggcaaacauuuuuagggguaguuaucuagcaggagcgggucuggccuuuucauuaaugaaaucucugggaggagguaggagagggacgggagcccaaggggaaacauugggagaaaaguggaaaagacagcugaaccaauugagcaagucacaauuuaacaccuacaagaggagugggauuauagaaguagauagaucugaagccaaggagggguugaaaagaggagaaacaaccaaacacgcagugucgagaggaacggccaaacugaggugguuuguggagaggaaccuugugaaaccagaagggaaagucaucgaccucgguuguggaagagguggcuggucauauuauugcgcugggcugaagaaagucacagaagugaaaggauacacaaaaggaggaccuggacaugaggaaccgaucccaauggcaaccuauggauggaaucuaguaaagcuacacuccgggaaagauguauucuuuauaccaccugagaaaugugacacucuuuugugugauauuggugaguccucuccgaacccgacuauagaagaaggaagaacguuacguguucuaaagaugguagaaccauggcucagaggaaaccaauuuugcauaaaaauucuaaaucccuauaugccgagugugguagaaacucuggagcaaaugcaaaggaaacauggaggaauguuagugcgaaauccacucucaagaaacuccacucaugaaauguacuggguuucauguggaacaggaaacauugugucagcaguaaauaugacaucuagaaugcugcuaaaccgauucacaauggcucacaggaagccaacauaugaaagagauguggacuugggcgcuggaacgagacauguggcaguagaaccagagguggccaaccuagacaucauuggccagaggauagagaacauaaaaaaugaacacaaaucaacauggcauuaugaugaggacaauccguacaaaacaugggccuaucauggaucauaugaggucaagccaucaggaucagccucauccauggucaaugguguggugagacugcuaaccaaaccaugggaugucauucccauggucacacaaauagccaugacugacaccacacccuuuggacaacaaaggguguuuaaagagaaaguugauacgcgcacaccaaaagcgaaacgaggcacagcacaaaucauggaggugacggccaagugguuaugggguuuccucucuagaaacaaaaaacccagaaucugcacaagagaagaguuuacaagaaaagucaggucaaaugcagcuauuggagcaguguucguugaugaaaaucaauggaacucagcaaaagaagcaguggaagaugaaagguucugggaccuugugcgcagagagagggagcuucauaaacaaggaaaaugugcuacaugugucuacaacaugaugggaaagagagaaaaaaaauuaggagaguucggaaaggcaaaaggaagucgcgcaauaugguacaugugguugggagcgcgcuucuuagaguuugaagcccuuggcuucaugaaugaagaucacugguucagcagagagaauucacucaguggaguggagggagaaggacuccacaaacuuggauacauacucagagauauaucaaagauuccagggggaaauauguaugcagaugacacagccggaugggacacaagaauaacagaggaagaucuucagaaugaggccaaaauuacugacaucauggaaccugaacaugcccuacuggccacgucaaucuuuaagcuaaccuaccaaaauaagguuguaaggguacagagaccagcaaaaaauggaaccgugauggaugucauauccaggcgugaccagagaggaaguggacagguuggaacuuauggcuuaaacaccuucaccaacauggaggcccaacuaauaagacaaauggagucugaaggaaucuuuucaccuagcgaauuggaaaccccaaauuuagccggaagaguccuugacugguuggaaaaacauggcaucgagaggcugagaagaauggcaaucaguggagaugacuguguggugaaaccaauugaugacagauuugcaacagccuuaacagccuugaaugacaugggaaagguaagaaaagacauaccgcaaugggaaccuucaaaaggauggaaugauuggcaacaagugcccuucugcucacaccacuuccaccagcugauuaugaaggaugggagggagauaguggugccaugccgcaaccaagaugaauugguagguagggccagagugucacaaggcgccggauggagcuugagagaaacugcaugucuaggcaagucguaugcacaaauguggcagcugauguacuuccacagaagagacuugagacuagcggcuaaugcuaucuguucagccguuccaguugauugggucccaaccagucgcaccaccuggucgauccaugcccaccaucaauggaugacaacagaagacauguugucaguguggaauagggucuggauagaggaaaacccauggauggaggauaaaacucauguguccaguugggaagacguuccauaccuagggaagagggaagaucaaugguguggaucccuaauaggcuuaacagcacgagccaccugggccaccaacauacagguggccauaaaucaagugagaaggcucauugggaaugagaauuaucuagacuacaugacaucaaugaagagauucaaaaacgagagugauccugaaggggcacucugguaa

SEQ ID NO: 6274 - RNA, 9879 nt, Artificial Sequence
  derived and/or modified CDS sequence (wt) from DENV-1__KJ755855__SS-prME
ucugugaccaugcuccuuaugcugaugccuacagccuuggcguuccauuugacuacacgagggggagagccgcacaugauagucagcaagcaggaaagaggaaagucacuuuuguucaagaccucagcaggugucaacaugugcacccuuauagcgauggauuugggagaguuaugugaggacacaaugacuuacaaaugcccccggaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagagcugaaacguggauguccucugaaggcgcuuggaaacagauacaaagaguggagacuugggcccugagacacccaggauucacggugauagcccuuuuccuagcacaugccauaggaacauccaucacccagaaagggauuauuuucauuuuguuaaugcugguaacaccauccauggccaugcgaugugugggaauaggcagcagggacuucguggaaggacugucaggagcaacuuggguagauguggaacuggaacauggaaguugcgucaccaccauggcuaaagacaaaccaacacuggacauugaacucuugaagacggaagucacaaacccugccguccugcgcaaacugugcauugaagccaaaauaucaaacaccaccacugacucaagauguccaacacaaggagaagccacauugguggaagaacaggacgcgaacuuugugugucgacgaacguuuguggacagaggcuggggcaauggcugugagcucuucggaaaaggaagccuacuaacgugugcuaaguuuaagugugugacaaaacuggaaggaaagauaguucaauaugaaaacuugaaauauucaguaauagucaccguccacauugccgcccagcaucaggugggaaaugaaagcacagaacaugggacaacugcaauuauaacaccucaagcucccacgacggaaauacagcugaccgacuacggagcucuuacauuggauuguucaccuagaacaggauuagacuucaaugaaaugguguuguugacaaugaaagaaaaaucauggcuaguccacaaacaaugguuucuagacuuaccacugccuuggaccucgggagcuucaacaucacaagagacuuggaacagacuuuuuuuguuggugacauuuaagacagcucaugcaaagaagcaggaaguagucguacuaggaucacaagaaggagcaaugcacacugcguugaccggagcgacagcacuccaaacauuuggaacgacaacaauuuuugcaggacacuugaacauucgacuaaagauggacaaacugacucuaaaagggaugucauaugugaugugcacaggcucauucaagcuugaaaaagaaguggcugagacccagcauggaaccauucuagugcagauuaaauacgaaggaacagaugcaccaugcaagauuccuuuuucgacccaagaugaaaaaggaguaacccagaaugggagauugauaacggccaaccccauagucacugacaaagaaaaaccagucaacauugaggcagaaccaccuuuuggugagaguuacaucgugauaggagcaggugaaaaagcuuugaaacuaagcugguucaagaaaggaagcagcauaggaaaaauguuugaggcaacugccagaggagcacgaaggauggccauacugggagacacugcaugggacuuugguuccauaggaggaguguucacgucuguuggaaaauuaguacaucagauuuuuggaacugcauauggaguuuuguucagcgguguuuccuggaccaugaaaauaggaauagggguucugcugacaugguuaggauuaaacucaaggagcacgucccucucgaugacgugcauugcaguuggccuaguaacacuauaccuaggagucaugguucaggcggauucaggaugcguaauuaauuggaaaggcagagaacucaaauguggaaguggcauuuuugucaccaaugaaguucacacuuggacagagcaauacaaauuucaagcugacuccccaaaaagacuaucagcagccaucgggaaggcaugggaggaggguguguguggaauucgaucagccacucgucucgagaacaucauguggaagcagauuucaaaugaacugaaccacaucuuacuugaaaaugaccugaaauucacagugguuguaggagauguugcugggaucuuggcucaagggaagaaaaugauuaggccacaacccauggaacacaaauacucguggaaaaauuggggaaaggcuaaaaucauaggggcagauguacagaacuccaccuucaucauugacggcccaaacaccccagaaugcucugaugaccaaagagcauggaacauuugggaaguugaggacuauggauuuggaauuuucacgacaaacauauggcugaaauugcgugacuccuacacccaagugugugaccaccggcuaaugucagcugccaucaaggacagcaaggcaguucacgcugacaugggguacuggauagaaagugaaaagaacgagaccuggaagcuggcaagagccuccuucauagaaguuaaaacauguacuuggccaaaaucccacacucuauggagcaauggaguucuggaaagugaaaugauaauuccaaagaucuauggaggaccaauaucucagcauaacuacagcccaggauacuucacacaaacggcagggccguggcaccuaggcaaguuggaguuggauuuugauuugugugaggguaccacagucguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccagucaaggaaaaggaagagaaucuagucaaaucaauggucucugcagggucaggggaaguggucagucuuucacuaggacugcuaugcauaucaauaaugaucgaagaggugaugagauccagauggaguagaaaaaugcugaugacuggaacacuggcuguguucuuucgaaaaauaaggggacaauugacauggaaugaucugaucagauuaugcaucaugguuggagccaacgcuuccgacagaauggggacgcgaacaacguaccuagcucugauggccacuuuuaaaaugagaccaauguuuucuguagggcuauuauuccgcagacuaacauccagagaaguucuucuucuaaccauuggauugagucuaguggcaucuguggaguuaccaaauuccuuggaggagcuggggguuuuacuugcaaugggcauuaugauuuuaacauuauugacugacuuucaaucacaucaguugugggcuaccuugcuguccaugacauuuaucaaaacaacguuuuccuugcacuauacauggaagacaauggcuaugguacugucaauuguaucucucuuccccuuaugccuguccacgaccucccagaaaacaacauggcuuccggugcuauugggaucucuuggaugcaaaccacuaaccauguuucuuauagcagaaaacaaaaucuggggaaggaaaagcuggccccucaaugaagggaucauggcuguuggaauagucagcauccuacuaaguucacuccucaaaaaugaugugccgcuagcugggccacuaauagcuggagguaugcuaauagcauguuauguuauaucuggaagcucagccgaccuaucacuagagaaagcagcugaggucuccugggaagaagaagcagaacacucuggugccucacacaacauauuaguggagguucaagacgauggaaccaugaagauaaaggacgaagagagagaugacacgcuaaccauucuccuuaaagcaacucugcuagcaguuucagggguguacccauuaucaauaccagcgacccuuuuugugugguacuucuggcagaaaaagaaacagagaucuggaguguuaugggacacaccuagcccuccaaaaguggaaaaagcaguucuugaugaugguaucuauagaauuaugcagagaggacuguuggguaggucccaaguagggguaggaguuuuucaagaaaacguguuccauacaauguggcaugucaccaggggagcuguacucauguaucaagggaagagacuggaaccgagcuggggcagagucaaaaaagaccugauuucuuauggaggagguugggggcuuaaaggaucauggaacacgggagaagaagugcaggugauugcuguugaaccagggaaaaaccccaaaaauguacaaacggcgccgggcaccuuuaagaccccugaaggugaaguuggagccauugcccuagauuuuaaacccgguacaucuggaucccccaucgugaacagagaagggaaaauagucggucuuuauggaaauggaguagugacaacaaguggaaccuacgucagugccauagcucaugccaaagcaucacaagaagggccccuaccagagacugaaguugaagcauucaggaaaagaaacuuaacaauaauggaccuacauccaggaucgggaaaaacaagaagauaucuuccagccauaguccgugaggccauaaaaaggaagaugcgcacacuaauucuggcccccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccagcuuagccgccagaggguacaucucaacccgagugggcaugggugaagcagcugcgaucuucaugacagccacucccccaggaucaguggaggccuuuccacagaguaacgcagucauccaagaugaggaaagagacauuccugagagaucauggaacucaggcuaugaguggaucacugacuuuccagguaaaacagucugguucguuccaagcauuaaagcaggaaaugacauugccaacugcuuaagaaagaauggaaaacgagugauucaauugagcaggaagaccuuugauacagaguaccaaaaaacaaaaaauaacgacugggacuacgucgucacaacagacaucuccgaaaugggagcaaacuucccggccgacagggugauagacccaagacggugucugaauccgguaauucuaaaagaugguccagagcgcgucauuuuagcaggaccgaugccagugacuguggccagugccaaccagaggagaggaagaauuggaaggaaccacaauaaagaaggugaucaguacauuuacaugggacagccuuuaaacaacgaugaagaucacgcucacuggacagaagcaaaaaugcuccuugacaauauaaacacaccagaagggauuaucccagcccucuucgagccggagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagauuuggacaaaagaaggagaaagaaagaaauuacgcccccgcuggcuggaugccagaacauacucagacccacuggcccugcgcgagaaaaaagaguuugcagcaggaagaagaagcguuucaggugaucuaauacuagaaauagggaaacuuccacaacacuugacgcaaagggcccagaaugccuuggacaaccuggucauguugcacaacuccgaacaaggaggaagagccuauagacaugcaauggaagaacugccagauaccauagaaacguugaugcuccuagcuuugauagcuguguuaacugguggagugacgcuguucuuccuaucaggaaagggccuagggaaagcggguaacggccuacucugcgugauggcuucaagcgcacugcuauggauggccaauguggagccccauuggauagcggccuccaucauacuggaguucuuccuaaugguguugcuuauuccagagccagacagacaacgcacuccgcaggacaaccagcuggcauauguggugauccguuuguuauucaugauacugacgguagcagccaaugagaugggacugcuggaaaccacaaagaaagacuuagggauuggccaugcggcuguugaaaaucaccaccaugccgcaaugcuggacauagacuuacauccagcuucagccuggacucucuaugcaguggccacaacaauuaucacucccaugaugaggcacacaauugaaaacacaacggcaaacauuucccugacagccauugcaaaccaggcagcuauauugaugggacuugacaaaggauggccuauaucgaagauggacauaggaguuccacuucucgcccugggauuccuaucccaggugaacccacugacgcugacagcggcgguguugaugcuaguggcucauuacgccauaauuggaccuggacugcaagcaaaagcuacuagagaagcucaaaaaaggacagcggccggaauaaugaaaaauccaaccauugauggaauuguugcaauagauuuggacccugugguuuaugaugcaaaauuugagaaacaacuaggccaaauaaugcuguugauacuaugcacaucacagauccucuugaugcggacuacaugggccuugugcgaauccaucacacuggccacuggaccucuguccccacuuugggaaggaucuccaggaaaaucuuggaacaccacgauagcgguuuccauggcaaacauuuucagaggaaguuaucuagcaggagcaggucuggcuuucucauuaaugaaaucucuaggaggagguaggagaggcacgggagcccaaggggaaacacugggagagaaauggaaaagacagcugaaccaacugagcaagacagaauucaacaccuauaaaaggagugggauuauggaaguggacagauccgaagccaaagagggacugaaaagaggagaaacaaccaaacaugcagugucgagaggaaccgccaaacuaaggugguuuguggagaggaaccuugugaaaccagaagggaaagucauagaccucgguuguggaagagguggcuggucauacuauugcgcugggcugaagaaagucucugaagugaggggauauacaaaaggaggaccaggacaugaggaaccaaucccaauggcgaccuauggaugggaccuauuaaaacgguguucggggaaagaauuuuuuuuuauuccaccugagaaaugugauuccuuuuugggugauauuggugaguccucuccaaacccaacuauagaggaaggaagaacgguacgcguucuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguacuggguuucauguggaacaggaaacauugugucagcaguaaacaugacauccagaauguugcuaaaucgauuuacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacuacucaccaaaccaugggauguuauccccaugguuacacaaauagccaugacugacaccacacccuuuggacaacagaggguguuuaaagagaaaguugacacacgcacaccaaaagcaaaacgaggcacagcacaaaucauggaagugacagcuaggugguuauggaguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugaccgguucugggaccuugugcacagagagagggagcuucacaaacagggaaaaugugccacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuucacaaacuuggauauauacucagagacauaucaaagauuccagggggaaacauguaugcagaugacacagccggaugggauacaaggauaacagaggaugaccuccagaaugaggccaaaaucacugacaucauggaacccgaacaugcccuacuggcuaagucaaucuucaagcuaaccuaccaaaauaaggugguaaggguacagagaccagcaaaaaauggaaccgugauggaugucauauccagacgugaccagagaggaaguggccagguuggaacuuauggcuuaaacacuuucaccaacauggaagcccagcugauaagacaaauggagucugaggaaaucuuuucacccaaugaauuagagaccccaaauuuagccgagagaguucucgacuggcuggaaaaauauggcgucgaaaggcugaaaagaauggcaaucagcggagaugacugcguagugaaaccaauugaugauagguuugcgacagccuuaacagcucugaaugauaugggaaaaguaagaaaagauauaccacaaugggaaccuucaaaaggauggaaugauuggcaacaagugccuuuuuguucacaccacuuccaccagcugguuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugccaucuguucagccguuccaguugauuggguuccaaccagccgcaccacuuggucgauccaugcccaccaccaauggaugacaacagaagacaugcugucaguauggaauaggguuuggauagaggaaaacccauggauggaggacaaaacccguguaucuaguugggaagauguuccauaccuaggaaaaagggaagaucaaugguguggaucucugauaggcuuaacagcaagggccaccugggccaccaacauacaaguggccauaaaccaagugagaagacugauugggaaugagaauuauucggauuacaugacaucaaugaagagauucaagaacgagagugaacccgaaggggcacucugguga

SEQ ID NO: 6275 - RNA, 9879 nt, Artificial Sequence
  derived and/or modified CDS sequence (wt) from DENV-1__KF289073__SS-prME
uccgugaccaugcucuucaugcugcugcccacagcccuggcguuccauuugaccacacgagggggagagccacacaugauaguuagcaagcaggaaagaggaaagucacucuuguuuaagaccucugcaggugucaacaugugcacccucauugcgauggauuugggagaguuaugugaggacacaaugaccuacaaaugcccccggaucacugaggcggaaccagaugacguugacugcuggugcaaugccacagacacaugggugaccuaugggacguguucucaaacuggcgaacaccgacgagacaaacguuccgucgcacuggccccacacgugggacuuggucuagaaacaagaaccgaaacguggauguccucugaaggcgccuggaaacaaauacaaaaaguggagacuugggccuugagacacccaggauucacggugauagcccuuuuuuuagcacaugccauaggaacauccaucacccagaaagggauuauuuucauuuugcugaugcugguaacaccaucaauggccaugcgaugcgugggaauaggcaacagagacuucguugaaggacugucaggagcaacguggguggaugugguacuggagcauggaagcugcgucaccaccauggcaaaaaauaaaccaacacuggacauugaacuccugaagacggaggucacgaacccugccgucuugcgcaaacugugcauugaagcuaaaauaucaaaaaccaccaccgauucaagauguccaacacaaggagaagccacacugguggaagaacaagacgcgaacuuugugugucgacgaacguucguggacagaggcugggguaauggcuguggacuauucggaaaaggaagccuacugacgugugcuaaguucaagugugugacaaaacuagaaggaaaaauaguucaauaugaaaacuuaaaauauucagugauagucaccguccacacuggggaccagcaccagguaggaaacgagacuacagaacauggaacaauugcaaccauaacaccucaagcuccuacgucggaaauacagcugaccgacuacggagcccucacauuggacugcucaccuagaacagggcuggacuuuaaugagauggugcuguugacaaugaaagaaaaaucauggcuuguccacaaacaaugguuucuagacuuaccacugccuuggaccucgggggcuucaacaucucaagagacuuggaacagacaagauuugcuggucacauuuaagacagcucaugcaaagaagcaggaaguagucguacugggaucacaagaaggagcaaugcacacugcguugacuggggcgacagaaauccagacgucaggaacgacaacaaucuuugcaggacaccugaaaugcagacuaaaaauggauaaacugacuuugaaagggaugucauaugugaugugcacaggcucauuuaaguuagagaaggaaguggcugagacccagcauggaaccgucuuagugcagguuaaauaugaaggaacagaugcaccaugcaagauuccaauuucaacccaagaugagaaaggagugacccagaaugggagauugauaacagccaaucccauaguuacugacaaagaaaaaccagucaacauugaaacagaaccacccuuuggugagagcuacaucgugauaggggcgggugaaaaagcuuugaaacuaagcugguucaagaaaggaagcagcauagggaaaauguucgaagccaccgcccgaggagcacgaaggauggcuauccugggagacacagcaugggacuucgguuccauaggagggguguucacaucugugggaaaauugguacaccagguuuuuggaaccgcauauggggucuuguucagcgguguuuccuggaccaugaaaauaggaauagggguucugcugacauggcuaggauugaauucaaggagcacgucacucucgaugacgugcauugcaguuggcauggucacacuguaccuaggagucaugguucaagcggacucggggugugugaucaacuggaagggcagagaacucaaauguggaaguggcauuuuugucacuaaugaaguccacacuuggacagagcaauacaaauuccaggcugacuccccaaaaagacugucagcagccauugggaaggcaugggaggagggcguguguggaauucgaucagccacacgucuugagaacaucauguggaagcaaauaucaaaugaauugaaccacauucuacuugaaaaugacaugaaauucacagugguuguaggagaugcuaauggaaucuuggcccaaggaaaaaaaaugauuaggccacaacccauggaacacaaauacucauggaaaagcuggggaaaagccaaaaucauaggggcagacauacagaauaccaccuucaucaucgacggcccagacacuccagaaugccccgaugaccacagagcauggaacauuugggaaguugaggacuauggguuuggaauuuucacgacaaacauauggcugaaacugcgugacuccuacacccaaaugugugaccaccggcuaaugucagcugccaucaaggacagcaaggcaguccaugcugacaugggguacuggauagaaagugaaaagaacgagaccuggaagcuagcgagagccuccuucauagaagucaagacaugcaucuggccaaaaucccacacucuauggaguaauggaguuuuggaaagugaaaugauaaucccaaagauauauggaggaccaauaucucagcacaacuacagaccaggguauuucacacaaacagcagggccauggcaccuaggcaaguuggaacuagacuuugauuugugugaaggcaccacaguuguuguggaugaacauuguggaaaucgagguccaucucuuagaacuacaacagucacaggaaagauaauccaugaauggugcugcagauccugcacguuaccccccuuacgcuucaaaggagaagacggauguugguauggcauggaaaucagaccaguuaaggagaaggaagagaaccuagucaggucaauggucucugcagggucaggagaaguggauaguuuuucauuaggacuacuaugcguaucaauaaugauugaagaagugaugagauccagauggaguagaaagaugcugaugacuggaacauuggcuguuuuccuccuucuuauaaugggacaacugacauggaaugaucugaucagguuaugcaucaugguuggagccaaugcuucagacaggauggggaugggaacaacguaccuagccuugauggccacuuucaaaaugagaccaauguucgcuguugggcuauuauuucgcagacuaacauccagagaaguucuucuucucacaauuggauuaagccugguggcauccguggagcuaccaaauucuuuagaggagcuaggggauggacuugcaaugggcaucaugauguuaaaauuauugacugauuuucaaucacaccaguuauggacuaccuuacugucucugacauuuaucaaaacaacucuuucauuggauuaugcauggaagacaauggcuaugguacugucaaucguaucucucuuuccuuuaugucugucuacgaccucucaaaaaacaacauggcuuccggugcuguuaggaucuuuuggaugcaaaccacuaaccauguuucuuauaacagaaaacaaaaucuggggaaggaaaaguuggccccucaaugaaggaauuauggcuguuggaauaguuaguauucuacuaaguucacuccucaaaaaugaugugccgcuagccggcccacuaauagcuggaggcaugcuaauagcauguuaugucauauccggaagcucagccgauuuaucauuggagaaagcggcugaggucuccugggaagaagaagcagaacacucuggugccucacacaacauauuaguggagguccaagaugauggaacuaugaaaauaaaagaugaagagagagaugacacacucaccauacuccuuaaagcaacucugcuggcagucucagggguguacccaaugucaauaccagcaacccuuuuugugugguauuuuuggcagaaaaagaaacagagaucaggaguguuaugggacacacccagcccuccagaaguggaaagagcaguucuugaugaugguaucuauagaaucuugcaaagaggacuguugggcaggucccaaguaggagugggaguuuuccaagacggcguguuccacacaauguggcacgucaccaggggagcuguccucauguaccaagggaagaggcuggaaccaagcugggccagugucaaaaaagacuugaucucauauggaggagguuggagguuucaaggaucauggaacaugggagaagaagugcaggugauagcuguugaaccaggaaaaaaccccaaaaauguacagacaacgccgggcaccuucaagacccccgaaggcgaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaagcaucacaagaagggccucuaccagagauugaggacgagguguuuaggaaaagaaacuuaacaauaauggaccuacauccaggaucaggaaaaacaagaagauaucuuccagccauaguccgugaggccauaaaaaggaagcugcgcacgcuaaucuuggcucccacaagaguugucgccucugaaauggcagaggcgcucaagggaaugccaauaagauaucagacaacagcaguaaagagugaacacacaggaagggagauaguugaccucaugugccacgccacuuucaccaugcgucucuuaucuccagugagaguucccaauuacaacaugaucaucauggaugaagcacauuuuacugauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugauuucccagguaaaacagucugguuuguuccaagcaucaaaucaggaaaugacauugccaacuguuuaagaaagaacggaaaacgggugauccaauugagcagaaaaaccuuugacacugaguaccagaaaacaaaaaacaaugacugggacuauguugucacaacagacauuuccgaaaugggagcaaauuuccgggccgacaggguaauagacccaaggcggugcuugaaaccgguaauacuaaaagaugguccagagcgcgucauucuagccggaccgaugccagugacuguggccagugcugcccagaggagaggaagaauuggaaggaaccaaaacaaggaaggugaucaguauguuuacaugggacagccuuuaaauaaugaugaggaccacgcucauuggacagaagcaaaaaugcuccuugacaauauaaacacaccagaagggauuaucccagcccucuuugagccggagagaaaaaagagugcagcaauagacggggaguacagacugcggggagaagcaaggaaaacguucguggagcucaugagaagaggagaucuaccaguuuggcuauccuacaaaguugccucagaagguuuccaguacuccgacagaagguggugcuuugauggggaaaggaacaaccagguguuggaggagaacauggacguggagaucuggacaaaggaaggagaaagaaagaaauuacgaccccgcuggcuggaugccagaacauacucugauccauuggcccugcgcgaguuuaaagaguuugcagcaggaagaaggagugucucaggugaccuaauauuagaaauagggaagcuuccacaacauuugacguuaagggcccagaaagcuuuggacaacuuggucauguugcacaacuccgaacaaggaggaaaagccuauagacaugccauggaagaacuaccagacaccauagaaacauugaugcuccuagcuuugauagcugugcugacugguggagugacgcuguucuuccuaucaggaaaaggucuagggaaaacauccauuggccuacuuugugugauggccucaagcgcacuguuauggauggccaguguggaaccccauuggauagcggccuccaucauacuagaguucuuucugauggugcugcucauuccagagccagacagacagcgcacuccacaggacaaccagcuagcauauguggugauagguuuguuauucaugauauugacaguggcagccaaugagaugggauuauuggaaaccacaaagaaagaccuggggauuggccauguagcugccgaaaaccaccaccaugcuacaaugcuggacguagaccuacguccagcuucagccuggacccucuaugcaguagccacaacaauuaucacucccaugaugagacacacaauugaaaacacaacggcaaauauuucccugacagccauugcaaaucaggcagcuauauugaugggacuugacaagggauggccaauaucgaagauggacauaggagucccacuucucgccuuagggugcuauucccaggugaacccauugacacugacagcggcgguguugaugcuaguggcucauuaugccauaauuggaccaggacugcaagcaaaggcuacuagagaagcucaaaaaaggacagcggccggaauaaugaaaaauccaacuguagacgggauuguugcaauagacuuggauccugugguuuacgaugcaaaauuugaaaaacagcuaggccaaauaauguuacugauacuuugcacaucacagauucucuugaugcggaccacaugggccuugugugaaucaaucacacuggcuacuggacccuugaccacucuuugggagggaucuccaggaaaauucuggaauaccacgauagcaguguccauggcaaacaucuucaggggaaguuaucuagcaggagcaggucuggccuucucauugaugaaaucuuuaggaggagguaggagagguacaggagcucaaggggaaacacugggagaaaaauggaaaagacagcuaaaccaacugagcaagucagaauucaacacuuacaaaaggagugggauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugcgcugggcugaagaaagucacagaagugaagggauauacaaaaggaggaccuggacaugaggaaccuaucccaauggcgacuuauggauggaaccuagugaagcuacacucuggaaaagauguguucuuuacaccaccugagaaaugugacacccuuuugugugauauuggugaguccucuccgaauccaacuauagaagaaggaagaacguuacguguucuaaagaugguggaaccauggcucagaggaaaccaguuuugcauaaaaauccuaaauccuuacaugccaagugugguagaaacucuggagcaaaugcaaagaaaacauggagggaugcuagugcgaaacccacucucaagaaauucuacccaugaaauguacuggguuucauguggaacaggaaacauugugucggcagugaacaugacauccagaauguugcugaaucgguucacaaugacucacaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaggacaauccauacaaaacaugggccuaucauggaucauaugaggucaagccaucaggaucagccucaucuaugguaaauggcguggugagauugcucaccaaaccaugggauguuauccccauggucacacaaauagcuaugacugauaccacacccuucggacaacagaggguguuuaaagagaaaguugacacgcgcacaccaagagcaaaacgaggcacagcacaaauuauggaggugacagccaagugguuaugggguuuccuuucuagaaacaaaaaacccagaaucugcacaagagaggaguucacaagaaaaguuaggucaaacgcagcaauuggagcaguguucguugaugaaaaccaauggaacucagcaaaagaagcaguggaagacgaaagguuuugggaucucgugcacagagagagggagcuucauaaacagggaaaaugugccacgugugucuacaauaugauggggaagagagagaaaaaauuaggagaguuuggaaaggcaaaaggaagucgugcaauaugguacaugugguugggagcacgcuuucuagaguucgaagcccuugguuucaugaaugaagaucacugguucaguagagagaauucacucaguggaguggaaggagaaggacuacacaaacuuggauacauacucagagacauaucaaagauuccagggggaaauauguaugcagaugauacaaccggaugggacacaagaauaacagaggaugaccuucagaaugaggcuaaaaucacugacaucauggagcccgaacaugcucuauuggcuacgucaaucuuuaagcugaccuaccaaaauaaggugguaagggugcaaagaccagcaaaaaguggaaccgugauggauguuauauccagacgugaccagagaggaaguggacaggucggaacuuauggcuuaaauacauucaccaacauggagguccaacuaauaagacaaauggagucugagggaaucuuuuuacccagcgaauuggaaaccccuaaucuagcugagagaguucucgacugguuggaaaaacauggcgucgaaaggcugaaaagaauggcaauuagcggagaugacuguguggugaaaccaacugaugacagguucgcaacagccuuaacagcucugaaugacaugggaaaaguaagaaaagacauaccgcaaugggaaccuucaaaaggauggaaugacuggcagcaagugccuuucuguucacaccauuuccaccagcugaucaugaaggaugggagggagauaguggugccaugccgcaaccaagaugaacuuaugggcagggccagaguaucacaaggcgccggauggagccugagagaaacugcuugccuaggcaagucauaugcacaaauguggcagcugauguacuuccacaggagagaccugagauuagcggcuaaugcuaucuguucagccgucccaguugauugggucccaaccagccgcaccaccuggucgauccaugcccaccaccaauggaugacaacagaagacauguugucaguauggaauaggguuuggauagaggaaaacccauggauggaggacaaaacucauguauccaguugggaagauguuccauacuuaggaaaaagggaagaucaaugguguggaucccugauaggcuuaacagcaagggccaccugggccaccaacauacaaguagccauaaaccaagugagaaggcucaucgggaaugagaauuaucuagauuacaugacaucaaugaagagauucaagaaugagagugaucccgaaggggcacucugguaa

SEQ ID NO: 6276 - RNA, 9879 nt, Artificial Sequence
  derived and/or modified CDS sequence (wt) from DENV-1__JQ915072__SS-prME
ucugugaccaugcuccucaugcugcugcccacaguccugacguuccauuugaccacccgagggggagagccucacaugauaguuagcaaacaggaaagaggaaagucacuuuuguucaagaccucugcaggugucaacaugugcacccuuauugcaauggaccugggagaguuaugugaugacacgaugaccuacaaauguccccggaucacugagacggaaccagaugacguugacuguuggugcaaugccacggagacgugggugaccuauggaacauguucucaaacuggugaacaccgacgagacaaacguuccguugcacuggcaccacacguagggcuuggucuagaaacaagaaccgaaacguggauguccucugaaggcgcuuggagacaaauacaaaaaguggagacaugggcucugagacacccaggauuuacggugauagcccuuuuucuagcacaugccauaggaacauccaucacccagaaaggaauuauuuucauuuugcugaugcuggugacuccauccauggccaugcggugcgugggaauaggaaacagagacuucguggaaggacugucaggagcuacguggguggauguaguucuggagcauggaaguugcgucacuaccauggcaaaagacaaaccaacacuggacauugaacuccugaagacggaggucacaaacccugccguccugcgcaaauuguguauagaagcuaaaauaucaaauacuaccacugacucgagauguccgacacaaggagaagccacgcugguggaagaacaagacacgaacuuugugugucgacgaacauucguugacagaggcuggggcaaugguuguggacuauucggaaaggguagccuaauaacgugugcuaaguucaagugugugacaaaauuggaaggaaagauaguccaauaugaaaacuuaaaauauucugugaucguuacuguccacacuggagaccagcaccaaguuggaaaugagaccacagaacauggaacaauagcaaccauaacaccccaagcucccacgucggaaauacaacugacagacuacggagcucuaacacuggauuguucaccuagaacagggcuagacuuuaaugagaugguguugcugacaaugaaagaaaaaucauggcucguccacaaacaaugguuucuagacuuaccacugccuuggaccacaggggccucaacgucccaagagacuuggaacagacaagacuugcuggucacguuuaagacagcucaugcaaagaagcaggaaguagucguacuaggaucacaagaaggagcaaugcacacugcguugacuggagcgacagaaauccaaacgucuggaacgacaacaauuuuugcaggccaccugaaaugcagauuaaaaauggacaaacuaacucuaaaaggaauaucauauguaaugugcacaggcucauucaaguuagagaaggaaguggcugagacccagcauggaacuguucuaguacaggucaaauacgaaggaacagaugcaccaugcaagauccccuucucgucccaagaugagaagggaguaacccagaaugggagauugguaacagccaaccccauagucacugacaaagaaaaaccagucaacauugaagcggagccacccuuuggugagagcuacaucgugguaggagcaggugaaaaagcuuugaaacuaaguugguucaagaagggaagcaguauagggaaaauguuugaagcaacugcccguggagcacgaaggauggccauccugggagacaccgcaugggacuucggcucuauaggaggaguguucacgucugugggaaaacugguacaccagaucuuuggaacugcguauggaguuuuguucagcgguguuucuuggaccaugaaaauaggaauagggauucugcugacauggcugggauuaaacucaaggagcacgucccuuucaaugacguguaucgcaguuggcauggucacacuguaccuaggagucaugguccaggcggacucgggauguguaaucaacuggaaaggcagagaacucaaauguggaagcggcauuuuugucacuaaugaaguucacaccuggacagagcaauacaaauuccaggcugacuccccaaagagacuaucagcagccauugggaaggcaugggaggaggguguguguggaauucgaucagccacucgucucgagaacaucauguggaagcaaauaucaaaugaauuaaaccacaucuuacuugaaaaugacaugaaauuuacagugguaguaggagacguuaguggaaucuuggcccaaggaaagaaaacgauuaggccacaacccauggaacacaaauacucguggaaaaguuggggaaaagccaaaaucauuggagcagauguucagaacacuaccuucaucaucgacggcccaaacaccccagaaugccccgaugaccaaagagcguggaacaucugggaaguugaagacuauggauuuggaauuuucacgacaaacauaugguugaaauugcgugauuccuacacccaagugugugaccaucgacuaaugucggcugccaucaaggauagcaaagcaguucaugcugacaugggguacuggauagaaagugaaaagaacgagacuuggaaguuggcaagagccuccuucauagaagucaagacaugcgucuggccaaaaucucacacucuauggagcaauggaguccuggaaagugagaugauaaucccaaagauauauggaggaccaauaucucagcacaauuacagaccaggauauuucacacaaacagcagggccguggcacuuaggcaaguuggaacuagauuuugauuugugugaagguaccacagugguuguggaugaacauuguggacaucgcggaccaucucuuagaaccacaacagucacaggaaagauaauccaugaauggugcugcagaucuugcacguuacccccucuacguuucaaaggagaagacgggugcugguacggcauggaaauuagaccagucaaggagaaggaagagaaccuaguuaagucaauggucucugcagggucaggagaaguggacaguuuuucacuaggacuguuaugcauaucaauaaugaucgaagagguaaugagauccagauggagcaggaaaaugcugaugacuggaacauugguuguguuccuccuucucacauugggacaauugacauggaacgaucugaucaggcuaugcaucaugguuggagccaaugcuucagacaauauggggaugggaacaacguacuuagcucugauggccacuuucagaaugagaccaauguucgcagucgggcuauuauuucgcagauuaacaucuagagaaguucuccuucucacgguuggauugagucugguggcaucuguagaacuaccaaauuccuuagacgagcuaggggauggacuugcaaugggcaucaugauauugaaauuacugacugauuuucaaucacaucagcuaugggccacuuugcugucucuaacauuugucaaaacaacucuuucacugcacuaugcauggaagacaauggccaugauacugucaauuguaucccuccucccuuuaugccuguccacgacuucucaaaaaacgacauggcuuccagugcuucugggaucucuuggaugcaaaccacuaaccauguuucucauaacagaaaacaaaaucuggggaaggaaaaguuggccucucaaugaaggaaucauggcuguuggaauaguuagcauucuacuaagcucacuucucaaaaaugaugugccacuagcuggcccauuaauagcuggaggcaugcuaauagcauguuaugucauauccggaagcucggccgauuuaucacuggagaaagcagcuaaggucuccugggaagaagaagcagaacacucuggcgccucacacaauauacuagucgagauccaagaugauggaaccaugaagauaaaggaugaagagagagaugacacgaucaccauccuccucaaagcaacccugcuggcaaucucagggguguauccaaugucaauaccggcgacucucuuuguguggcauuuuuggcagaaaaagaaacagagaucaggaguguuaugggacacacccagcccuccagaaguggaaaaagcaguccuugaugauggcauuuauagaauucuccaaagaggauuguugggcaggucucagguaggaguaggagucuuccaagaaggcguauuccacacaauguggcacgucaccaggggagcuguucucauguaccaagggaagagauuggaaccaaguugggccagugucaaaaaagacuugaucucauauggaggagguuggagguuucaaggauccuggaacaugggagaagaagugcaggugauugcuguugaaccggggaagaacccaaaaaauguacagacagcgccagguaccuucaagacuucugaaggcgaaguuggagccauagcucuagacuucaaacccggcacaucuggaucuccuaucgugaacagagagggaaaaauaguaggucuuuacggaaauggaguggugacaacaaguggaaccuaugucagugcuauagcucaagcuaaagcaucacaagaagggccuuugccagagauugaggacgagguguuuaggaaaagaaacuuaacaauaauggaccuacacccaggaucgggaaaaacaagaagauaccuuccagccauaguccgugaggccauaaaaagaaagcugcggacguuaguucuagcucccacaagaguugucgccucugaaauggcagaggcgcucaagggaaugccaauaagguaucagacaacagcagugaagagugaacacacgggaaaggagauaguugaccuuaugugucacgccacuuucacuaugcgucuccuuucuccugugagaguucccaauuauaacaugauaaucauggaugaagcacauuuuaccgauccagccagcauagcagccagaggguacaucucaacccgaguggguaugggugaagcagcugcgauuuucaugacagccaccccccccggaucgguggaggcuuuuccacagagcaaugcaguuauccaagaugaggaaaaagacauuccugaaagaucauggaacucaggcuaugacuggaucacugacuucccaggcaaaacagucugguuuguuccaagcaucaaaucaggaaaugacauugccaacugucuaagaaagaaugguaaacgggugauccaauuaagcaggaaaacuuuugacacugaguaucagaaaacaaaaaauaacgacugggacuauguugucacaacagacauauccgaaaugggagcaaacuuucgagcugacaggguaauagacccaaggcggugccugaaaccggucauacugaaagaugguccagagcgugucauucuagccggaccgaugccagugacuguggcuagugccgcccagaggagaggaagaauuggaaggaaccaaaauaaggaaggcgaucaguauauuuacaugggacagccucuaaauaaugaugaggaccacgcccauuggacagaagcaaaaaugcuccuugacaacauaaacacaccagaagggaucaucccagcccucuuugagccggaaagagaaaagagugcugcaauagacggggaguacagacuacggggugaagcgaggaaaacguuuguggagcucaugagaagaggagaucuacccgucuggcuaucuuacaaagucgccucagaaggcuuccaauacuccgacagaagauggugcuuugauggggaaaggaacaaccagguguuggaggagaacauggacguggagaucuggacaaaagaaggagaaagaaagaaacugcgaccccgcuggcuggaugccagaacauacucugacccacuggcucugcgcgaauucaaagaguucgcagcaggaagaagaagcgucucaggugaccuaauauuggaaauagggaaacuuccacaacaucuaacgcaaagggcccagaaugcuuuggauaaucugguuaugcugcacaacucugaacaaggaggaaaagcuuauagacacgccauggaagaauugccagacaccauagagacaauaaugcuccuagcucugauagcugugcugacuggcggagugacgcuguucuuccuaucaggaagaggcuuagggaaaacauccauaggccuacucugcgugacguccucaagugcacuguuauggauggccaguguggagccccauuggauagcggccucuauuauacuagaguucuuucugaugguguugcucauuccagagccagauagacagcgcacuccacaagacaaccaguuagcauauguggugauaggcuugcuauucaugauauugacaguggcagccaaugagaugggauuauuggaaaccacaaagaaagaccuggggauuggucauacagcugcugaaaaccaccaccacgccgcaauguuggacguggaccuccauccagcuucagccuggacccuuuacgcaguggccacaacgauuaucacucccaugaugagacacacaauugaaaacacaacggcaaauauuucccugacagcuauugcaaaccaggcagcuauauugaugggacuugauaagggauggccgauaucaaagauggacauaggaguuccacuucucgccuuggggugcuauucucaagugaacccgcugacgcugacagcagcgguacugaugcuaguagcccauuaugccauaauuggaccaggacugcaagcaaaagccacuagagaagcgcaaaaaaggacggcagccggaauaaugaaaaacccaacugucgacgggaucguugcaauagauuuagacccugugguuuaugaugcaaaauuugaaaaacagcuaggccaaauaauguugcugauacuuugcacaucucagauucucuugaugcggaccacaugggccuugugugaauccaucacacuggccacaggaccucugaccacgcuuugggagggaucuccaggaaaauucuggaacaccacgauagcgguguccauggcaaacauuuuuaggggcaguuaucuagcaggagcgggucuggccuuuucauuaaugaaaucucugggaggaaguaggagagggacgggagcccaaggggaaacauugggagaaaaguggaaaagacagcugaaccaauugagcaagucagaauuuaacauuuacaagaggagugggauuauagaaguggauagaucugaagccaaggagggguugaaaagaggagaaacaaccaaacacgcagugucgagaggaacggccaaacugaggugguuuguggagaggaaccuugugaaaccagaagggaaagucauagaccucgguuguggaagagguggcuggucauauuauugcgcugggcugaagaaagucacagaagugaaaggauacacaaaaggaggaccuggacaugaggaaccgaucccaauggcaacuuauggauggaaucuaguaaagcuacacuccgggaaagauguauucuuuauaccaccugagaaaugugacacucuuuugugugauauuggugaguccucuccgaacccgacuauagaagaaggaagaacguuacguguucuaaagaugguagaaccauggcucagaggaaaccaauuuugcauaaaaauucuaaaucccuauaugccgagugugguagaaacucuggagcaaaugcaaagaaaacauggaggaaugcuagugcgaaauccacucucaagaaauuccacucaugaaauguacuggguuucauguggaacaggaaacauugugucagcaguaaauaugacaucuagaaugcugcuaaaccgauucacaauggcucacaggaagccaacauaugaaagagauguggacuugggcgcuggaacgagacauguggcaguagaaccagagguggccaaccuagacaucauuggccagaggauagagaacauaaaaaaugaacauaaaucaacauggcauuaugaugaggauaauccguacaaaacaugggccuaucauggaucauaugaggucaagccaucaggaucagccucauccauggucaaugguguggugagacugcuaaccaaaccaugggaugucauucccauggucacacaaauagccaugacugacaccacacccuuuggacaacaaaggguguuuaaagagaaaguugauacgcgcacaccaaaagcgaaacgaggcacagcacaaaucauggaggugacggccaagugguuaugggguuuccucucuagaaacaaaaaacccagaaucugcacaagagaagaguuuacaagaaaagucaggucaaaugcagcuauuggagcaguguucguugaugaaaaucaauggaacucagcaaaagaagcaguggaagaugaaagguucugggaccuugugcgcagagagagggagcuucauaaacaaggaaaaugugcuacauguguuuacaacaugaugggaaagagagaaaaaaaauuaggagaguucggaaaggcaaaaggaagucgcgcaauaugguacauguggcugggagcgcgcuucuuagaguuugaagcccuuggcuucaugaaugaagaucacugguucagcagagagaauucacucaguggaguggagggagaaggacuccacaaacuuggauacauacuuagagauauaucaaagauuccagggggaaauauguaugcagaugacacagccggaugggacacaagaauaacagaggaagaucuucagaaugaggccaaaauuacugacaucauggaaccugaacaugcccuacuggccacgucaaucuuuaagcuaaccuaccaaaauaagguuguaaggguacagagaccagcaaaaaauggaaccgugauggaugucauauccaggcgugaccagagaggaaguggacagguuggaacuuauggcuuaaacaccuucaccaacauggaggcccaacuaauaagacaaauggagucugaaggaaucuuuucaccuagcgaauuggaaacuccaaauuuagccggaagaguccuugacugguuggaaaaacauggcaucgagaggcugagaagaauggcaaucaguggagaugacuguguggugaaaccaauugaugacagauuugcaacagccuuaacagccuugaaugacaugggaaagguaagaaaagacauaccgcagugggaaccuucaaaaggauggaaugauuggcaacaagugcccuucugcucacaccacuuccaccagcugauuaugaaggaugggagggagauaguggugccaugccgcaaccaagaugaauugguagguagggccagagugucacaaggcgccggauggagcuugagagaaacugcaugucuaggcaagucguaugcacaaauguggcagcugauguacuuccacagaagagacuugagacuagcggcuaaugcuauuuguucagccguuccaguugauugggucccaaccagucgcaccaccuggucgauccaugcccaccaucaauggaugacaacagaagacauguugucaguguggaauagggucuggauagaggaaaacccauggauggaggauaaaacucauguguccaguugggaagacguuccauaccuagggaaaagggaagaucaaugguguggaucccuaauaggcuuaacagcacgagccaccugggccaccaacauacagguggccauaaaacaagugagaaggcucauugggaaugagaauuaucuagacuacaugacaucaaugaagagauucaaaaacgagagugauccugaaggggcacucugguaa

SEQ ID NO: 6277 - RNA, 9879 nt, Artificial Sequence
  derived and/or modified CDS sequence (wt) from DENV-1__JQ915071__SS-prME
ucugugaccaugcuccucaugcugcugcccacaguccugacguuccauuugaccacccgagggggagagccucacaugauaguuagcaaacaggaaagaggaaagucacuuuuguucaagaccucugcaggugucaacaugugcacccuuauugcaauggaccugggagaguuaugugaugacacgaugaccuacaaauguccccggaucacugagacggaaccagaugacguugacuguuggugcaaugccacggagacgugggugaccuauggaacauguucucaaacuggugaacaccgacgagacaaacguuccguugcacuggcaccacacguagggcuuggucuagaaacaagaaccgaaacguggauguccucugaaggcgcuuggagacaaauacaaaaaguggagacaugggcucugagacacccaggauuuacggugauagcccuuuuucuagcacaugccauaggaacauccaucacccagaaaggaauuauuuucauuuugcugaugcuggugacuccauccauggccaugcggugcgugggaauaggaaacagagacuucguggaaggacugucaggagcuacguggguggauguaguucuggagcauggaaguugcgucacuaccauggcaaaagacaaaccaacacuggacauugaacuccugaagacggaggucacaaacccugccguccugcgcaaacuguguauagaagcuaaaauaucaaauacuaccacugacucgagauguccgacacaaggagaagccacgcugguggaagaacaagacacgaacuuugugugucgacgaacauucguugacagaggcuggggcaaugguuguggacuauucggaaaggguagcuuaauaacgugugcuaaguuuaagugugcgacaaaauuggaaggaaagauaguccaauaugaaaacuuaaaauauucugugaucguuacuguccacacuggagaccagcaccaaguuggaaaugagaccacagaacauggaacaauugcaaccauaacaccccaagcucccacgucggaaauacaacugacagacuacggagcucuaacacuggauuguucaccuagaacagggcuagacuuuaaugagaugguguugcugacaaugaaagaaaaaucauggcucguccacaaacaaugguuucuagacuuaccacugccuuggaccacaggggccucaacgucccaagagacuuggaacagacaagacuugcuggucacguuuaagacagcucaugcaaagaagcaggaaguagucguacuaggaucacaagaaggagcaaugcacacugcguugacuggagcgacagaaauccaaacgucuggaacgacaacaauuuuugcaggccaccugaaaugcagauuaaaaauggacaaacuaacucuaaaaggaauaucauauguaaugugcacaggcucauucaaguuagagaaggaaguggcugagacccagcacggaacuguucuaguacaggucaaauacgaaggaacagaugcaccaugcaagauccccuucucgucccaagaugagaagggaguaacccagaaugggagauugguaacagccaaccccauagucacugacaaagaaagaccagucaacauugaagcggagccacccuuuggugagagcuacaucgugguaggagcaggugaaaaagcuuugaaacuaaguugguucaagaagggaagcaguauagggaaaauguuugaagcaacugcccguggagcacgaaggauggccauccugggagacaccgcaugggacuucggcucuauaggaggaguguucacgucugugggaaaacugguacaccagaucuuuggaacugcguauggaguuuuguucagcgguguuucuuggaccaugaaaauaggaauagggauucugcugacauggcugggauuaaacucaaggagcacgucucuuucaaugacguguaucgcaguuggcauggucacacuguaccuaggagucaugguccaggcggacucgggauguguaaucaacuggaaaggcagagaacucaaauguggaaguggcauuuuugucacuaaugaaguucacaccuggacagagcaauacaaauuccaggcugacuccccaaagagacuaucagcagccauugggaaggcaugggaggaggguguguguggaauucgaucagccacucgucucgagaacaucauguggaagcaaauaucaaaugaauuaaaccacaucuuacuugaaaaugacaugaaauuuacagugguaguaggagacguuaguggaaucuuggcccaaggaaagaaaacgauuaggccacaacccauggaacacaaauacucguggaaaaguuggggaaaagccaaaaucauuggagcagauguucagaacacuaccuucaucaucgacggcccaaacaccccagaaugccccgaugaccaaagagcguggaacaucugggaaguugaagacuauggauuuggaauuuucacgacaaacauaugguugaaauugcgugauuccuacacccaagugugugaccaucgacuaaugucggcugccaucaaggauagcaaagcaguucaugcugacaugggguacuggauagaaagugaaaagaacgagacuuggaaguuggcaagagccucuuucauagaagucaagacaugcguuuggccaaaaucucacacucuauggagcaauggaguccuggaaagugagaugauaaucccaaagauauauggaggaccaauaucucagcacaauuacagaccaggauauuucacacaaacagcagggccguggcacuuaggcaaguuggaacuagauuuugauuugugugaagguaccacagugguuguggaugaacauuguggaaaucgcggaccaucucuuagaaccacaacagucacaggaaagauaauccaugaauggugcugcagaucuugcacguuacccccucuacguuucaaaggagaagacgggugcugguacggcauggaaauuagaccagucaaggagaaggaagagaaccuaguuaagucaauggucucugcggggucaggagaaguggacaguuuuucacuaggacuguuaugcauaucaauaaugaucgaagagguaaugagauccagauggagcaggaaaaugcugaugacuggaacauugguuguguuccuccuucucacauugggacaauugacauggaacgaucugaucaggcuaugcaucaugguuggagccaaugcuucagacaauauggggaugggaacaacguacuuagcuuugauggccacuuucagaaugagaccaauguucgcagucgggcuauuauuucgcagauuaacaucuagagaaguucuccuucucacgguuggauugagucugguggcaucuguagaacuaccaaauuccuuagacgagcuaggggauggacuugcaaugggcaucaugauauugaaauuacugacugauuuucaaucacaucagcuaugggccacuuugcugucucuaacauuugucaaaacaacucuuucacugcacuaugcauggaagacaauggccaugauacugucaauuguaucccuccucccuuuaugccuguccacgacuucucaaaaaacgacauggcuuccagugcuucugggaucucuuggaugcaaaccacuaaccauguuucucauaacagaaaacaaaaucuggggaaggaaaaguuggccucucaaugaaggaaucauggcuguuggaauaguuagcauucuacuaagcucacuucucaaaaaugaugugccacuagcuggcccauuaauagcuggaggcaugcuaauagcauguuaugucauauccggaagcucggccgauuuaucacuggagaaagcagcuaaggucuccugggaagaagaagcagaacacucuggcgccucacacaauauacuagucgagauccaagaugauggaaccaugaagauaaaggaugaagagagagaugauacgaucaccauccuccucaaagcaacccugcuggcaaucucagggguguauccaaugucaauaccggcgacucucuuuguguggcauuuuuggcagaaaaagaaacagagaucaggaguguuaugggacacacccagcccuccagaaguggaaaaagcaguccuugaugauggcauuuauagaauucuccaaagaggauuguugggcaggucucagguaggaguaggaguuuuccaagaaggcguauuccacacaauguggcacgucaccaggggagcuguucucauguaccaagggaagagauuggaaccaaguugggccagugucaaaaaagacuugaucucauauggaggagguuggagguuucaaggauccuggaacacgggagaagaagugcaggugauugcuguugaaccggggaagaacccaaaaaauguacagacagcgccagguaccuucaagacuucugaaggcgaaguuggagccauagcucuagacuucaaacccggcacaucuggaucuccuaucgugaacagagagggaaaaauaguaggucuuuacggaaauggaguggugacaacaaguggaaccuaugucagugcuauagcucaagcuaaagcaucacaagaagggccuuugccagagauugaggacgagguguuuaggaaaagaaacuuaacaauaauggaccuacacccaggaucgggaaaaacaagaagauaccuuccagccauaguccgugaggccauaaaaagaaagcugcggacguuaguucuagcucccacaagaguugucgccucugaaauggcagaggcgcucaagggaaugccaauaagguaucagacaacagcagugaagagugaacacacgggaaaggagauaguugaccuuaugugucacgccacuuucacuaugcgucuccuuucuccugugagaguucccaauuauaacaugauaaucauggaugaagcacauuuuaccgauccagccagcauagcagccagaggguacaucucaacccgaguggguaugggugaagcagcugcgauuuucaugacagccaccccccccggaucgguggaggcuuuuccacagagcaaugcaguuauccaagaugaggaaaaagacauuccugaaagaucauggaacucaggcuaugacuggaucacugacuucccaggcaaaacagucugguuuguuccaagcaucaaaucaggaaaugacauugccaacuguuuaagaaagaaugguaaacgggugauccaauuaagcaggaaaacuuuugacacugaguaucagaaaacaaaaaauaacgacugggacuauguugucacaacagacauauccgaaaugggagcaaacuuucgagcugacaggguaauagacccaaggcggugccugaaaccgguuauacugaaagaugguccagagcgugucauucuagccggaccgaugccagugacuguggcuagugccgcccagaggagaggaagaauuggaaggaaccaaaauaaggaaggugaucaguauauuuacaugggacagccucuaaauaaugaugaggaucacgcccauuggacagaagcaaaaaugcuccuugacaacauaaacacaccagaagggaucaucccagcccucuuugagccggaaagagaaaagagugcugcaauagacggggaguacagacuacggggugaagcgaggaaaacguuuguggagcucaugagaagaggagaucuaccugucuggcuaucuuacaaagucgccucagaaggcuuccaauacuccgacagaagauggugcuuugauggggaaaggaacaaccagguguuggaggagaacauggacguggagaucuggacaaaagaaggagaaagaaagaaacugcgaccccgcuggcuggaugccagaacauacucugacccacuggcucugcgcgaauucaaagaguucgcagcaggaagaagaagcgucucaagugaccuaauauuggaaauagggaaacuuccacaacaucuaacgcaaagggcccagaaugcuuuggauaaucugguuaugcugcacaacucugaacaaggaggaaaagcuuauagacacgccauggaagaauugccagacaccauagagacaauaaugcuccuagcucugauagcugugcugacuggcggagugacgcuguucuuccuaucaggaagaggcuuagggaaaacauccauaggccuacucugcgugacguccucaagugcacuguuauggauggccaauguggagccccauuggauagcggccucuauuauacuagaguucuuucugaugguguugcucauuccagagccagauagacagcgcacuccacaagacaaccaguuagcauauguggugauagguuugcuauucaugauauugacaguggcagccaaugagaugggauuauuggaaaccacaaagaaagaccuggggauuggucauacagcugcugaaaaccaccaccacgccgcaauguuggacguggaccuccauccagcuucagccuggacccucuacgcaguggccacaacgauuaucacucccaugaugagacacacaauugaaaacacaacggcaaauauuucccugacagcuauugcaaaccaggcagcuauauugaugggacuugauaagggauggccaauaucaaagauggacauaggaguuccacuucucgccuuggggugcuauucucaagugaacccgcugacgcugacagcagcgguacugaugcuaguagcccauuaugccauaauuggaccaggacugcaagcaaaagccacuagagaagcgcaaaaaaggacggcagccggaauaaugaaaaacccaacugucgacgggaucguugcaauagauuuagacccugugguuuaugaugcaaaauuugaaaaacagcuaggccaaauaauguugcugauacuuugcacaucucagauucucuugaugcggaccacaugggccuugugugaauccaucacacuggccacaggaccucugaccacgcuuugggagggaucuccaggaaaauucuggaacaccacgauagcgguguccauggcaaacauuuuuagggguaguuaucuagcaggagcgggucuggccuuuucauuaaugaaaucucugggaggagguaggagagggacgggagcccaaggggaaacauugggagaaaaguggaaaagacagcugaaccaauugagcaagucagaauuuaacaccuacaagaggagugggauuauagaaguagauagaucugaagccagggagggguugaaaagaggagaaacaaccaaacacgcagugucgagaggaacggccaaacugaggugguuuguggagaggaaccuugugaaaccagaagggaaagucauagaccucgguuguggaagagguggcuggucauauuauugcgcugggcugaagaaagucacagaagugaaaggauacacaaaaggaggaccuggacaugaggaaccgaucccaauggcaaccuauggauggaauuuaguaaagcuacacuccgggaaagauguauucuuuauaccaccugagaaaugugacacucuuuugugugauauuggugaguccucuccgaacccgacuauagaagaaggaagaacguuacguguucuaaagaugguagaaccauggcucagaggaaaccaauuuugcauaaaaauucuaaaucccuauaugccgagugugguagaaacucuggagcaaaugcaaaggaaacauggaggaauguuagugcgaaauccacucucaagaaauuccacucaugaaauguacuggguuucauguggaacaggaaacauugugucagcaguaaauaugacaucuagaaugcugcuaaaccgauucacaauggcucacaggaagccaacauaugaaagagauguggacuugggcgcuggaacgagacauguggcaguagaaccagagguggccaaccuagacaucauuggccagaggauagagaacauaaaaaaugaacacaaaucaacauggcauuaugaugaggauaauccguacaaaacaugggccuaucauggaucauaugaggucaagccaucaggaucagccucauccauggucaaugguguggugagacugcuaaccaaaccaugggaugucauucccauggucacacaaauagccaugacugacaccacacccuuuggacaacaaaggguguuuaaagagaaaguugauacgcgcacaccaaaagcgaaacgaggcacagcacaaaucauggaggugacggccaagugguuaugggguuuccucucuagaaacaaaaaacccagaaucugcacaagagaagaguuuacaagaaaagucaggucaaaugcagcuauuggagcaguguucguugaugaaaaucaauggaacucagcaaaagaagcaguggaagaugaaagguucugggaccuugugcgcagagagagggagcuucauaaacaaggaaaaugugccacaugugucuacaacaugaugggaaagagagaaaaaaaauuaggagaguucggaaaggcaaaaggaagucgcgcaauaugguacaugugguugggagcgcgcuucuuagaguuugaagcccuuggcuucaugaaugaagaucacugguucagcagagagaauucacucaguggaguggagggagaaggacuccacaaacuuggauacauacucagagauauaucaaagauuccagggggaaauauguaugcagaugacacagccggaugggacacaagaauaacagaggaagaucuucagaaugaggccaaaauuacugacaucauggaaccugaacaugcccuacuggccacgucaaucuuuaagcuaaccuaccaaaauaagguuguaaggguacagagaccagcaaaaaauggaaccgugauggaugucauauccaggcgugaccagagaggaaguggacagguuggaacuuauggcuuaaacaccuucaccaacauggaggcccaacuaauaagacaaauggagucugaaggaaucuuuucaccuagcgaauuggaaaccccaaauuuagccggaagaguccuugacugguuggaaaaacauggcaucgagaggcugagaagaauggcaaucaguggagaugacuguguggugaaaccaauugaugacagauuugcaacagccuuaacagccuugaaugacaugggaaagguaagaaaagacauaccgcaaugggaaccuucaaaaggauggaaugauuggcaacaagugcccuucugcucacaccacuuccaccagcugauuaugaaggaugggagggagauaguggugccaugccgcaaccaagaugaauugguagguagggccagagugucacaaggcgccggauggagcuugagagaaacugcaugucuaggcaagucguaugcacaaauguggcagcugauguacuuccacagaagagacuugagacuagcggcuaaugcuaucuguucagccguuccaguugauugggucccaaccagucgcaccaccuggucgauccaugcccaccaucaauggaugacaacagaagacauguugucaguguggaauagggucuggauagaggaaaacccauggauggaggauaaaacucauguguccaguugggaagacguuccauaccuagggaaaagggaagaucaaugguguggaucccuaauaggcuuaacagcacgagccaccugggccaccaacauacagguggccauaaaccaagugagaaggcucauugggaaugagaauuaucuagacuacaugacaucaaugaagagauucaaaaacgagagugauccugaaggggcacucugguaa

SEQ ID NO: 6278 - RNA, 9879 nt, Artificial Sequence
  derived and/or modified CDS sequence (wt) from DENV-1__JQ915073__SS-prME
ucugugaccaugcuccucaugcugcugcccacaguccugacguuccauuugaccacccgagggggagagccucacaugauaguuagcaaacaggaaagaggaaagucacuuuuguucaagaccucugcaggugucaacaugugcacccuuauugcaauggaccugggagaguuaugugaugacacgaugaccuacaaauguccccggaucacugagacggaaccagaugacguugacuguuggugcaaugccacggagacgugggugaccuauggaacauguuuucaaacuggugaacaccgacgagacaaacguuccguugcacuggcaccacacguagggcuuggucuagaaacaagaaccgaaacguggauguccucugaaggcgcuuggagacaaauacaaaaaguggagacaugggcucugagacacccaggauuuacggugauagcccuuuuucuagcacaugccauaggaacauccaucacccagaaaggaauuauuuucauuuugcugaugcuggugacuccauccauggccaugcggugcgugggaauaggaaacagagacuucguggaaggacugucaggagcuacguggguggauguaguucuggagcauggaaguugcgucacuaccauggcaaaagacaaaccaacacuggacauugaacuccugaagacggaggucacaaacccugccguccugcgcaaacuguguauagaagcuaaaauaucaaacacuaccacugacucgagauguccgacacaaggagaagccacgcugguggaagaacaagacacgaacuuugugugucgacgaacauucguugacagaggcuggggcaaugguuguggacuauucggaaaggguagcuuaauaacgugugcuaaguuuaagugugugacaaaauuggaaggaaagauaguccaauaugaaaacuuaaaauauucugugaucguuacuguccacacuggagaccagcaccaaguuggaaaugagaccacagaacauggaacaauugcaaccauaacaccccaagcucccacgucggaaauacaacugacagacuacggagcucuaacacuggauuguucaccuagaacagggcuagacuuuaaugagaugguguugcugacaaugaaagaaaaaucauggcucguccacaaacaaugguuucuagacuuaccacugccuuggaccacaggggccucaacgucccaagagacuuggaacagacaagacuugcuggucacguuuaagacagcucaugcaaagaagcaggaaguagucguacuaggaucacaagaaggagcaaugcacacugcguugacuggagcgacagaaauccaaacgucuggaacgacaacaauuuuugcaggccaccugaaaugcagauuaaaaauggacaaacuaacucuaaaaggaauaucauauguaaugugcacaggcucauucaaguuagagaaggaaguggcugagacccagcauggaacuguucuaguacaggucaaauacgaaggaacagaugcaccaugcaagauccccuucucgucccaagaugagaagggaguaacccagaaugggagauugguaacagccaaccccauagucacugacaaagaaaaaccagucaacauugaagcggagccacccuuuggugagagcuacaucgugguaggagcaggugaaaaagcuuugaaacuaaguugguucaagaagggaagcaguauagggaaaauguuugaagcaacugcccguggagcacgaaggauggccauccugggagacaccgcaugggacuucggcucuauaggaggaguguucacgucugugggaaaacugguacaccagaucuuuggaacugcguauggaguuuuguucagcgguguuucuuggaccaugaaaauaggaauagggauucugcugacauggcugggauuaaacucaaggagcacgucccuuucaaugacguguaucgcaguuggcauggucacacuguaccuaggagucaugguccaggcggacucgggauguguaaucaacuggaaaggcagagaacucaaauguggaagcggcauuuuugucacuaaugaaguucacaccuggacagagcaauacaaauuccaggcugacuccccaaagagacuaucagcagccauugggaaggcaugggaggaggguguguguggaauucgaucagccacucgucucgagaacaucauguggaagcaaauaucaaaugaauuaaaccacaucuuacuugaaaaugacaugaaauuuacagugguaguaggagacguuaguggaaucuuggcccaaggaaagaaaacgauuaggccacaacccauggaacacaaauacucguggaaaaguuggggaaaagccaaaaucauuggagcagauguucagaacacuaccuucaucaucgacggcccaaacaccccagaaugccccgaugaccaaagagcguggaacaucugggaaguugaagacuauggauuuggaauuuucacgacaaacauaugguugaaauugcgugauuccuauacccaagugugugaccaucgacuaaugucggcugccaucaaggauagcaaagcaguucaugcugacaugggguacuggauagaaagugaaaagaacgagacuuggaaguuggcaagagccuccuucauagaagucaagacaugcgucuggccaaaaucucacacucuauggagcaauggaguccuggaaagugagaugauaaucccaaagauauauggaggaccaauaucucagcacaauuacagaccaggauauuucacacaaacagcagggccguggcacuuaggcaaguuggaacuagauuuugauuugugugaagguaccacagugguuguggaugaacauuguggacaucgcggaccaucucuuagaaccacaacagucacaggaaagauaauccaugaauggugcugcagaucuugcacguuacccccucuacguuucaaaggagaagacgggugcugguacggcauggaaauuagaccagucaaggagaaggaagagaaccuaguuaagucaauggucucugcagggucaggagaaguggacaguuuuucacuaggacuguuaugcauaucaauaaugaucgaagaggugaugagauccagauggagcaggaaaaugcugaugacuggaacauugguuguguuccuccuucucacauugggacaauugacauggaacgaucugaucaggcuaugcaucaugguuggagccaaugcuucagacaauauggggaugggaacaacguacuuagcuuugauggccacuuucagaaugagaccaauguucgcagucgggcuauuauuucgcagauuaacaucuagagaaguucuccuccucacgguuggauugagucugguggcaucuguagaacuaccaaauuccuuagacgagcuaggggauggacuugcaaugggcaucaugauauugaaauuacugacugauuuucaaucacaucagcuaugggccacuuugcugucucuaacauuugucaaaacaacucuuucacugcacuaugcauggaagacaauggccaugauacugucaauuguaucccuccucccuuuaugccuguccacgacuucucaaaaaacgacauggcuuccagugcuucugggaucucuuggaugcaaaccacuaaccauguuucucauaacagaaaacaaaaucuggggaaggaaaaguuggccucucaaugaaggaaucauggcuguuggaauaguuagcauucuacuaagcucacuucucaaaaaugaugugccacuagcuggcccauuaauagcuggaggcaugcuaauagcauguuaugucauauccggaagcucggccgauuuaucacuggagaaagcagcuaaggucuccugggaagaagaagcagaacacucuggcgccucacacaauauacuagucgagauccaagaugauggaaccaugaagauaaaggaugaagagagagaugacacgaucaccauccuccucaaagcaacccugcuggcaaucucagggguguauccaaugucaauaccggcgacucucuuuguguggcauuuuuggcagaaaaagaaacagagaucaggaguguuaugggacacacccagcccuccagaaguggaaaaagcaguccuugaugauggcauuuauagaauucuccaaagaggauuguugggcaggucucagguaggaguaggagucuuccaagaaggcguauuccacacaauguggcacgucaccaggggagcuguucucauguaccaagggaagagauuggaaccaaguugggccagugucaaaaaagacuugaucucauauggaggagguuggagguuucaaggauccuggaacacgggagaagaagugcaggugauugcuguugaaccggggaagaacccaaaaaauguacagacaacgccagguaccuucaagacuucugaaggcgaagucggagccauagcucuagacuucaaacccggcacaucuggaucuccuaucgugaacagagagggaaaaauaguaggucuuuacggaaauggaguggugacaacaaguggaaccuaugucagugcuauagcucaagcuaaagcaucacaagaagggccuuugccagagauugaggacgagguguuuaggaaaagaaacuuaacaauaauggaccuacacccaggaucgggaaaaacaagaagauaccuuccagccauaguccgugaggccauaaaaagaaagcugcggacguuaguucuagcucccacaagaguugucgccucugaaauggcagaggcgcucaagggaaugccaauaagguaucagacaacagcagugaagagugaacacacgggaaaggagauaguugaccuuaugugucacgccacuuucacuaugcgucuccuuucuccugugagaguucccaauuauaacaugauaaucauggaugaagcacauuuuaccgauccagccagcauagcagccagaggguacaucucaacccgaguggguaugggugaagcagcugcgauuuucaugacagccaccccccccggaucggcggaggcuuuuccacagagcaaugcaguuauccaagaugaggaaaaagacauuccugaaagaucauggaacucaggcuaugacuggaucacugacuucccaggcaaaacagucugguuuguuccaagcaucaaaucaggaaaugacauugccaacuguuuaagaaagaaugguaaacgggugauccaauuaagcaggaaaacuuuugacacugaguaucagaaaacaaaaaauaacgacugggacuauguugucacaacagacauauccgaaaugggagcaaacuuucgagcugacaggguaauagacccaaggcggugccugaaaccggucauacugaaagaugguccagagcgugucauucuagccggaccgaugccagugacuguggcuagugccgcccagaggagaggaagaauuggaaggaaccaaaauaaggaaggugaucaguauauuuacaugggacagccucuaaauaaugaugaggaccacgcccauuggacagaagcaaaaaugcuccuugacaacauaaacacaccagaagggaucaucccagcccucuuugagccggaaagagaaaagagugcugcaauagacggggaguacagacuacggggugaagcgaggaaaacguuuguggagcucaugagaagaggagaucuaccugucuggcuaucuuacaaagucgccucagaaggcuuccaauacuccgacagaagauggugcuuugauggggaaaggaacaaccagguguuggaggagaacauggacguggagaucuggacaaaagaaggagaaagaaagaaacugcgaccccgcuggcuggaugccagaacauacucugacccacuggcucugcgcgaauucaaagaguucgcagcaggaagaagaagcgucucaggugaccuaauauuggaaauagggaaacuuccacaacaucucacgcaaagggcccagaaugcuuuggauaaucugguuaugcugcacaacucugaacaaggaggaaaagcuuauagacacgccauggaagaauugccagacaccauagagacaauaaugcuucuagcucugauagcugugcugacuggcggagugacgcuguucuuccuaucaggaagaggcuuagggaaaacauccauaggccuacucugcgugacguccucaagugcacuguuauggauggccaguguggagccccauuggauagcggccucuauuauacuagaguucuuucugaugguguugcucauuccagagccagauagacagcgcacuccacaagacaaccaguuagcauauguggugauaggucugcuauucaugauauugacaguggcagccaaugagaugggauuauuggaaaccacaaagaaagaccuggggauuggucauacagcugcugaaaaccaccaccacgccgcaauguuggacguggaccuccauccagcuucagccuggacccucuacgcaguggccacaacgauuaucacucccaugaugagacacacaauugaaaacacaacggcaaauauuucccugacagcuauugcaaaccaggcagcuauauugaugggacuugauaagggauggccgauaucaaagauggacauaggaguuccacuccucgccuuggggugcuauucucaagugaacccgcugacgcugacagcagcgguacugaugcuaguagcccauuaugccauaauuggaccaggacugcaagcaaaagccacuagagaagcgcaaaaaaggacggcagccggaauaaugaaaaacccaacugucgacgggaucguugcaauagauuuagacccugugguuuaugaugcaaaauuugaaaaacagcuaggccaaauaauguugcugauacuuugcacaucucagauucucuugaugcggaccacaugggccuugugugaauccaucacacuggccacaggaccucugaccacgcuuugggagggaucuccaggaaaauucuggaacaccacgauagcgguguccauggcaaacauuuuuagggguaguuaucuagcaggagcgggucuggccuuuucauuaaugaaaucucugggaggagguaggagagggacgggagcccaaggggaaacauugggagaaaaguggaaaagacagcugaaccaauugagcaagucagaauuuaacacuuacaagaggagugggauuauagaaguggauagaucugaagccaaggagggguugaaaagaggagaaacaaccaaacacgcagugucgagaggaacggccaaacugaggugguuuguggagaggaaccuugugaaaccagaagggaaagucauagaccucgguuguggaagagguggcuggucauauuauugcgcugggcugaagaaagucacagaagugaaaggauacacaaaaggaggaccuggacaugaggaaccgaucccaauggcaaccuauggauggaaucuaguaaagcuacacuccgggaaagauguauucuuuauaccaccugagaaaugugacacucuuuugugugauauaggugagucuucuccgaacccgacuauagaagaaggaagaacguuacguguucuaaagaugguagaaccauggcucagaggaaaccaauuuugcauaaaaauucuaaaucccuauaugccgagugugguagaaacucuggagcaaaugcaaagaaaacauggaggaauguuagugcgaaauccacucucaagaaauuccacucaugaaauguacuggguuucauguggaacaggaaacauugugucagcaguaaauaugacaucuagaaugcugcuaaaccgauucacaauggcucacaggaagccaacauaugaaagagauguggacuugggcgcuggaacgagacauguggcaguagaaccagagguggccaaccuagacaucauuggccagaggauagagaacauaaaaaaugaacauaaaucaacauggcauuaugaugaggauaauccguacaagacaugggccuaucauggaucauaugaggucaagccaucaggaucagccucauccauggucaaugguguggugagacugcuaaccaaaccaugggaugucauucccauggucacacaaauagccaugacugacaccacacccuuuggacaacaaaggguguuuaaagagaaaguugauacgcgcacaccaaaagcgaaacgaggcacagcacaaaucauggaggugacggccaagugguuaugggguuuccucucuagaaacaaaaaacccagaaucugcacaagagaagaguuuacaagaaaagucaggucaaaugcagcuauuggagcaguguucguugaugaaaaucaauggaacucagcaaaagaagcaguggaagaugaaagguucugggaccuugugcgcagagagagggagcuucauaaacaaggaaaaugugcuacaugugucuacaacaugaugggaaagagagaaaaaaaauuaggagaguucggaaaggcaaaaggaagucgcgcaauaugguacaugugguugggagcgcgcuucuuagaguuugaagcccuuggcuucaugaaugaagaucacugguucagcagagagaauucacucaguggaguggagggagaaggacuccacaaacuuggauacauacuuagagauauaucaaagauuccagggggaaacauguaugcagaugacacagccggaugggacacaagaauaacagaggaagaucuucagaaugaggccaaaauuacugacaucauggaaccugaacaugcccuacuggccacgucaaucuuuaagcuaaccuaccaaaauaagguuguaaggguacagagaccagcaaaaaauggaaccgugauggaugucauauccaggcgugaccagagaggaaguggacagguuggaacuuauggcuuaaacaccuucaccaacauggaggcccaacuaauaagacaaauggagucugaaggaaucuuuucaccuagcgaauuggaaaccccaaauuuagccggaagaguccuugacugguuggaaaaacauggcaucgagaggcugagaagaauggcaaucaguggagaugacuguguggugaaaccaauugaugacagauuugcaacagccuuaacagccuugaaugacaugggaaagguaagaaaagacauaccgcagugggaaccuucaaaaggauggaaugauuggcaacaagugcccuucugcucacaccacuuccaccagcugauuaugaaggaugggagggagauaguggugccaugccgcaaccaagaugaauugguagguagggccagagugucacaaggcgccggauggagcuugagagaaacugcaugucuaggcaagucguaugcacaaauguggcagcugauguacuuccacagaagagacuugagacuagcggcuaaugcuauuuguucagccguuccaguugauugggucccaaccagucgcaccaccuggucgauccaugcccaccaucaauggaugacaacagaagacauguugucaguguggaauagggucuggauagaggaaaacccauggauggaggacaaaacucauguguccaguugggaagacguuccauaccuagggaaaagggaagaucaaugguguggaucccuaauaggcuuaacagcacgagccaccugggccaccaacauacaaguggcuauaaaccaagugagaaggcucauugggaaugagaauuaucuagacuacaugacaucaaugaagagauucaaaaacgagagugauccugaaggggcacucugguaa

SEQ ID NO: 6279 - RNA, 9879 nt, Artificial Sequence
  derived and/or modified CDS sequence (wt) from DENV-1__JQ915075__SS-prME
ucugugaccaugcuccucaugcugcugcccacaguccugacguuccauuugaccacccgagggggagagccucacaugauaguuagcaaacaggaaagaggaaagucacuuuuguucaagaccucugcaggugucaacaugugcacccuuauugcaauggaccugggagaguuaugugaugacacgaugaccuacaaauguccccggaucacugagacggaaccagaugacguugacuguuggugcaaugccacggagacgugggugaccuauggaacauguucucaaacuggugaacaccgacgagacaaacguuccguugcacuggcaccacacguagggcuuggucuagaaacaagaaccgaaacguggauguccucugaaggcgcuuggagacaaauacaaaaaguggagacaugggcucugagacacccaggauuuacggugauagcccuuuuucuagcacaugccauaggaacauccaucacccagaaaggaauuaucuucauuuugcugaugcuggugacuccauccauggccaugcggugcgugggaauaggaaacagagacuucguggaaggacugucaggagcuacguggguggauguaguucuggagcauggaaguugcgucacuaccauggcaaaagacaaaccaacacuggacauugaacuccugaagacggaggucacaaacccugccguccugcgcaaacuguguauagaagcuaaaauaucaaauacuaccacugacucgagauguccgacacaaggagaagccacgcugguggaagaacaggacacgaacuuugugugucgacgaacauucguugacagaggcuggggcaaugguuguggacuauucggaaaggguagcuuaauaacgugugcuaaguuuaagugugcgacaaaauuggaaggaaagauaguccaauaugaaaacuuaaaauauucugugaucguuacuguccacacuggagaccagcaccaaguuggaaaugagaccacagaacauggaacaauugcaaccauaacaccccaagcucccacgucggaaauacaacugacagacuacggagcucuaacacuggauuguucaccuagaacagggcuagacuuuaaugagaugguguugcugacaaugaaagaaaaaucauggcucguccacaaacaaugguuucuagacuuaccacugccuuggaccacaggggccucaacgucccaagagacuuggaacagacaagacuugcuggucacguuuaagacagcucaugcaaagaagcaggaaguagucguacuaggaucacaagaaggagcaaugcacacugcguugacuggagcgacagaaauccaaacgucuggaacgacaacaauuuuugcaggccaccugaaauguagauuaaaaauggacaaacuaacucuaaaaggaauaucauauguaaugugcacaggcucauucaaguuagagaaggaaguggcugagacccagcauggaacuguucuaguacaggucaaauacgaaggaacagaugcaccaugcaagauccccuucucgucccaagaugagaagggaguaacccagaaugggagauugguaacagccaaccccauagucacugacaaagaaagaccagucaacauugaagcggagccacccuuuggugagagcuacaucgugguaggagcaggugaaaaagcuuugaaacuaaguugguucaagaagggaagcaguauagggaaaauguuugaagcaacugcccguggagcacgaaggauggccauccugggagacaccgcaugggacuucggcucuauaggaggaguguucacgucugugggaaaacugguacaccagaucuuuggaacugcguauggaguuuuguucagcgguguuucuuggaccaugaaaauaggaauagggauucugcugacauggcugggauuaaacucaaggagcacgucucuuucaaugacguguaucgcgguuggcauggucacacuguaccuaggagucaugguccaggcggacucgggauguguaaucaacuggaaaggcagagaacucaaauguggaaguggcauuuuugucacuaaugaaguucacaccuggacagagcaauacaaauuccaggcugacuccccaaagagacuaucagcagccauugggaaggcaugggaggaggguguguguggaauucgaucagccacucgucucgagaacaucauguggaagcaaauaucaaaugaauuaaaccacaucuuacuugaaaaugacaugaaauuuacagugguaguaggagacguuaguggaaucuuggcccaaggaaagaaaacgauuaggccacaacccauggaacacaaauacucguggaaaaguuggggaaaagccaaaaucauuggagcagauguucagaacacuaccuucaucaucgacggcccaaacaccccagaaugccccgaugaccaaagagcguggaacaucugggaaguugaagacuauggauuuggaauuuucacgacaaacauaugguugaaauugcgugauuccuacacccaagugugugaccaucgacuaaugucggcugccaucaaggauagcaaagcaguucaugcugacaugggguacuggauagaaagugaaaagaacgagacuuggaaguuggcaagagccucuuucauagaagucaagacaugcguuuggccaaaaucucacacucuauggagcaauggaguccuggaaagugagaugauaaucccaaagauauauggaggaccaauaucucagcacaauuacagaccaggauauuucacacaaacagcagggccguggcacuuaggcaaguuggaacuagauuuugauuugugugaagguaccacagugguuguggaugaacauugcggaaaucgcggaccaucucuuagaaccacaacagucacaggaaagauaauccaugaauggugcugcagaucuugcacguuacccccucuacguuucaaaggagaagacgggugcugguacggcauggaaauuagaccagucaaggagaaggaagagaaccuaguuaagucaauggucucugcggggucaggagaaguggacaguuuuucacuaggacuguuaugcauaucaauaaugaucgaagagguaaugagauccagauggagcaggaaaaugcugaugacuggaacauugguuguguuccuccuucucacauugggacaauugacauggaacgaucugaucaggcuaugcaucaugguuggagccaaugcuucagacaauauggggaugggaacaacguacuuagcuuugauggccacuuucagaaugagaccaauguucgcagucgggcuauuauuucgcagauuaacaucuagagaaguucuccuucucacgguuggauugagucugguggcaucuguagaacuaccaaauuccuuagacgaguuaggggauggacuugcaaugggcaucaugauauugaaauuacugacugauuuucaaucacaucagcuaugggccacuuugcugucucuaacauuugucaaaacaacucuuucacugcacuaugcauggaagacaauggccaugauacugucaauuguaucccucuucccuuuaugccuguccacgacuucucaaaaaacgacauggcuuccagugcuucugggaucucuuggaugcaaaccacuaaccauguuucucauaacagaaaacaaaaucuggggaaggaaaaguuggccucucaaugaaggaaucauggcuguuggaauaguuagcauucuacuaagcucacuucucaaaaaugaugugccacuagcuggcccauuaauagcuggaggcaugcuaauagcauguuaugucauauccggaagcucggccgauuuaucacuggagaaagcagcuaaggucuccugggaagaagaagcagaacacucuggcgccucacacaauauacuagucgagauccaagaugauggaaccaugaagauaaaggaugaagagagagaugacacgaucaccauccuccucaaagcaacccugcuggcaaucucagggguguauccaaugucaauaccggcgacucucuuuguguggcauuuuuggcagaaaaagaaacagagaucaggaguguuaugggacacacccagcccuccagaaguggaaaaagcaguccuugaugauggcauuuauagaauucuccaaagaggauuguugggcaggucucagguaggaguaggaguuuuccaagaaggcguauuccacacaauguggcacgucaccaggggagcuguucucauguaccaagggaagagauuggaaccaaguugggccagugucaaaaaagacuugaucucauauggaggagguuggagguuucaaggauccuggaacacgggagaagaagugcaggugauugcuguugaaccggggaagaacccaaaaaauguacagacagcgccaggcaucuucaagacuucugaaggcgaaguuggagccauagcucuagacuucaaacccggcacaucuggaucuccuaucgugaacagagagggaaaaauaguaggucuuuacggaaauggaguggugacaacaaguggaaccuaugucagugcuauagcucaagcuaaagcaucacaagaagggccuuugccagagauugaggacgagguguuuaggaaaagaaacuuaacaauaauggaccuacacccaggaucgggaaaaacaagaagauaccuuccagccauaguccgugaggccauaaaaagaaagcugcggacguuaguucuggcucccacaagaguugucgccucugaaauggcagaggcgcucaagggaaugccaauaagguaucagacaacagcagugaagagugaacacacgggaaaggagauaguugaccuuaugugucacgccacuuucacuaugcgucuccuuucuccugugagaguucccaauuauaacaugauaaucauggaugaagcacauuuuaccgauccagccagcauagcagccagaggguacaucucaacccgaguggguaugggugaagcagcugcgauuuucaugacagccaccccccccggaucgguggaggcuuuuccacagagcaaugcaguuauccaagaugaggaaaaagacauuccugaaagaucauggaacucaggcuaugacuggaucacugacuucccaggcaaaacagucugguuuguuccaagcaucaaaucaggaaaugacauugccaacuguuuaagaaagaaugguaaacgggugauccaauuaagcaggaaaacuuuugacacugaguaccagaaaacaaaaaauaacgacugggacuauguugucacaacagacauauccgaaaugggagcaaacuuucgagcugacaggguaauagacccaaggcggugccugaaaccgguuauacugaaagaugguccagagcgugucauucuagccggaccgaugccagugacuguggcuagugccgcccagaggagaggaagaauuggaaggaaccaaaauaaggaaggugaucaguauauuuacaugggacagccucuaaauaaugaugaggaucacgcccauuggacagaagcaaaaaugcuccuugacaacauaaacacaccagaagggaucaucccagcccucuuugagccggaaagagaaaagagugcugcaauagacggggaguacagacuacggggugaagcgaggaaaacguuuguggagcucaugagaagaggagaucuaccugucuggcuaucuuacaaagucgccucagaaggcuuccaauacuccgacagaagauggugcuuugauggggaaaggaacaaccagguguuggaggagaacauggacguggagaucuggacaaaagaaggagaaagaaagaaacugcgaccccgcuggcuggaugccagaacauacucugacccacuggcucugcgcgaauucaaagaguucgcagcaggaagaagaagcgucucaagugaccuaauauuggaaauagggaaacuuccacaacaucuaacgcaaagggcccagaaugcuuuggauaaucugguuaugcugcacaacucugaacaaggaggaaaagcuuauagacacgccauggaagaauugccagacaccauagagacaauaaugcuccuagcucugauagcugugcugaccggcggagugacgcuguucuuccuaucaggaagaggcuuagggaaaacauccauaggccuacucugcgugacguccucaagugcacuguuauggauggccaauguggagccccauuggauagcggccucuauuauacuagaguucuuucugaugguguugcucauuccagagccagauagacagcgcacuccacaagacaaccaguuagcauauguggugauagguuugcuauucaugauauugacaguggcagccaaugagaugggauuauuggaaaccacaaagaaagaccuggggauuggucauacagcugcugaaaaccaccaccacgccgcaauguuggacguggaccuccauccagcuucagccuggacccucuacgcaguggccacaacgauuaucacucccaugaugagacacacaauugaaaacacaacggcaaauauuucccugacagcuauggcaaaccaggcagcuauauugaugggacuugacaagggauggccaauaucaaagauggacauaggaguuccacuucucgccuuggggugcuauucucaagugaacccgcugacgcugacagcagcgguacugaugcuaguagcccauuaugccauaauuggaccaggacugcaagcaaaagccacuagagaagcgcaaaaaaggacggcagccggaauaaugaaaaacccaacugucgacgggaucguugcaauagauuuagacccugugguuuaugaugcaaaauuugaaaaacagcuaggccaaauaauguugcugauacuuugcacaucucagauucucuugaugcggaccacaugggccuugugugaauccaucacacuggccacaggaccucugaccacgcuuugggagggaucuccaggaaaauucuggaacaccacgauagcgguguccauggcaaacauuuuuagggguaguuaucuagcaggagcgggucuggccuuuucauuaaugaaaucucugggaggagguaggagagggacgggagcccaaggggaaacauugggagaaaaguggaaaagacagcugaaccaauugagcaagucagaauuuaacaccuacaagaggagugggauuauagaaguagauagaucugaagccagggagggguugaaaagaggagaaacaaccaaacacgcagugucgagaggaacggccaaacugaggugguuuguggagaggaaccuugugaaaccagaagggaaagucauagaccucgguuguggaagagguggcuggucauauuauugcgcugggcugaagaaagucacagaagugaaaggauacacaaaaggaggaccuggacaugaggaaccgaucccaauggcaaccuauggauggaauuuaguaaagcuacacuccgggaaagauguauucuuuauaccaccugagaaaugugacacucuuuugugugauauuggugaguccucuccgaacccgacuauagaagaaggaagaacguuacguguucuaaagaugguagaaccauggcucagaggaaaccaauuuugcauaaaaauuuuaaaucccuauaugccgagugugguagaaacucuggagcaaaugcaaaggaagcauggaggaauguuagugcgaaauccacucucaagaaauuccacucaugaaauguacuggguuucauguggaacaggaaacauugugucagcaguaaauaugacaucuagaaugcugcuaaaccgauucacaauggcucacaggaagccaacauaugaaagagauguggacuugggcgcuggaacgagacauguggcaguagaaccagagguggccaaccuagacaucauuggccagaggauagagaacauaaaaaaugaacacaaaucaacauggcauuaugaugaggauaauccguacaaaacaugggccuaucauggaucauaugaggucaagccaucaggaucagccucauccauggucaaugguguggugagacugcuaaccaaaccaugggaugucauucccauggucacacaaauagccaugacugacaccacacccuuuggacaacaaaggguguuuaaagagaaaguugauacgcgcacaccgaaagcgaaacgaggcacagcacaaaucauggaggugacggccaagugguuaugggguuuccucucuagaaacaaaaaacccagaaucugcacaagagaagaguuuacaagaaaagucaggucaaaugcagcuauuggagcaguguucguugaugaaaaucaauggaacucagcaaaagaagcaguggaagaugaaagguucugggaccuugugcgcagagagagggagcuucauaaacaaggaaaaugugccacaugcgucuacaacaugaugggaaagagagaaaaaaaauuaggagaguucggaaaggcaaaaggaagucgcgcaauaugguacaugugguugggagcgcgcuucuuagaguuugaagcccuuggcuucaugaaugaagaucacugguucagcagagagaauucacucaguggaguggagggagaaggacuccacaaacuuggauacauacucagagauauaucaaagauuccagggggaaauauguaugcagaugacacagccggaugggacacaagaauaacagaggaagaucuucagaaugaggccaaaauuacugacaucauggaaccugaacaugcccuacuggccacgucaaucuuuaagcuaaccuaccaaaauaagguuguaaggguacagagaccagcaaaaaacggaaccgugauggaugucauauccaggcgugaccagagaggaaguggacagguuggaacuuauggcuuaaacaccuucaccaacauggaggcccaacuaauaagacaaauggagucugaaggaaucuuuucaccuagcgaauuggaaaccccaaauuuagccggaagaguccuugacugguuggaaaaacauggcaucgagaggcugagaagaauggcaaucaguggagaugacuguguggugaaaccaauugaugacagauuugcaacagccuuaacagccuugaaugacaugggaaagguaagaaaagacauaccgcaaugggaaccuucaaaaggauggaaugauuggcaacaagugcccuucugcucacaccacuuccaccagcugauuaugaaggaugggagggagauaguggugccaugccgcaaccaagaugaauugguagguagggccagagugucacaaggcgccggauggagcuugagagaaacugcaugucuaggcaagucguaugcacaaauguggcagcugauguacuuccacagaagagacuugagacuagcggcuaaugcuaucuguucagccguuccaguugauugggucccaaccagucgcaccaccuggucgauccaugcccaccaucaauggaugacaacagaagacauguugucaguguggaauagggucuggauagaggaaaacccauggauggaggauaaaacucauguguccaguugggaagacguuccauaccuagggaaaagggaagaucaaugguguggaucccuaauaggcuuaacagcacgagccaccugggccaccaacauacagguggccauaaaccaagugagaaggcucauugggaaugagaauuaucuagacuacaugacaucaaugaagagauucaaaaacgagagugauccugaaggggcacucugguaa

SEQ ID NO: 6280 - RNA, 9879 nt, Artificial Sequence
  derived and/or modified CDS sequence (wt) from DENV-1__JQ915076__SS-prME
ucugugaccaugcuccucaugcugcugcccacaguccugacguuccauuugaccacccgagggggagagccucacaugauaguuagcaaacaggaaagaggaaagucacuuuuguucaagaccucugcaggugucaacaugugcacccuuauugcaauggaccugggagaguuaugugaugacacgaugaccuacaaauguccccggaucacugagacggaaccagaugacguugacuguuggugcaaugccacggagacgugggugaccuauggaacauguucucaaacuggugaacaccgacgagacaaacguuccguugcacuggcaccacacguagggcuuggucuagaaacaagaaccgaaacguggauguccucugaaggcgcuuggagacaaauacaaaaaguggagacuugggcucugagacacccaggauuuacggugauagcccuuuuucuagcacaugccauaggaacauccaucacccagaaaggaauuauuuucauuuugcugaugcuggugacuccauccauggccaugcggugcgugggaauaggaaacagagacuucguggaaggacugucaggagcuacguggguggauguaguucuggagcauggaaguugcgucacuaccauggcaaaagacaaaccaacacuggacauugaacuccugaagacggaggucacaaauccugccguccugcgcaaacuguguauagaagcuaaaauaucaaauacuaccacugacucgagauguccgacacaaggagaagccacgcugguggaagaacaagacacgaacuuugugugucgacgaacauucguugacagaggcuggggcaaugguuguggacuauucggaaaggguagcuuaauaacgugugcuaaguucaagugugugacaaaauuggaaggaaagauaguccaauaugaaaacuuaaaauauucugugaucguuacuguccacacuggagaccagcaccaaguuggaaaugagaccacagaacauggaacaauugcaaccauaacaccccaagcucccacgucggaaauacaacugacagacuacggagcucuaacacuggauuguucaccuagaacagggcuagacuuuaaugagaugguguugcugacaaugaaagaaaaaucauggcucguccacaaacaaugguuucuagacuuaccacugccuuggaccacaggggcuucaacgucccaagagaccuggaacagacaagacuugcuggucacguuuaagacagcucaugcaaagaagcaggaaguagucguacuaggaucacaagaaggagcaaugcacacugcguugacuggagcgacagaaauccaaacgucuggaacgacaacaauuuuugcaggccaccugaaaugcagauuaaaaauggacaaacuaacucuaaaaggaaugucauauguaaugugcacaggcucauucaaguuagagaaggaaguggcugagacccagcauggaacuguucuaguacaggucaaauacgaaggaacagaugcaccaugcaagauccccuucucgucccaagaugagaagggaguaacccagaaugggagauugguaacagccaaccccauagucacugacaaagaaaaaccagucaacauugaagcggagccacccuuuggugagagcuacaucgugguaggagcaggugaaaaagcuuugaaacuaaguugguucaagaagggaagcaguauagggaaaauguuugaagcaacugcccguggagcacgaaggauggccauccugggagacaccgcaugggacuucggcucuauaggaggaguguucacgucugugggaaaacugguacaccagaucuuuggaacugcguauggaguuuuguucagcgguguuucuuggaccaugaaaauaggaauagggauucugcugacauggcugggauuaaacucaaggagcacgucccuuucaaugacguguaucgcagucggcauggucacacuguaccuaggagucaugguccaggcggacucgggauguguaaucaacuggaaaggcagagaacucaaauguggaagcggcauuuuugucaccaaugaaguucacaccuggacagagcaauacaaauuccaggcugacuccccaaagagacuaucagcagccauugggaaggcaugggaggaggguguguguggaauucgaucagccacucgucucgagaacaucauguggaagcaaauaucaaaugaacuaaaccacaucuuacuugaaaaugacaugaaauuuacagugguaguaggagacguuaguggaaucuuggcccaaggaaagaaaacgauuaggccacaacccauggaacacaaauacucguggaaaagcuggggaaaagccaaaaucauuggagcagauguucagaacacuaccuucaucaucgacggcccaaacaccccagaaugccccgaugaccaaagagcguggaacaucugggaaguugaagacuauggauuuggaauuuucacgacaaacauaugguugaaauugcgugauuccuacacccaagugugugaccaucgacuaaugucggcugccaucaaggauagcaaagcaguucaugcugacaugggguacuggauagaaagugaaaagaacgagacuuggaaguuggcaagagccuccuucauagaagucaagacaugcgucuggccaaaaucucacacucuauggagcaauggaguccuggaaagugagaugauaaucccaaagauauauggaggaccaauaucucagcacaauuacagaccaggauauuucacacaaacagcagggccguggcacuuaggcaaguuggaacuagauuuugauuugugugaagguaccacagugguuguggaugaacauuguggacaucgcggaccaucucuuagaaccacaacagucacaggaaagauaauccaugaauggugcugcagaucuugcacguuacccccucuacguuucaaaggagaagacgggugcugguacggcauggaaauuagaccagucaaggagaaggaagagaaccuaguuaagucaauggucucugcagggucaggagaaguggacaguuuuucacuaggacuguuaugcauaucaauaaugaucgaagagguaaugagauccagauggagcaggaaaaugcugaugacuggaacauugguuguguuccuccuucucacauugggacaauugacauggaacgaucugaucaggcuaugcauaaugguuggagccaaugcuucagacaauauggggaugggaacaacauacuuagcuuugauggccacuuucagaaugagaccaauguucgcagucgggcuauuauuucgcagauuaacaucuagagaaguucuccuucucacgguuggauugagucugguggcaucuguagaacuaccaaauuccuuagacgagcuaggggauggacuugcaaugggcaucaugauauugaaauuacugacugauuuucaaucacaucagcuaugggccacuuugcugucucuaacauuugucaaaacaacucuuucacugcacuaugcauggaagacuauggccaugauacugucaauuguaucccuccucccuuuaugccuguccacgacuucucaaaaaacgacauggcuuccagugcuucugggaucucuuggaugcaaaccacuaaccauguuucucauaacagaaaacaaaaucuggggaaggaaaaguuggccucucaaugaaggaaucauggcuguuggaauaguuagcauucuacuaagcucacuucucaaaaaugaugugccacuagcuggcccauuaauagcuggaggcaugcuaauagcauguuaugucauauccggaagcucggccgauuuaucacuggagaaagcagcuaaggucuccugggaagaagaagcagaacacucuggcgccucacacaauauacuagucgagauccaagaugauggaaccaugaagauaaaggaugaagagagagaugacacgaucacaauccuccucaaagcaacccugcuggcaaucucagggguguauccaaugucaauaccggcgacucucuuuguguggcauuuuuggcagaaaaagaaacagagaucaggaguguuaugggacacacccagcccuccagaaguggaaaaagcaguccuugaugauggcauuuauagaauucuccaaagaggauuguugggcaggucucagguaggaguaggagucuuccaagaaggcguauuccacacaauguggcacgucaccaggggagcuguccucauguaccaagggaagagauuggaaccaaguugggccagugucaaaaaagacuugaucucauauggaggagguuggagguuucaaggauccuggaacacgggagaagaagugcaggugauugcuguugaaccggggaagaacccaaaaaauguacagacagcgccagguacuuucaagacuucugaaggcgaaguuggagccauagcucuagacuucaaacccggcacaucuggaucuccuaucgugaacagagagggaaaaauaguaggucuuuacggaaauggaguggugacaacaaguggaaccuaugucagugcuauagcucaagcuaaaacaucacaagaagggccuuugccagagauugaggacgagguguuuaggaaaagaaacuuaacaauaauggaucuacacccaggaucgggaaaaacaagaagauaccuuccagccauaguccgugaggccauaaaaagaaagcugcggacguuaguucuagcucccacaagaguugucgccucugaaauggcagaggcgcucaagggaaugccaauaagguaucagacaacagcagugaagagugaacacacgggaaaggagauaguugaccuuaugugucacgccacuuucacuaugcgucuccuuucuccugugagaguucccaauuauaacaugauaaucauggaugaagcacauuuuaccgauccagccagcauagcagccagaggguacaucucaacccgaguggguaugggugaagcagcugcgauuuucaugacagccaccccccccggaucgguggaggcuuuuccacagagcaaugcaguuauccaagaugaggaaaaagacauuccugaaagaucauggaacucaggcuaugacuggaucacugacuuuccaggcaaaacagucugguuuguuccaagcaucaaaucaggaaaugacauugccaacuguuuaagaaagaaugguaaacgggugauccaauuaagcaggaaaacuuuugacacugaguaucagaaaacaaaaaauaacgacugggacuauguugucacaacagacauauccgaaaugggagcaaacuuucgagcugacaggguaauagacccaaggcggugccugaaaccggucauacugaaagaugguccagagcgugucauucuagccggaccgaugccagugacuguggcuagugccgcccagaggagaggaagaauuggaaggaaccaaaauaaggaaggugaucaguauguuuacaugggacagccucuaaauaaugaugaggaccacgcccauuggacagaagcaaaaaugcuccuugacaacauaaacacaccagaagggaucaucccagcccucuuugagccggaaagagaaaagagugcugcaauagacggggaguacagacuacggggugaagcgaggaaaacguuuguggagcucaugagaagaggagaucuacccgucuggcuaucuuacaaagucgccucagaaggcuuccaauacuccgacagaagauggugcuuugauggggaaaggaacaaccagguguuggaggagaacauggacguggagaucuggacaaaagaaggagaaagaaagaaacugcgaccccgcuggcuggaugccagaacauacucugacccacuggcucugcgcgaauucaaagaguucgcagcaggaagaagaagcgucucaggugaccuaauauuggaaauagggaaacuuccacaacaucuaacgcaaagggcccagaaugcuuuggauaaucugguuaugcugcacaacucugaacaaggaggaaaagcuuauagacacgccauggaagaauugccagacaccauagagacaauaaugcuccuagcucugauagcugugcugacuggcggagugacgcuguucuuccuaucaggaagaggcuuagggaaaacauccauaggccuacucugcgugacguccucaagugcacuguuauggauggccaguguggagccccauuggauagcggccucuauuauacuagaguucuuccugaugguguugcucauuccagagccagauagacagcgcacuccacaagacaaccaguuagcauauguggugauaggcuugcuauucaugauauugacaguggcagccaaugagaugggauuauuggaaaccacaaagaaagaccuggggauuggucauacagcugcugaaaaccaccaccacgccgcaauguuggacguggaccuccauccagcuucagccuggacccucuacgcaguggccacaacgauuaucacucccaugaugagacacacaauugaaaacacaacggcaaauauuucccugacagcuauugcaaaccaggcagcuauauugaugggacuugacaagggauggccgauaucaaagauggacauaggaguuccacuucucgccuuggggugcuauucucaagugaacccgcugacgcugacagcagcgguacugaugcuaguagcccauuaugccauaauuggaccaggacugcaagcaaaagccacuagagaagcgcaaaaaaggacggcagccggaauaaugaaaaacccaacugucgacgggaucguugcaauagauuuagacccugugguuuaugaugcaaaauuugaaaaacagcuaggccaaauaauguugcugauacuuugcacaucucagauucucuugaugcggaccacaugggccuugugugaauccaucacacuggccacaggaccucugaccacgcuuugggagggaucuccaggaaaauucuggaacaccacgauagcgguguccauggcaaacauuuuuagggguaguuaucuagcaggagcgggucuggccuuuucauuaaugaaaucucugggaggagguaggagagggacgggagcccaaggggaaacauugggagaaaaguggaaaagacagcugaaccaauugagcaagucagaauuuaacauuuacaagaggagugggauuauagaaguggauagaucugaagccaaggagggguugaaaagaggagaaacaaccaaacacgcagugucgagaggaacggccaaacugaggugguuuguggagaggaaccuugugaaaccagaagggaaagucauagaccucgguuguggaagagguggcuggucauauuauugcgcugggcugaagaaagucacagaagugaaaggauacacaaaaggaggaccuggacaugaggaaccgaucccaauggcaacuuauggauggaaucuaguaaagcuacacucugggaaagauguauucuuuauaccaccugagaaaugugacacucuuuugugugauauuggugaguccucuccgaacccgacuauagaagaaggaagaacguuacguguucuaaagaugguagaaccauggcucagaggaaaccaauuuugcauaaaaauucuaaaucccuauaugccgagugugguagaaacucuggagcaaaugcaaagaaaacauggaggaauguuagugcgaaauccacucucaagaaauuccacucaugaaauguacuggguuucauguggaacaggaaacauugugucagcaguaaauaugacaucuagaaugcugcuaaaccgauucacaauggcucacaggaagccaacauaugaaagagauguggacuugggcgcuggaacgagacauguggcaguagaaccagagguggccaaccuagacaucauuggccagaggauagagaacauaaaaaaugaacauaaaucaacauggcauuaugaugaggauaauccguacaaaacaugggccuaucauggaucauaugaggucaagccaucaggaucagccucauccauggucaaugguguggugagacugcuaaccaaaccaugggaugucauucccauggucacacaaauagccaugacugacaccacacccuuuggacaacaaaggguguuuaaagagaaaguugauacgcgcacaccaaaagcgaaacgaggcacagcacaaaucauggaggugacggccaagugguuaugggguuuccucucuagaaacaaaaaacccagaaucugcacaagagaagaguuuacaagaaaagucaggucaaaugcagcuauuggagcaguguucguugaugaaaaucaauggaacucagcaaaagaagcaguggaagaugaaagguucugggaccuugugcgcagagagagggagcuucauaaacaaggaaaaugugccacaugugucuacaacaugaugggaaagagagaaaaaaaauuaggagaguucggaaaggcaaaaggaagucgcgcaauaugguacaugugguugggagcgcgcuucuuagaguuugaagcccuuggcuucaugaaugaagaucacugguucagcagagagaauucacucaguggaguggagggagaaggacuccacaaacuuggauacauacuuagagauauaucaaagauuccagggggaaauauguaugcagaugacacagccggaugggacacaagaauaacagaggaagaucuucagaacgaggccaaaauuacugacaucauggaaccugaacaugcccuacuggccacgucaaucuuuaagcuaaccuaccaaaauaagguuguaaggguacagagaccagcaaaaaauggaaccgugauggaugucauauccaggcgugaccagagaggaaguggacagguuggaacuuauggcuuaaacaccuucaccaacauggaggcccaacuaauaagacaaauggagucugaagggaucuuuucaccuagcgaauuggaaacuccaaauuuagccggaaggguccuugacugguuggaaaaacauggcaucgagaggcugagaagaauggcaaucaguggagaugacuguguggugaaaccaauugaugacagauuugcaacagccuuaacagccuugaaugacaugggaaagguaagaaaagacauaccgcagugggaaccuucaaaaggauggaaugauuggcaacaagugcccuucugcucacaccacuuccaccagcugauuaugaaggaugggagggagauaguggugccaugccgcaaccaagaugaauugguagguagggccagagugucacaaggcgccggauggagcuugagagaaacugcaugucuaggcaagucguaugcgcaaauguggcagcugauguacuuccacagaagagacuugagacuagcggcuaaugcuauuuguucagccguuccaguugauugggucccaaccagucgcaccaccuggucgauccaugcccaccaucaauggaugacaacagaagacauguugucaguguggaacagggucuggauagaggaaaacccauggauggaggauaaaacucauguguccaguugggaagacguuccauaccuagggaaaagggaagaucaaugguguggaucccuaauaggcuuaacagcacgagccaccugggccaccaacauacagguggccauaaaccaagugagaaggcucauugggaaugagaauuaucuagacuacaugacaucaaugaagagauucaaaaacgagagugauccugaaggggcacucugguaa

SEQ ID NO: 6281 - RNA, 9879 nt, Artificial Sequence
  derived and/or modified CDS sequence (wt) from DENV-1__KF289072__SS-prME
uccgugaccaugcuccucaugcugcugcccacagcccuggcguuccauuugaccacacgagggggagagccacacaugauaguuagcaagcaggaaagaggaaagucacuccuguuuaagaccucugcaggugucaacaugugcacccucauugcaauggauuugggagaguuaugugaggauacaaugaccuacaaaugcccccggaucacugaagcggaaccagaugauguugauugcuggugcaaugccacagacacaugggugaccuaugggacguguucucagacuggcgaacaccgacgggauaaacgcucugucgcauuggccccacacguggggcuuggucucgaaacaagaaccgaaacguggauguccucugaaggcgccuggagacagauacaaaaaguggagacuugggccuugagacacccaggauucacggugauagcccuuuuucuagcacaugccauaggaacauccauuacccagaaagggaucaucuucauuuugcugaugcuggugacaccaucaauggccaugcgaugugugggaauaggcaacagagacuucguugaaggacugucaggagcaacauggguggaugugguacuggagcauggaagcugcgucaccaccauggcaaaaaauaaaccaacauuggacauugaacucuugaagacggaggucacgaacccugccgucuugcgcaaacugugcauugaagcuaaaauaucaaacaccacuaccgauucaagauguccaacacaaggagaagcuacacugguggaagaacaagacgcgaacuuugugugucgacgaacauucguggacagaggcugggguaaugguuguggacuauucgggaagggaagcuuacuaacgugugcuaaguuuaagugugugacaaaacuugaaggaaagauaguucaauaugaaaacuuaaaauauucggugauagucacuguccacacuggggaccagcaccagguaggaaaugagacuacagaacauggaacaauugcaaccauaacaccucaagcucccacgucggaaauacagcugacugacuacggagcccuuacauuggacugcucaccuagaacagggcuggacuuuaaugagauggugcuguugacaaugaaagaaaaaucauggcuuguccacaaacaaugguuucuagacuuaccauugccuuggaccucgggggcuucaacaucucaagagacuuggaacagacaagauuugcuggucacauuuaagacagcucaugcaaagaagcaggaaguagucguacuggggucacaagaaggagcaaugcacacugcguugacuggggcgacagaaauccagacgucaggaacgacgacaaucuucgcaggacaccugaaauguagacuaaaaauggauaaacugacuuuaaaaggggugucauaugugaugugcacaggcucauuuaagcuagagaaggaaguggcugagacccagcauggaacuguuuuagugcagguuaaauaugaaggaacagaugcaccaugcaagauuccaauuucaacccaagaugagaaaggagugacccagaaugggagauugauaacagccaaucccauaguuacugacaaagaaaaaccagucaacauugaaacagaaccacccuuuggugagagcuacaucgugauaggggcgggugaaaaagcuuugaaacuaagcugguucaagaaaggaagcagcauagggaaaauguucgaagccaccgcccgaggagcacgaaggauggcuauccugggagacacagcaugggacuucgguuccauaggagggguguucacaucugugggaaaauugguacaccagguuuuuggaaccgcauauggggucuuguucagcgguguuuccuggaccaugaaaauaggaauagggauucugcugacauggcuaggauugaauucaaggagcacgucacucucgaugacgugcauugcaguuggcauggucacacuguaccuaggagucaugguucaagcggacucggggugugugaucaacuggaagggcagagaacucaaguguggaaguggcaucuuugucacuaaugaaguccacacuuggacagagcaauauaaauuccaggcugacuccccaaaaagacuaucagcagccauugggaaggcaugggaggaaggcguguguggaauucgaucagccacacgucuugagaacaucauguggaagcaaauaucaaaugaauugaaccacauucuacuugaaaaugacaugaaauuuacagugguuguaggagacgccaauggaaucuugacccaaggaaaaaagaugauuaggccacaacccauggaacacaaauacucauggaaaagcuggggaaaagccaaaaucauaggagcagauacacagaauacuaccuucaucaucgacggcccagacacuccagaaugccccgaugaccagagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaacgagaccuggaagcuagcgagagccuccuucauagaagugaagacaugcaucuggccaagaucccacacucuauggagcaauggagucuuggaaagugaaaugauaaucccaaagauauauggaggaccaauaucucagcacaacuacagaccaggguauuucacacaaacagcagggccauggcaccuaggcaaguuggaacuagacuuuaauuugugugaaggcaccacaguuguuguggaugaacauuguggaaaucgagguccaucucuuagaacuacaacagucacaggaaagauaauccaugaaugguguugcagauccugcacgcuaccccccuuacgcuucaaaggagaagacggauguugguauggcauggaaaucagaccaguuaaggagaaggaagagaaucuagucaggucaauggucucugcagggucaggagaaguggacaguuuuucauugggacuacuaugcguaucaauaaugauugaagaagugaugagauccagauggaguagaaagaugcugaugacuggaacacuggcuguuuucuuccuucuuauaaugggacaacugacauggaaugaucugaucagguuaugcaucaugguuggagccaaugucucagacagaauggggaugggaacaacguaccuagccuuaauggccacuuuuaaaaugagaccgauguucgcuguugggcuauuauuucgcagacuaacauccagagaggugcuccuucucacaauuggacuaagccugguggcauccguggagcuaccaaauucuuuagaggagcuaggggacggacuugcgaugggcaucaugauguuaaaauuguugacugauuuucagucacaccaguuguggacuaccuuacugucucugacauucaucaaaacaacucucucacuggauuaugcauggaagacaauggcuaugguauugucaaucguaucucucuuuccucuaugucuauccacgaccucucaaaaaacaacauggcuuccggugcugcuaggauccuuuggauguaaaccacuaaccauguuucuuauaacagaaaacaaaauuuggggaaggaaaaguuggccccucaaugaaggaauuauggcuguuggaauagucagcauuuuacuaaguucacuccucaaaaaugacgugccacuagccggcccacuaauagcuggaggcaugcugauagcauguuacgucauauccggaagcucagccgauuuaucauuggagagagcggcugaggucuccugggaagaagaagcagaacacucuggugccucacacaacauacuaguggagguccaagaugauggaacuaugaaaauaaaagaugaagagagagaugauacgcucacuauacuccucaaagcaacuuuguuggcaguuucagggguguacccaaugucaauaccagcaacccuuuuugugugguauuuuuggcagaaaaagaaacagagaucaggagucuugugggacacacccagcccuccagaaguagaaagagcaguucuugaugaugguaucuauagaaucuugcaaagaggacuguuggguaggucccagguaggagugggaguuuuucaagacggcguguuccauacaauguggcaugucaccaggggggccguccucauguaccaagggaagaggcuggaaccaaguugggccagugucaaaaaagacuugaucucauauggaggagguuggagguuucaaggaucauggaacacgggagaagaaguacaggugauagcuguugaaccaggaaaaaacccaaagaauguacagacaacgccgggcaccuucaagaccccugaaggcgcaguuggagccauagcccuagauuucaaaccuggcacaucuggaucucccaucgugaacagagagggaaaaauaguaggucuuuauggaaauggaguggugacaacaaguggaaccuacgucagugccauugcccaagcuaaagcgucacaagaagggccucuaccagagauugaggacgagguguuuaagaaaagaaaccuaacaauaauggaccuacauccaggaucaggaaaaacaagaagauaucuuccagccauaguccgugaggccauaaaaaggaaacugcgcacgcuaaucuuggcucccacaagaguugucgccucugaaauggcagaggcgcucaaaggaaugccaauaagauaucagacaacagcaguaaagagugaacacacaggaaaggagauaguugaucucaugugccacgccacuuucaccaugcgucuccuaucuccagugagaguucccaauuacaacaugauuaucauggaugaagcacacuuuaccgauccagccagcauagcggccagaggguacaucucaacccgaguggguaugggugaagcagcugcgaucuuuaugacagccacucccccaggaucgguagaggccuuuccacagagcaaugcaguuauccaagaugaggaaagagacauuccugagagaucauggaacucaggcuaugacuggaucacugauuucccaggaaaaacagucugguuuguuccaagcaucaaaucaggaaaugacauugccaacuguuuaagaaaaaacgggaaacgggugauccaauugagcagaaaaaccuuugacacugaauaccagaaaacaaaaaacaaugauugggacuauguugucacaacagacauuuccgaaaugggagcaaauuuccgggccgacaggguaauagacccaaggcggugcuugaagccgguaauacuaaaagauggcccagagcgcgucauucuagccggaccaaugccagugacugcggccagugcugcccagaggagaggaagaauuggaaggaaccaaaacaaagaaggugaccaguauauuuacaugggacagccuuuaaauaaugaugaggaccacgcucauuggacagaagcaaaaaugcuccuugacaauauaaauacgccagaagggauuaucccagcccucuuugagccagagagagaaaagagugcagcaauagacggggaguacagacugcggggagaagcaaggaaaacguucguggagcuaaugagaagaggggauuuaccaguuuggcuaucuuacaaaguugccucagaaggcuuccaguacuccgacagaagauggugcuuugacggggaaaggaacaaccagguguuggaggagaacauggacguggagaucuggacaaaagaaggagaaagaaagaaauuacgaccucgcugguuagaugccagaaccuacucugauccacuggcccugcgcgaguuuaaagaguucgcagcaggaagaagaagugucucaggugaccuaauauuagaaauagggaaacuuccacagcauuugacgcuaagggcccagaaugcuuuggacaacuuggucauguugcacaauuccgaacaagggggaaaagccuauagacaugcuauggaagaacuaccagacaccauagaaacauugaugcuacuagcuuugauagcugugcugacugguggaguuacguuguuuuuccuaucaggaaaaggucuagggaaaacauccauuggccuacuuuguguaauggccucaaguguacuguuauggauggccaguguggagccccauuggauagcggccuccaucauacuagaguuuuuucugauggugcugcucauuccagagccagacagacagcguacuccacaggacaaucaacuagcauauguggugauagguuuguuauucaugauauugacaguggcagccaaugagaugggauuacuggaaaccacaaagaaagaccuggggauuggccauguagucgccgaaaaccaccaccaugccacaaugcuagacauagacuuacauccagcuucagccuggacccucuaugcaguagccacaacaauuaucacucccaugaugagacacacaauugaaaacacaacggcaaacauuucccugacagcuauugcaaaucaggcggcuauauuaaugggacuugacaagggauggccaauaucgaagauggacauaggagugccacuucucgccuuagggugcuauucccaggugaacccauugacacugacagcggcgguguugauguuaguggcccauuaugccauaaucggaccuggacugcaagcaaaagcuacuagagaagcccaaaaaaggacugcggccggaauaaugaaaaauccaacuguagacgggauuguugcaauagauuuggauccugugguuuaugaugcaaaauuugaaaaacagcuaggccaaauaauguuacuaauacucugcacaucacagauucucuugaugcggacuacaugggccuuaugugaauccaucacacuggcuacuggacccuugaccacucucugggagggaucuccuggaagauucuggaauaccacgauagcaguguccauggcaaacaucuucaggggaaguuaucuagcaggagcaggucuggccuucucauuaaugaaaucuuuaggaggagguaggagagguacgggagcucaaggggaaacauugggagaaaaauggaaaagacaacuaaaccaacugagcaagucagaauuuaacacuuacaaaaggaguggaauuauggagguggacagaucugaagccaaggaaggacugaaaagaggagaaacaaccaaacaugcagugucgagaggaacagccaaacuuaggugguuuguggagaggaaccuugugaaaccagaagggaaagugauagaccucgguuguggaagagguggcuggucauauuacugcgcugggcugaagaaggucacagaagugaagggauacacaaaaggaggaccuggucaugaggaaccuaucccaauggcgacuuauggguggaacauagugaagcuacacucuggaagggauguguucuuuacaccaccugagaaaugugacacccuuuugugugauauuggugaguccucuccgaauccaacuauagaagaaggaagaacguuacguguucuaaagaugguggaaccauggcucagaggaaaccaguuuugcauaaaaauccuaaauccuuacaugccaagugugguagaaacucuggagcaaaugcaaagaaaacauggagggaugcuagugcgaaacccacucucaagaaauucuacccaugaaauguacuggguuucauguggaacaggaaacauugugucggcagugaacaugacauccagaauguugcugaaucgguucacaaugacucacaggaagccaacguaugaaagagacguggacuugggcgcuggaacaagacauguggcaguggaaccagagauagccaaccuagacauuauuggccagaggauagagaacauaaaaaaugaacauaagucaacauggcauuaugaugaggacaauccauacaaaacaugggccuaucauggaucauaugaggucaagccaucagggucagccucauccauggugaauggcguggugagauugcucaccaagccaugggaugucauccccauggucacacaaauagcuaugacugauaccacacccuucggacaacagaggguuuucaaagagaaaguugacacacgcacaccaagaccaaaacgaggcacagcacaaauuauggaggugacagccaagugguuguggggauuccucucuagaaauaaaaaacccagaauuugcacaagagaggaguucacaagaaaaguuaggucaaacgcagcaauuggagcaguguuuguugaugaaaaccaauggaacucagcaaaagaagcaguggaagacgaaagguuuugggaccucgugcacagagagagggagcuucauaaacagggaaaaugugccacgugugucuacaauaugauggggaaaagagagaaaaaacuaggagaguuuggaaaggcaaaaggaagucgugcaauaugguacaugugguugggagcacgcuuucuagaguuugaagcccuuggcuucaugaaugaagaccacugguucaguagggagaauucacucaguggaguggaaggagaaggacuacauaaacuuggauacauacuuagagacauaucaaagauuccagggggaaauauguaugcagacgacacagcuggaugggacacaagaauaacagaggaugaucuucagaaugaggcuaaaaucaccgacaucauggagcccgaacaugcucuacuggcuacgucaaucuucaagcugaccuaucaaaauaaggugguaagggugcaaagaccagcaaaaaguggaaccgugauggacgucauauccagacgugaccagagaggaaguggacaggucggaacuuauggccuaaacacuuucaccaacauggagguccaacuaauaagacaaauggaaucugaaggaaucuuuucacccagcgaauuggaaaauucaaaucuagcugagagaguucucgacugguuggaaaaacauggcgucgaaagguugaaaagaauggcaaucagcggagaugacuguguggugaaaccaacugaugacagguuugcaacagcuuuaacagcccugaaugacaugggaaaggugagaaaagacauaccgcaaugggaaccuucaaaaggauggaaugacuggcagcaagugccuuucuguucacaccacuuccaccaacugaucaugaaggaugggagggagauaguggugccaugccgcaaccaagaugaacuugugggcagggccagaguaucacaaggcgccggguggagccugagagaaacugcuugccuaggcaagucauaugcacaaauguggcagcugauguacuuccacaggagagaccugagacuggcggccaaugcuaucuguucagccguuccaguugauugggucccaaccagccgcaccacuuggucgauccaugcccaccaucaauggaugacaacagaagacauguugucaguauggaauaggguuuggauagaggaaaacccauggauggaggacaaaacucauguauccagcugggaagauguuccauacuuaggaaaaagggaagaucaaugguguggaucucugauaggcuuaacagcaagagccaccugggccaccaacauacaaguggccauaaaccaagugagaaggcuuauugggaaugagaauuauuuagacuacaugacaucaaugaagagauucaagaaugagagugauuccgaaggagcccucugguaa

SEQ ID NO: 6282 - RNA, 9879 nt, Artificial Sequence
  derived and/or modified CDS sequence (wt) from DENV-1__JQ692085__SS-prME
uccgugaccaugcuccucaugcugcugcccacagcccuggcguuccauuugaccacacgagggggagagccacacaugauaguuagcaagcaggaaagaggaaagucacucuuguuuaagaccucugcaggugucaacaugugcacccucauugcaauggauuugggagaguuaugugaggauacaaugaccuacaaaugcccccggaucacugaagcggaaccagaugauguugauugcuggugcaaugccacagacacaugggugaccuaugggacguguucucagacuggcgaacaccgacgggauaaacguucugucgcauuggccccacacguggggcuuggucucgaaacaagaaccgaaacguggauguccucugaaggcgccuggagacagauacaaaaaguggagacuugggccuugagacacccaggauucacggugauagcccuuuuucuagcacaugccauaggaacauccauuacccagaaagggaucaucuucauuuugcugaugcuggugacaccaucaauggccaugcgaugugugggaauaggcaacagagacuucguugaaggacugucaggagcaacauggguggaugugguacuggagcauggaagcugcgucaccaccauggcaaaaaauaaaccaacauuggacauugaacucuugaagacggaggucacgaacccugccgucuugcgcaaacugugcauugaagcuaaaauaucaaacaccacuaccgauucaagauguccaacacaaggagaagcuacacugguggaagaacaagacgcgaacuuugugugucgacgaacauucguggacagaggcugggguaaugguuguggacuauucgggaagggaagcuuacuaacgugugcuaaguuuaagugugugacaaaacuugaaggaaagauaguucaauaugaaaacuuaaaauauucggugauagucacuguccacacuggggaccagcaccagguaggaaaugagacuacagaacauggaacaauugcaaccauaacaccucaagcucccacgucggaaauacagcugacugacuacggagcccuuacauuggacugcucaccuagaacagggcuggacuuuaaugagauggugcuguugacaaugaaagaaaaaucauggcuuguccacaaacaaugguuucuagacuuaccauugccuuggaccucgggggcuucaacaucucaagagacuuggaacagacaagaucugcuggucacauuuaagacagcucaugcaaagaagcaggaaguagucguacuggggucacaagaaggagcaaugcacacugcguugacuggggcgacagaaauccagacgucaggaacgacgacaaucuucgcaggacaccugaaauguagacuaaaaauggauaaacugacuuuaaaaggggugucauaugugaugugcacaggcucauuuaagcuagagaaggaaguggcugagacccagcauggaacugucuuagugcagguuaaauaugaaggaacagaugcaccaugcaagauuccaauuucaacccaagaugagaaaggagugacccagaaugggagauugauaacagccaaucccauaguuacugacaaagaaaaaccagucaacauugaaacagaaccacccuuuggugagagcuacaucgugauaggggcgggugaaaaagcuuugaaacuaagcugguucaagaaaggaagcagcauagggaaaauguucgaagccaccgcccgaggagcacgaaggauggcuauccugggagacacagcaugggacuucgguuccauaggagggguguucacaucugugggaaaauugguacaccagguuuuuggaaccgcauauggggucuuguucagcgguguuuccuggaccaugaaaauaggaauagggauucugcugacauggcuaggauugaauucaaggagcacgucacucucgaugacgugcauugcaguuggcauggucacacuguaccuaggagucaugguucaagcggacucggggugugugaucaacuggaagggcagagaacucaaguguggaaguggcaucuuugucacuaaugaaguccacacuuggacagagcaauauaaauuccaggcugacuccccaaaaagacuaucagcagccauugggaaggcaugggaggaaggcguguguggaauucgaucagccacacgucuugagaacaucauguggaagcaaauaucaaaugaauugaaccacauucuacuugaaaaugacaugaaauuuacagugguuguaggagacgccaauggaaucuugacccaaggaaaaaagaugauuaggccacaacccauggaacacaaauacucauggaaaagcuggggaaaagccaaaaucauaggagcagauacacagaauacuaccuucaucaucgacggcccagauacuccagaaugccccgaugaccagagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaacgagaccuggaagcuagcgagagccuccuucauagaagugaagacaugcaucuggccaagaucccacacucuauggagcaauggagucuuggaaagugaaaugauaaucccaaagauauauggaggaccaauaucucagcacaacuacagaccaggguauuucacacaaacagcagggccauggcaccuaggcaaguuggaacuagacuuuaauuugugugaaggcaccacaguuguuguggaugaacauuguggaaaucgagguccaucucuuagaacuacaacagucacaggaaagauaauccaugaaugguguugcagauccugcacgcuaccccccuuacgcuucagaggagaagacggauguugguauggcauggaaaucagaccaguuaaggagaaggaagagaaucuagucaggucaauggucucugcagggucaggagaaguggacaguuuuucauugggacuacuaugcguaucaauaaugauugaagaagugaugagauccagauggaguagaaagaugcugaugacuggaacacuggcuguuuucuuccuucuuauaaugggacaacugacauggaaugaucugaucagguuaugcaucaugguuggagccaaugucucagacagaauggggaugggaacaacguaccuagccuuaauggccacuuuuaaaaugagaccgauguucgcuguugggcuauuauuucgcagacuaacauccagagaggugcuccuucucacaauuggacuaagccugguggcauccguggagcuaccaaauucuuuagaggagcuaggggacggacuugcgaugggcaucaugauguuaaaauuguugacugauuuucagucacaccaguuguggacuaccuuacugucucugacauucaucaaaacaacucuuucacuggauuaugcauggaagacaauggcuaugguauugucgaucguaucucucuuuccucuaugucuauccacgaccucucaaaaaacaacauggcuuccggugcuguuaggauccuuuggauguaaaccacuaaccauguuucuuauaacagaaaacaaaauuuggggaaggaaaaguuggccccucaaugaaggaauuauggcuguuggaauagucagcauuuuauuaaguucacuccucaaaaaugacgugccacuagccggcccacuaauagcuggaggcaugcugauagcauguuacgucauauccggaagcucagccgauuuaucauuggagagagcggcugaggucuccugggaagaagaagcagaacacucuggugccucacacaacauacuaguggagguccaagaugauggaacuaugaaaauaaaagaugaagagagagaugauacgcucacuauacuccucaaagcaacuuuguuggcaguuucagggguguacccaaugucaauaccagcaacccuuuuugugugguauuuuuggcagaaaaagaaacagagaucaggagucuugugggacacacccagcccuccagaaguagaaagagcaguucuugaugaugguaucuauagaaucuugcaaagaggacuguuggguaggucccagguaggagugggaguuuuucaagacggcguguuccacacaauguggcaugucaccaggggggcuguccucauguaccaagggaagaggcuggaaccaaguugggccagugucaaaaaagacuugaucucauauggaggagguuggagguuucaaggaucauggaacacgggagaagaaguacaggugauagcuguugaaccaggaaaaaacccaaagaauguacagacaacgccgggcaccuucaagaccccugaaggcgcaguuggagccauagcccuagauuucaaaccuggcacaucuggaucucccaucgugaacagagagggaaaaauaguaggucuuuauggaaauggaguggugacaacaaguggaaccuacgucagugccauugcccaagcuaaagcgucacaagaagggccucuaccagagauugaggacgagguguuuaagaaaagaaaccuaacaauaauggaccuacauccaggaucaggaaaaacaagaagauaucuuccagccauaguccgugaggccauaaaaaggaaacugcgcacgcuaaucuuggcucccacaagaguugucgccucugaaauggcagaggcgcucaaaggaaugccaauaagauaucagacaacagcaguaaagagugaacacacaggaaaggagauagucgaucucaugugccacgccacuuucaccaugcgucuccuaucuccagugagaguucccaauuacaacaugauuaucauggaugaagcacacuuuaccgauccagccagcauagcggccagaggguacaucucaacccgaguggguaugggugaagcagcugcgaucuuuaugacagccacucccccaggaucgguagaggccuuuccacagagcaaugcaguuauccaagaugaggaaagagacauuccugagagaucauggaacucaggcuaugacuggaucacugauuucccaggaaaaacagucugguuuguuccaagcaucaaaucaggaaaugacauugccaacuguuuaagaaaaaacgggaaacgggugauccaauugagcagaaaaaccuuugacacugaauaccagaaaacaaaaaacaaugauugggacuauguugucacaacagacauuuccgaaaugggagcaaauuuccgggccgacaggguaauagacccaaggcggugcuugaagccgguaauacuaaaagauggcccagagcgcgucauucuagccggaccaaugccagugaccgcggccagugcugcccagaggagaggaagaauuggaaggaaccaaaacaaagaaggugaccaguauauuuacaugggacagccuuuaaauaaugaugaggaccacgcccauuggacagaagcaaaaaugcuccuugacaauauaaauacgccagaagggauuaucccagcccucuuugagccagagagagaaaagagugcagcaauagacggggaguacagacugcggggagaagcaaggaaaacguucguggagcuaaugagaagaggggauuuaccaguuuggcuaucuuacaaaguugccucagaaggcuuccaguacuccgacagaagauggugcuuugacggggaaaggaacaaccagguguuggaggagaacauggacguggagaucuggacaaaagaaggagaaagaaagaaauuacgaccucgcugguuagaugccagaaccuacucugauccacuggcccugcgcgaguuuaaagaguucgcagcaggaagaagaagugucucaggugaccuaauauuagaaauagggaaacuuccacagcauuugacgcuaagggcccagaaugcuuuggacaacuuggucauguugcacaauuccgaacaagggggaaaagccuauagacaugcuauggaagaacuaccagacaccauagaaacauugaugcuacuagccuugauagcugugcugacugguggaguuacguuguuuuuccuaucaggaaaaggucuagggaaaacauccauuggccuacuuuguguaauggccucaaguguacuguuauggauggccaguguggagccccauuggauagcggccuccaucauacuagaguuuuuucugauggugcugcucauuccagagccagacagacagcguacuccacaggacaaucaacuagcauauguggugauagguuuguuauucaugauauugacaguggcagccaaugagaugggauuacuggaaaccacaaagaaagaccuggggauuggccauguagucgccgaaaaccaccaccaugccacaaugcuagacauagacuuacauccagcuucagccuggacccucuaugcaguagccacaacaauuaucacucccaugaugagacacacaauugaaaacacaacggcaaacauuucccugacagcuauugcaaaucaggcggcuauauuaaugggacuugacaagggauggccaauaucgaagauggacauaggagugccacuucucgccuuagggugcuauucccaggugaacccauugacacugacagcggcgguguugauguuaguggcccauuaugccauaaucggaccuggacugcaagcaaaagcuacuagagaagcccaaaaaaggacugcggccggaauaaugaaaaauccaacuguagacgggauuguugcaauagauuuggauccugugguuuaugaugcaaaauuugaaaaacagcuaggccaaauaauguuacuaauacucugcacaucacagauucucuugaugcggacuacaugggccuuaugugaauccaucacacuggcuacuggacccuugaccacucucugggagggaucuccuggaagauucuggaauaccacgauagcaguguccauggcaaacaucuucaggggaaguuaucuagcaggagcaggucuggccuucucauuaaugaaaucuuuaggaggagguaggagagguacgggagcucaaggggaaacauugggagaaaaauggaaaagacaacuaaaccaacugagcaagucagaauuuaacacuuacaaaaggaguggaauuauggagguggacagaucugaagccaaggaaggacugaaaagaggagaaacaaccaaacaugcagugucgagaggaacagccaaacuuaggugguuuguggagaggaaccuugugaaaccagaagggaaagugauagaccucgguuguggaagagguggcuggucauauuacugcgcugggcugaagaaggucacagaagugaagggauacacaaaaggaggacccggucaugaggaaccuaucccaauggcgacuuauggauggaacauagugaagcuacacucuggaagggauguauucuuuacaccaccugagaaaugugacacccuuuugugugauauuggugaguccucuccgaauccaacuauagaagaaggaagaacguuacguguucuaaagaugguggaaccauggcucagaggaaaccaguuuugcauaaaaauccuaaauccuuacaugccaagugugguagaaacucuggagcaaaugcaaagaaaacauggagggaugcuagugcgaaacccacucucaagaaauucuacccaugaaauguacuggguuucauguggaacaggaaacauugugucggcagugaacaugacauccagaauguugcugaaccgguucacaaugacucacaggaagccaacguaugaaagagacguggacuugggcgcuggaacaagacauguggcaguggaaccagagauagccaaccuagacauuauuggccagaggauagagaacauaaaaaaugaacauaagucaacauggcauuaugaugaggacaauccauauaaaacaugggccuaucauggaucauaugaggucaagccaucagggucagccucauccauggugaauggcguggugagauugcucaccaagccaugggaugucauccccauggucacacaaauagcuaugacugauaccacacccuucggacaacagaggguuuucaaagagaaaguugacacacgcacaccaagaccaaaacgaggcacagcacaaauuauggaggugacagccaagugguuguggggauuccucucuagaaauaaaaaacccagaauuugcacaagagaggaguucacaagaaaaguuaggucaaacgcagcaguuggagcaguguuuguugaugaaaaccaauggaacucagcaaaagaagcaguggaagacgaaagguuuugggaccucgugcacagagagagggagcuucauaaacagggaaaaugugccacgugugucuacaauaugauggggaaaagagagaaaaaacuaggagaguuuggaaaggcaaaaggaagucgugcaauaugguacaugugguugggagcacgcuuucuagaguuugaagcccuuggcuucaugaaugaagaccacugguucaguagggagaauucacucaguggaguggaaggagaaggacuacauaaacuuggauacauacuuagagacauaucaaagauuccagggggaaauauguaugcagacgacacagcuggaugggacacaagaauaacagaggaugaucuucagaaugaggcuaaaaucaccgacaucauggagcccgaacaugcucuacuggcuacgucaaucuucaagcugaccuaucaaaauaaggugguaagggugcaaagaccagcaaaaaguggaaccgugauggacgucauauccagacgugaccagagaggaaguggacaggucggaacuuauggccuaaacacuuucaccaacauggagguccaacuaauaagacaaauggaaucugaaggaaucuuuucacccaacgaauuggaaaauucaaaucuagcugagagaguucucgacugguuggaaaaacauggcgucgaaagguugaaaagaauggcaaucagcggagaugacuguguggugaaaccaacugaugacagguuugcaacagcuuuaacagcccugaaugacaugggaaaggugagaaaagacauaccgcaaugggaaccuucaaaaggauggaaugacuggcagcaagugccuuucuguucacaccacuuccaccaacugaucaugaaggaugggagggagauaguggugccaugccgcaaccaagaugaacuugugggcagggccagaguaucacaaggcgccggguggagccugagagaaacugcuugccuaggcaagucauaugcacaaauguggcagcugauguacuuccacaggagagaccugagacuggcggccaaugcuaucuguucagccguuccaguugauugggucccaaccagccgcaccacuuggucgauccaugcccaccaucaauggaugacaacagaagacauguugucaguauggaauaggguuuggauagaggaaaacccauggauggaggacaaaacucauguauccagcugggaagauguuccauacuuaggaaaaagggaagaucaaugguguggaucucugauaggcuuaacagcaagagccaccugggccaccaacauacaaguggccauaaaccaagugagaaggcuuauugggaaugagaauuauuuagacuacaugacaucaaugaagagauucaagaaugagagugauuccgaaggagcccucugguaa

SEQ ID NO: 6283 - RNA, 9879 nt, Artificial Sequence
  derived and/or modified CDS sequence (wt) from DENV-1__JQ917404__SS-prME
uccgugaccaugcuccucaugcugcugcccacagcccuggcguuccauuugaccacacgagggggagagccacacaugauaguuagcaagcaggaaagaggaaagucacucuuguuuaagaccucugcaggugucaacaugugcacccucauugcaauggauuugggagaguuaugugaggauacaaugaccuacaaaugcccccggaucacugaagcggaaccagaugauguugauugcuggugcaaugccacagacacaugggugaccuaugggacguguucucagacuggcgaacaccgacgggauaaacguucugucgcauuggccccacacguggggcuuggucucgaaacaagaaccgaaacguggauguccucugaaggcgccuggagacagauacaaaaaguggagacuugggccuugagacacccaggauucacggugauagcccuuuuucuagcacaugccauaggaacauccauuacccagaaagggaucaucuucauuuugcugaugcuggugacaccaucaauggccaugcgaugcgugggaauaggcaacagagacuucguugaaggacugucaggagcaacauggguggaugugguacuggagcauggaagcugugucaccaccauggcaaaaaauaaaccaacauuggacauugaacucuugaagacggaggucacgaacccugccgucuugcgcaaacugugcauugaagcuaaaauaucaaacaccaccaccgauucaagauguccaacacaaggagaagcuacacugguggaagaacaagacgcgaacuuugugugucgacgaacauucguggacagaggcugggguaaugguuguggacuauucgggaagggaagcuuacuaacgugugcuaaguuuaagugugugacaaaacuugaaggaaagauaguucaauaugaaaacuuaaaauauucggugauagucacuguccacacuggggaccagcaccagguaggaaaugagacuacagaacauggaacaauugcaaccauaacaccucaagcucccacgucggaaauacagcugacugacuacggagcccucacauuggacugcucaccuagaacagggcuggacuuuaaugagauggugcugcugacaaugaaagaaaaaucauggcuuguccacaaacaaugguuucuagacuuaccauugccuuggaccucgggggcuucaacaucucaagagacuuggaacagacaagaucugcuagucacauuuaagacagcucaugcaaagaagcaggaaguagucguacuggggucacaagaaggagcaaugcacacugcguugacuggggcgacagaaauccagacgucaggaacgacgacaaucuucgcaggacaccugaaauguagacuaaaaauggauaaacugacuuuaaaaggggugucauaugugaugugcacaggcucauuuaagcuagagaaggaaguggcugagacccagcauggaacuguuuuagugcagguuaaauaugaaggaacagaugcaccaugcaagauuccaauuucaacccaagaugagaaaggagugacccagaaugggagauugauaacagccaaucccauaguuacugacaaagaaaaaccagucaacauugaaacagaaccacccuuuggugagagcuacaucgugauaggggcgggugaaaaagcuuugaaacuaagcugguucaagaaaggaagcagcauagggaaaauguucgaagccaccgcccgaggagcacgaaggauggcuauccugggagacacagcaugggacuucgguuccauaggagggguguucacaucugugggaaaauugguacaccagguuuuuggaaccgcauaugggguccuguucagcgguguuucuuggaccaugaaaauaggaauagggauucugcugacauggcuaggauugaauucaaggagcacgucacucucgaugacgugcauugcaguuggcauggucacacuguaccuaggagucaugguucaagcggacucggggugugugaucaacuggaagggcagagaacucaaguguggaaguggcaucuuugucacuaaugaaguccacacuuggacagagcaauauaaauuucaggcugacuccccaaaaagacuaucagcagccauugggaaggcaugggaggaaggcguguguggaauucgaucagccacacgucuugagaacaucauguggaagcaaauaucaaaugaauugaaccacauccuacuugaaaaugacaugaaauucacagugguuguaggagacgccaauggaaucuugacccaaggaaaaaagaugauuaggccacaacccauggaacacaaauauucauggaaaagcuggggaaaagccaaaaucauaggagcagauacacagaauacuaccuucaucaucgauggcccagacacuccagaaugccccgaugaccagagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaacgagaccuggaagcuagcgagagccuccuucauagaagugaagacaugcaucuggccaagaucccacacucuauggagcaauggagucuuggaaagugaaaugauaaucccaaagauauauggaggaccaauaucucagcacaacuacagaccaggguauuucacacaaacagcagggccauggcaccuaggcaaguuggaacuagacuuuaauuugugugaaggcaccacaguuguuguggaugaacauuguggaaaucgagguccaucucuuagaacuacaacagucacaggaaagauaauccaugaauggugcugcagauccugcacgcuaccccccuuacgcuucagaggagaagacggauguugguauggcauggaaaucagaccaguuaaggagaaggaagagaaucuagucaggucaauggucucugcagggucaggagaaguggacaguuuuucauugggacuacuaugcguaucaauaaugauugaagaagugaugagauccagauggaguagaaagaugcugaugacuggaacacuggcuguuuucuuccuucuuauaaugggacaacugacauggaaugaucugaucagguuaugcaucaugguuggagccaaugucucagacagaauggggaugggaacaacguaccuagcucugauggccacuuuuaaaaugagaccgauguucgcuguugggcuauuauuucgcagacuaacauccagagaggugcuccuucucacaauuggacuaagccugguggcauccguggagcuaccaaauucuuuagaggagcuaggggacggacuugcgaugggcaucaugauguuaaaauuguugacugauuuucagucacaccaguuguggacuaccuuacugucucugacauucaucaaaacaacucuuucacuggauuaugcauggaagacaauggcuaugguauugucaaucguaucucucuuuccucuaugucuauccacgaccucucaaaaaacaacauggcuuccggugcuguuaggauccuuuggauguaaaccacuaaccauguuucuuauaacagaaaacaaaauuuggggaaggaaaaguuggccccucaaugaaggaauuauggcuguuggaauagucagcauuuuacuaaguucacuccucaaaaaugacgugccacuagccggcccacuaauagcuggaggcaugcugauagcauguuacgucauauccggaagcucagccgauuuaucauuggagagagcggcugaggucuccugggaagaagaagcagaacacucuggugccucacacaacauacuaguggagguccaagaugauggaacuaugaaaauaaaagaugaagagagagaugacacgcucacuauacuccucaaagcaacuuuguuggcaguuucagggguguacccaaugucaauaccagcaacccuuuuugugugguauuuuuggcagaaaaagaaacagagaucaggagucuugugggacacacccagcccuccagaaguagaaagagcaguucuugaugaugguaucuauagaaucuugcaaagaggacuguuggguaggucccagguaggagugggaguuuuucaagacggcguguuccacacaauguggcaugucaccaggggggcuguccucauguaccaagggaagaggcuggaaccaaguugggccagugucaaaaaagacuugaucucauauggaggagguuggagguuucaaggaucauggaacacgggagaagaaguacaggugauagcuguugaaccaggaaaaaacccaaagaauguacagacaacgccgggcaccuucaagaccccugaaggcgaaguuggagccauagcccuagauuucaaaccuggcacaucuggaucucccaucgugaacagagagggaaaaauaguaggucuuuauggaaauggaguggugacaacaaguggaaccuacgucagugccauugcccaagcuaaagcgucacaagaagggccucuaccagagauugaggacgagguguuuaagaaaagaaaccuaacaauaauggaccuacauccaggaucaggaaaaacaagaagauaucuuccagccauaguccgugaggccauaaaaaggaaacugcgcacgcuaaucuuggcucccacaagaguugucgccucugaaauggcagaggcgcuuaaaggaaugccaauaagauaucagacaacagcaguaaagagugaacacacaggaaaggagauagucgaucucaugugccacgccacuuucaccaugcgucuccuaucuccagugagaguucccaauuacaacaugauuaucauggaugaagcacacuuuaccgauccagccagcauagcggccagaggguacaucucaacccgaguggguaugggugaagcagcugcgaucuuuaugacagccacucccccaggaucgguagaggccuuuccacagagcaaugcaguuauccaagaugaggaaagagacauuccugagagaucauggaacucaggcuacgacuggaucacugauuucccaggaaaaacagucugguuuguuccaagcaucaaaucaggaaaugacauugccaacugcuuaagaaaaaacgggaaacgggugauccaauugagcagaaaaaccuuugacacugaauaccagaaaacgaaaaacaaugauugggacuauguugucacaacagacauuuccgaaaugggagcaaauuuccgggccgacaggguaauagacccaaggcggugcuugaagccgguaauacuaaaagauggcccagagcgcgucauucuagccggaccaaugccagugaccgcggccagugcugcccagaggagaggaagaauuggaaggaaccaaaacaaggaaggugaccaguauauuuacaugggacagccuuuaaauaaugaugaggaccacgcucauuggacagaagcaaaaaugcuccuugacaauauaaauacgccagaagggauuaucccagcccucuuugagccagagagagaaaagagugcagcaauagacggggaguauagacugcggggagaagcaaggaaaacguucguggagcuaaugagaagaggggaucuaccaguuuggcuaucuuacaaaguugccucagaaggcuuccaguacuccgacagaagauggugcuuugacggggaaaggaacaaccagguguuggaggagaacauggacguggagaucuggacaagagaaggagaaagaaagaaauuacgaccucgcugguuagaugccagaaccuacucugauccacuggcccugcgcgaguuuaaagaguucgcagcaggaagaagaagugucucaggugaccuaauauuagaaauagggaaacuuccacagcauuugacgcuaagggcccagaaugcuuuggacaacuuggucauguugcacaauuccgaacaagggggaaaagccuauagacaugcuauggaagaacuaccagacaccauagaaacauugaugcuacuagccuugauagcugugcugacugguggaguuacguuguuuuuccuaucaggaaaaggucuagggaaaacauccauuggccuacuuuguguaauggccucaaguguacuguuauggauggccaguguggagccccauuggauagcggccuccaucauacuagaguuuuuucugauggugcugcucauuccagagccagacagacagcguacuccacaggacaaucaacuagcauauguggugauagguuuguuauucaugauauugacaguggcagccaaugagaugggauuacuggaaaccacaaagaaagaccuggggauuggccauguagucgccgaaaaccaccaccaugccacaaugcuagacauagacuuacauccagcuucagccuggacccucuaugcaguagccacaacaauuaucacucccaugaugagacacacaauugaaaacacaacggcaaacauuucccugacagcuauugcaaaucaggcggcuauauuaaugggacuugacaagggauggccaauaucgaagauggacauaggagugccacuucucgccuuagggugcuauucccaggugaacccauugacacugacagcggcgguguugauguuaguggcucauuaugccauaaucggaccuggacugcaagcaaaagcuacuagagaagcccaaaaaaggacugcggccggaauaaugaaaaauccaacuguagacgggauuguugcaauagauuuggauccugugguuuaugaugcaaaauuugaaaaacagcuaggccaaauaauguuacuaauacucugcacaucacagauucucuugaugcggacuacaugggccuuaugugaaucuaucacacuggcuacuggacccuugaccacucucugggagggaucuccuggaagauucuggaauaccacgauagcaguguccauggcaaacaucuucaggggaaguuauuuagcaggagcaggucuggccuucucauuaaugaaaucuuuaggaggagguaggagagguacgggagcucaaggggaaacauugggagaaaaauggaaaagacaauuaaaccaacugagcaagucagaauuuaacacuuacaaaaggaguggaauuauggagguggacagaucugaagccaaggagggacugaaaagaggagaaacaaccaaacaugcagugucgagaggaacagccaaacuuagaugguuuguggagaggaaccuugugaaaccagaagggaaagugauagaccucgguuguggaagagguggcuggucauauuacugcgcugggcugaagaaggucacagaagugaagggauacacaaaaggaggacccggucaugaggaaccuaucccaauggcgacuuauggauggaacauagugaagcuacacucuggaagggauguauucuuuacaccaccugagaaaugugacacccuuuugugugauauuggugaguccucuccgaauccaacuauagaagaaggaagaacguuacguguucuaaagaugguggaaccauggcucagaggaaaucaguuuugcauaaaaauccuaaauccuuacaugccaagugugguagaaacucuggagcaaaugcaaagaaaacauggagggaugcuagugcgaaacccacucucaagaaauucuacccaugaaauguacuggguuucauguggaacaggaaacauugugucggcagugaacaugacauccagaauguugcugaaucgguucacaauggcucacaggaagccaacguaugaaagagacguggacuugggcgcuggaacaagacauguggcaguggaaccagagauagccaaccuagacauuauuggccagaggauagagaacauaaaaaaugaacauaagucaacauggcauuaugaugaggacaauccauacaaaacaugggccuaucauggaucauaugaggucaagccaucagggucagccucauccauggugaauggcguggugagauugcucaccaagccaugggauguuauccccauggucacacaaauagcuaugacugauaccacacccuucggacaacagaggguuuucaaagagaaaguugacacacgcacaccaagaccaaaacgaggcacagcacaaauuauggaggugacagccaagugguuguggggauuccucucuagaaauaaaaaacccagaaucugcacaagagaggaguucacaagaaaaguuaggucaaacgcagcaauuggagcaguguuuguugaugaaaaccaauggaacucagcaaaagaagcaguggaagacgaaagguuuugggaccucgugcacagagagagggagcuucauaaacagggaaaaugugccacgugugucuacaauaugauggggaaaagagagaaaaaacuaggagaguuuggaaaggcaaaaggaagucgugcaauaugguacaugugguugggagcacgcuuucuagaauuugaagcccuuggcuucaugaaugaagaccacugguucaguagggagaauucacucaguggaguggaaggagaaggacuacauaaacuuggauacauacucagagacauaucaaagauuccagggggaaauauguaugcagacgacacagcuggaugggacacaagaauaacagaggaugaucuucagaaugaggcuaaaaucaccgacaucauggagccugaacaugcucuacuggcuacgucaaucuucaagcugaccuaucaaaauaaggugguaagggugcaaagaccagcaaaaaguggaaccgugauggacgucauauccagacgugaccagagaggaaguggacaggucggaacuuauggccuaaacacuuucaccaacauggagguccaacuaauaagacaaauggaaucugaaggaaucuuuucacccagcgaauuggaaaacucaaaucuagcugagagaguucucgacugguuggaaaaacauggcgucgaaagguugaaaagaauggcaaucagcggagaugacuguguggugaaaccaacugaugacagguucgcaacagcuuuaacagcccugaaugacaugggaaaggugagaaaagacauaccgcaaugggaaccuucaaaaggauggaaugacuggcagcaagugccuuucuguucacaccacuuccaccaacugauuaugaaggaugggagggagauaguggugccaugccgcaaccaagaugaacuugugggcagggccagaguaucacaaggcgccggguggagccugagagaaacugcuugccuaggcaagucauaugcacaaauguggcagcugauguacuuccacaggagagaccugagacuggcggcuaaugcuaucuguucagccguuccaguuaauugggucccaaccagccgcaccaccuggucgauccaugcccaccaucaauggaugacaacagaagacauguugucaguauggaauaggguuuggauagaggaaaacccauggauggaggacaaaacucauguauccagcugggaagauguuccauacuuaggaaaaagggaagaucaaugguguggaucucugauaggcuuaacagcaagagccaccugggccaccaacauacaaguggccauaaaccaagugagaaggcuuauugggaaugagaauuauuuagacuacaugacaucaaugaagagauucaagaaugagagugaucccgaaggagcccucugguaa

SEQ ID NO: 6284 - RNA, 9879 nt, Artificial Sequence
  derived and/or modified CDS sequence (wt) from DENV-1__GU370048__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuaugugaggacacacugacuuacaaaugcccucgaaucacugaggcggaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccuccgaaggcgcuuggaaacagauacaaagaguggagacuugggcccugagacacccaggauucacggugauagcccuuuuucuagcacaugccauaggaacauccaucacucagaaagggauuaucuucauuuuguuaaugcugguuacaccauccauggccaugcgaugcgugggaauaggcagcagggacuucguggaaggacugucaggagcaacuuggguagauguggugcuggaacauggaaguugcgucacuaccauggcaaaagacaaaccaacauuggacauugaacucuugaagacggaagucacaaacccugccguccugcgcaaacugugcauugaagcuaaaauaucaaacacuaccaccgacucaagauguccaacacaaggagaagccacacugguggaagaacaagacgcgaacuuugugugucgacgaacguuuguggacagaggcuggggcaauggcugugggcucuucggaaaaggaagccuuauaacgugugcuaaguucaagugugugacaaaacuggaaggaaaaauaguucaauaugaaaacuugaaauauucaguaauagucaccguccacacuggagaccagcaucaggugggaaaugaaagcacagaacaugggacaacugcaacuauaacaccucaagcucccacgacagaaauacagcugaccgacuacggagcucuuacauuggauuguucaccuagaacaggacuaaacuuuaaugaaaugguguuguugacaaugaaagaaaaaucauggcuaguccacaaacaaugguuucuagaccuaccacugccuuggaccucgggagccucaacaacacaagaaacuuggaacagacaagauuugcuggugacauuuaagacagcucaugcaaagaagcaggaaguagucguacuaggaucacaagaaggagcaaugcacacugcgcugaccggagcgacagaaauccaaacaucuggaacgacaacaauuuuugcaggacacuugaaauguagacuaaagauggacaaacugacucuaaaagggaugucauaugugaugugcacaggcucauucaagcuagagaaggaaguggcugagacccagcauggaaccguucuagugcagauuaaauacgaaggaacagaugcaccaugcaagaucccuuuuucgacccaagaugaaaaaggaguaacccagaaugggagauugauaacagccaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagaucuuuggaacugcauauggaguuuuguucagcgguguuuccuggaccaugaaaauaggaauagggguucuguugacauggcuaggauuaaacucaaggagcacgucccuuucgaugacgugcauugcaguuggccuaguaacgcuauacuuaggagucaugguucaggcggauucaggauguguaauuaauuggaaagguagagaacucaaauguggaaguggcauuuuugucaccaaugaaguucacacuuggacagagcaauacaaauuucaagcugauuccccaaggagacuaucagcagccauugggaaggcaugggaggaggguguguguggaauucgaucagcaacucgucucgagaacaucauguggaagcaaauaucaaaugaauugaaccacaucuuacuugaaaaugacaugaaauucacagugguuguaggagauguugcugggaucuuggcucaaggaaaaaaaaugauuaggccacaacccauggaacacaaauacucguggaaaagcuggggaaaggcuaaaaucauaggggcagauguacagaacaccaccuuuaucaucgacggcccaaacaccccagaaugcccugaugaucaaagagcauggaacauuugggaaguugaggauuauggauuuggaauuuucacgacaaacauauggcugaaauugcgugacuccuacacccaggugugugaccaccggcuaaugucagcugccauuaaggacagcaaggcaguucacgcugacaugggguacuggauagaaagugaaaagaacgagaccuggaagcuggcaagagccucuuucauagaagucaaaacauguaucuggccaaaaucucacacucuauggagcaauggaguucuggaaagugaaaugauaauuccaaagaucuauggaggaccaauaucucagcacaacuacagaccaggauauuucacacaaacagcagggccguggcaccuaggcaagcuggaacuggauuuugauuugugugaggguaccacgguuguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccagucaaggaaaaggaagagaaucuagucaaaucaauggucuccgcagggucaggggaaguggacagcuuuucacuaggacuguuaugcauaucaauaaugaucgaagaggugaugagauccagauggaguagaaaaaugcugauaacuggaacacuggcuguguucuuccuucucauaaugggacaagugacauggaaugaucugaucagauuaugcaucaugguuggagccaacgcuuccgacaggauggggaugggaacgacguaccuagcucugauggccacuuuuaaaaugagaccaauguuugcuguagggcuacuauuccgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaccacaucagcuaugggcuaccuugcuguccuugacauuuaucaaaacaacguuuuccuugcacuaugcauggaagacaauggcuaugguacugucaauuguaucucucuuccccuuaugccuguccacgaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauugucagcauccuacuaaguucacuccucaaaaaugaugugccgcuagcuggaccacuaauagcuggaggcaugcuaauagcauguuauguuauaucuggaagcucagccgaucuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguugugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacgggagaagaagugcaggugauugcuguugaaccagggaaaaaccccaaaaauguacaaacagcgccgggcaccuuuaagaccccugaaggcgaaguuggagccauugcccuagauuuuaaacccggcacaucuggaucucccaucgugaacagagaagggaaaauaguaggucuuuauggaaauggaguagugacaacaaguggaaccuacgucagugcuauagcucaagcuaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcgcacacuaauucuggcucccacaaggguugucgcuuccgaaauggcagaggcgcuuaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccagcauagcggcuagaggguacaucucaacccgagugggcaugggugaagcagcugcgaucuucaugacagccacucccccaggaucaguggaggccuuuccacagagcaacgcaguuauccaagaugaggaaagagacauuccugagagaucauggaacucaggcuaugaguggaucacugacuucccaggcaaaacaguuugguuuguuccaagcauuaaaucaggaaaugauauugccaacugcuuaagaaagaaugggaaacgggugauucaauugagcagaaaaaccuuugacacagaguaccaaaaaacaaaaaauaacgacugggacuacgucgucacaacagacaucucugaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaccaguacaucuacaugggacagccuuuaaacaacgaugaagaucacgcccacuggacggaagcaaaaaugcuccuugauaauauaaacacaccagaagggauuaucccagcccucuucgagccggagagagaaaagagugcagcaauagacggggaauacagacugcggggugaagcaaggaaaacguuuguggagcucaugagaagaggagaucuaccugucuggcuauccuacaaaguugccucagaaggcuuccaguacucugauagaagauggugcuuugacggggaaaggaacaaccagguguuggaggagaacauggacguggagaucuggacaaaagaaggagaaagaaagaaacuacgaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaccugguuauguugcacaacuccgaacaaggaggaagagccuauagacaugcaauggaagaacuaccagacaccauagaaacguugaugcuccuagcuuugauagcuguguuaacugguggagugacgcuguucuuccuaucaggaaggggcuuagggaaaacaucuaucggccuacucugcgugauggcuucaagcguacugcuauggauggccaguguagagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuaucuugaugggacuugacaaaggauggccaauaucgaagauggacauaggaguuccacuucucgccuuggggugcuauucccaagugaauccacugacgcugacagcggcgguauugaugcuaguggcucauuacgcuauaauuggaccuggacugcaagcaaaagcuacuagggaagcucaaaaaaggacagcggccggaauaaugaaaaauccaaccguugauggaaucguugcaauagauuuggacccugugguuuaugaugcgaaauuugagaaacaacuaggccaaauaauguuguugauacuaugcacaucacagauccucuugaugcggacuacaugggccuugugcgaauccaucacacuggccacuggaccucugaccacgcucugggagggaucuccaggaaaauuuuggaacaccacgauagcgguuuccauggcaaacauuuucagaggaaguuaucuagcaggagcaggucuggccuucucauuaaugaaaucccuaggaggagguaggagaggcacgggagcccaaggggaaacacugggagagaaauggaaaagacagcugaaccaauugagcaagucagaauucaacaccuauaaaaggagugggauuauggaaguggacagauccgaagccaaagagggacugaaaagaggagaaacaaccaagcaugcagugucgagaggaaccgcuaaauugaggugguuuguggagaggaaccuugugaaaccagaagggaaagucauagaccucgguuguggaagagguggcuggucauacuauugcgcugggcugaagaaaguuacagaagugaagggauauacaaaaggaggaccuggacaugaagaaccaaucccaauggcgaccuauggauggaaccuaguaaagcugcacucugggaaagacguauucuuuauaccaccugagaaaugugacacccucuugugugauauuggugaguccucuccaaacccaacuauagaggaaggaagaacgcuacgcguccuaaagaugguggaaccauggcucagaggaaaccaauucugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacacaagucaacauggcauuaugaugaggacaauccauauaaaacaugggccuaucauggaucauaugaggucaagccaucaggaucagccucauccauggucaaugguguggugaaacugcucaccaaaccaugggaugucauccccauggucacacaaauagccaugacugacaccacacccuuuggacaacagaggguguucaaagagaaaguugacacacgcacaccaaaagcaaagcgaggcacagcacaaaucauggaggugacagccaggugguuaugggguuuucuuucuagaaacaagaagccaagaauuuguacaagagaggaguuuacaagaaaaguuaggucaaacgcagccaucggagcaguguucguugacgaaaaucaauggaacucagcaaaagaagcaguggaagaugagcgguucugggaccuugugcacagagagagggagcuucacaaacagggaaaaugugcuacguguguuuacaacaugauggggaagagagagaaaaagcuaggagaauuuggaaaggcaaaaggaagucgugcaauaugguacaugugguugggagcacgcuuucuagaguucgaagcucuugguuucaugaacgaagaccacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggcuaaaauuacugacaucauggaacccgagcaugcccuacuggcuaaggcaaucuucaagcuaaccuaccaaaauaaagugguaaggguacagagaccagcaaaaaauggaacugugauggaugucauauccagacgugaccagagaggaaguggccaggucggaacuuauggcuuaaacacuuucaccaacauggaagcccagcugauaagacaaauggagucugagggaaucuucucacccagugaauuagagaccccaaauuuagccgagagaguucucuacuggcuggaaaaauauggcgucgaaaggcuaaaaagaauggcaaucaguggagaugacugcguagugaaaccaauugaugauagguuugcaacagccuuaacagcucugaaugauaugggaaaaguaagaaaagacauaccgcaaugggaacccucaaaaggauggaaugauuggcaacaagugccuuuuuguucacaccacuuccaccagcugauuaugaaggaugggagggaaauaguggugccaugccgcaaccaagaugaacuuguggguagggcuagagugucacaaggugcuggauggagccugagagaaaccgcaugccuaggcaaaucauaugcacaaauguggcagcugauguacuuccacaggagagaccugagacuagcugcuaaugcuaucuguucagccguuccaguugauugggucccaaccagccguaccaccuggucgauccaugcccaucaccaauggaugacaacagaagacaugcugucaguguggaauaggguuuggauagaggaaaacccauggauggaggacaaaacccauauauccaguugggaagauguuccauauuuagggaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6285 - RNA, 9879 nt, Artificial Sequence
  derived and/or modified CDS sequence (wt) from DENV-1__KM403627__SS-prME
uccgugaccaugcuccucaugcugcugcccacagcccuggcguuccauuugaccacacgagggggagagccacacaugauaguuagcaagcaggaaagaggaaagucacucuuguuuaagaccucugcaggugucaacaugugcacccucauugcaauggauuugggagaguuaugugaggauacaaugaccuacaaaugcccccggaucacugaagcggaaccagaugauguugauugcuggugcaaugccacagacacaugggugaccuaugggacguguucucagacuggcgaacaccgacgggauaaacguucugucgcauuggccccacacguggggcuuggucucgaaacaagaaccgaaacguggauguccucugaaggcgccuggaggcagauacaaaaaguggagacuugggccuugagacacccaggauucacggugauagcccuuuuuuuagcacaugccauaggaacauccauuacccagaaagggaucaucuucauuuugcugaugcuggugacaccaucaauggccaugcgaugcgugggaauaggcaacagagacuucguugaaggacugucaggagcaacauggguggaugugguacuggagcauggaagcugugucaccaccauggcaaagaauaaaccaacauuggacauugaacucuugaagacggaggucacgaacccugccgucuugcgcaaacugugcauugaagcuaaaauaucaaacaccaccaccgauucaagauguccaacacaaggagaagcuacacugguggaagaacaagacgcgaauuuugugugucgacgaacauucguggacagaggcugggguaaugguuguggacuauucgggaagggaagcuuacuaacgugugcuaaguuuaagugugugacaaaacuugaaggaaagauaguucaauaugaaaacuuaaaauauucggugauagucacuguccacacuggggaucagcaccagguaggaaaugagacuacagaacauggaacaauugcaaccauaacaccucaagcucccacgucggaaauacagcugacugacuacggagcccuuacauuggacugcucaccuagaacagggcuggacuuuaaugagauggugcuguugacaaugaaagaaaaaucauggcuuguccacaaacaaugguuucuagacuuaccauugccuuggaccucgggggcuucaacaucucaagagacuuggaacagacaagaucugcuggucacauuuaagacagcucaugcaaagaagcaggaaguagucguacuggggucacaagaaggagcaaugcacacugcguugacuggggcgacagaaauccagacgucaggaacgacgacaaucuucgcaggacaccugaaauguagacuaaaaauggauaaacugacuuuaaaaggggugucauaugugaugugcacaggcucauuuaagcuagagaaggaaguggcugagacccagcauggaacuguccuagugcagguuaaauaugaaggaacagaugcaccaugcaagauuccaauuucaacccaagaugagaaaggagugacccagaaugggagauugauaacagccaaucccauaguuacugacaaagaaaaaccagucaacauugaaacagaaccacccuuuggugagagcuacaucgugauaggggcgggugaaaaagcuuugaaacuaagcugguucaagaaaggaagcagcauagggaaaauguucgaagccaccgcccgaggagcgcgaaggauggcuauccugggagacacagcaugggacuucgguuccauaggagggguguucacaucugugggaaaauugguacaccagguuuuuggaaccgcauaugggguccuguucagcgguguuucuuggaccaugaaaauaggaauagggauucugcugacauggcuaggauugaauucaaggagcacgucacucucgaugacgugcauugcaguuggcauggucacacuguaccuaggagucaugguucaagcggacucggggugugugaucaacuggaagggcagagaacucaaguguggaaguggcaucuuugucacuaaugaaguccacacuuggacagagcaauacaaauuucaggcugauuccccaaaaagacuaucagcagccauugggaaggcaugggaggaaggcguguguggaauucgaucagccacacgucuugagaacaucauguggaagcaaauaucaaaugaauugaaccacauucuacuugaaaaugacaugaaauucacagugguuguaggagacgccaauggaaucuugacccaaggaaaaaagaugauuaggccacaacccauggaacacaaauacucauggaaaagcuggggaaaagccaaaaucauaggagcagauauacagaauacuaccuucaucaucgauggcccagacacuccagaaugccccgaugaccagagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaacgagaccuggaagcuagcgagagccuccuucauagaagugaagacaugcaucuggccaagaucccacacucuauggagcaauggagucuuggaaagugaaaugauaaucccaaagauauauggaggaccaauaucucagcacaacuacagaccaggguauuucacacaaacagcagggccauggcaccuaggcaaguuggaacuagacuuuaauuugugugaaggcaccacaguuguuguggaugaacauuguggaaaucgagguccaucucuuagaacuacaacagucacaggaaagauaauccaugaauggugcugcagauccugcacgcuaccccccuuacgcuucagaggagaagacggauguugguauggcauggaaaucagaccaguuaaggagaaggaagagaaucuagucaggucaauggucucugcagggucaggagaaguggacaguuuuucauugggacuacuaugcguaucaauaaugauugaagaagugaugagauccagauggaguagaaagaugcugaugacuggaacacuggcuguuuucuuccuucuuauaaugggacaacugacauggaaugaucugaucagguuaugcaucaugguuggagccaaugucucagacagaauggggaugggaacaacguaccuagcuuuaauggccacuuuuaaaaugagaccgauguucgcuguugggcuauuauuucgcagacuaacauccagagaggugcuccuucucacaauuggacuaagccugguggcauccguggagcuaccaaauucuuuagaggagcuaggggacggacuugcgaugggcaucaugauguuaaaauuguugacugacuuucagucacaccaguuguggacuaccuuacugucucugacauucaucaaaacaacucuuucacuggauuaugcauggaagacaauggcuaugguauugucaaucguaucucucuuuccucuaugucuauccacgaccucucaaaaaacaacauggcuuccgguguuguuaggauccuuuggauguaaaccacuaaccauguuucuuauaacagaaaacaaaauuuggggaaggaaaaguuggccccucaaugaaggaauuauggcuguuggaauagucagcauuuuacuaaguucacuccucaaaaaugacgugccacuagccggcccacuaauagcuggaggcaugcugauagcauguuacgucauuuccggaagcucagccgauuuaucauuggagagagcggcugaggucuccugggaagaagaagcagaacacucuggugccucacacaacauacuaguggagguccaagaugauggaacuaugaaaauaaaagaugaagagagagaugacacgcucacuauacuccucaaagcaacuuuguuggcaguuucagggguguacccaaugucaauaccagcaacccuuuuugugugguauuuuuggcagaaaaagaaacagagaucaggagucuugugggacacacccagcccuccagaaguagaaagagcaguucuugaugaugguaucuauagaaucuugcaaagaggacuguuggguaggucccagguaggagugggaguuuuucaagacggcguguuccacacaauguggcaugucaccaggggggcuguccucauguaccaagggaagaggcuggaaccaaguugggccagugucaaaaaagacuugaucucauauggaggagguuggagguuucaaggaucauggaacacgggagaagaaguacaggugauagcuguugaaccagggaaaaacccaaagaauguacagacaacgccgggcacuuucaagaccccugaaggcgaaguuggagccauagcccuagauuucaaaccuggcacaucuggaucucccaucgugaacagagaggggaaaauaguaggucuuuauggaaauggaguggugacaacaaguggaaccuacgucagugccauugcccaagcuaaagcgucacaagaagggccucuaccagagauugaggacgagguguuuaagaaaagaaaccuaacaauaauggaccuacauccaggaucaggaaaaacaagaagauaucuuccagccauaguccgugaggccauaaaaaggaaacugcgcacgcuaaucuuggcucccacaagaguugucgccucugaaauggcagaggcgcuuaaaggaaugccaauaagauaucagacaacagcaguaaagagugaacacacaggaaaggagauagucgaucucaugugccacgccacuuucaccaugcgucuccuaucuccagugagaguucccaauuacaacaugauuaucauggaugaagcacacuuuaccgauccagccagcauagcggccagaggguacaucucaacccgaguggguaugggugaagcagcugcgaucuuuaugacagccacucccccaggaucgguagaguccuuuccacagagcaaugcaguuauccaagaugaggaaagagacauuccugagagaucauggaacucagguuacgacuggaucacugacuucccaggaaaaacagucugguuuguuccaagcaucaaaucaggaaaugacauugccaacugcuuaagaaaaaacgggaaacgggugauccaauugagcagaaaaaccuuugacacugaauaccagaaaacgaaaaacaaugauugggacuauguugucacaacagacauuuccgaaaugggagcaaauuuccgggccgauaggguaauagacccaaggcggugcuugaagccgguaauacuaaaagauggcccagagcgcgucauucuggccggaccaaugccagugaccgcggccagugcugcccagaggagaggaagaauuggaaggaaccaaaacaaggaaggugaccaguauauuuacaugggacagccuuuaaauaaugaugaggaccacgcucauuggacagaagcaaaaaugcuccuugacaauauaaauacgccagaagggauuaucccagcccucuuugagccagagagagaaaagagugcagcaauagacggggaguauagacugcggggagaagcaaggaaaacguucguggagcuaaugagaagaggggaucuaccaguuuggcuaucuuacaaaguugccucagaaggcuuccaguacuccgacagaagauggugcuuugacggggaaaggaacaaccagguguuggaggagaacauggacguggagaucuggacaaaagaaggagaaagaaagaaauugcgaccucgcugguuagaugccagaaccuacucugauccacuggcccugcgcgaguuuaaagaguucgcagcaggaagaagaagugucucaggugaccuaauauuagaaauagggaaacucccacagcauuugacgcuaagggcccagaaugcuuuggacaacuuggucauguugcacaauuccgaacaagggggaaaagccuauagacaugcuauggaagaacuaccagacaccauagaaacauugaugcuacuagccuugauagcugugcugacugguggaguuacguuguuuuuccuaucaggaaaaggucuagggaaaacauccauuggccuacuuuguguaauggccucaaguguacuguuauggauggccaguguggagccccauuggauagcggccuccaucauacuagaguuuuuucugauggugcugcuuauuccagagccagacagacagcguacuccacaggacaaucaacuagcauauguggugauagguuuguuauucaugauauugacaguggcagccaaugagaugggauuacuggaaaccacaaagaaagaccuggggauuggccauguagucgccgaaaaccaccaccaugccacaaugcuagacauagacuuacauccagcuucagccuggacccucuaugcaguagccacaacaauuaucacucccaugaugagacacacaauugaaaacacaacggcaaacauuucccugacagcuauugcaaaucaggcggcuauauuaaugggacuugacaagggauggccaauaucgaagauggacauaggagugccacuucucgccuuagggugcuauucccaggugaacccauugacacugacagcggcgguguuaauguuaguggcucauuaugccauaaucggaccuggacugcaagcaaaagcuaccagagaagcccaaaaaaggacugcggccggaauaaugaaaaauccaacuguagacgggauuguugcaauagauuuggauccugugguuuaugaugcaaaauuugaaaaacagcuaggccaaauaauguuacuaauacucugcacaucacagauucucuugaugcggacuacaugggccuuaugugaaucuaucacacuggcuacuggacccuugaccacucucugggagggaucuccuggaaaauucuggaauaccacgauagcaguguccauggcaaacaucuucaggggaaguuauuuagcaggggcaggucuggccuucucauuaaugaaaucuuuaggaggagguaggagagguacgggagcucaaggggaaacauugggagaaaaauggaaaagacaacuaaaccaacugagcaagucagaauuuaacacuuacaaaaggaguggaauuauggagguggacagauccgaagccaaggagggacugaaaagaggagaaacaaccaaacaugcagugucgagaggaacagccaaacuuaggugguuuguggagaggaaccuugugaaaccggaagggaaagugauagaccucgguuguggaagagguggcuggucauauuacugcgcugggcugaagaaggucacagaaguaaagggauacacaaaaggaggacccggucaugaggaaccuaucccaauggcgacuuauggauggaacauagugaagcuacacucuggaagggauguauucuuuacaccaccugagaaaugugacacccuuuugugugauauuggugaguccucuccgaauccaacuauagaagaaggaagaacguuacguguucuaaagaugguggaaccauggcucagaggaaaucaguuuugcauaaaaauccuaaauccuuauaugccaagugugguagaaacucuggagcaaaugcaaagaaaacauggagggaugcuagugcgaaacccacucucaagaaauuccacccaugaaauguacugggucucauguggaacaggaaacauugugucggcagugaacaugacauccagaaugcugcugaaucgguucacaauggcucacaggaagccaacguaugaaagagacguggacuugggcgcuggaacaagacauguggcaguggaaccagagauagccaaccuagacauuauuggccagaggauagagaacauaaaaaaugaacauaagucaacauggcauuaugaugaggacaauccauacaaaacaugggccuaucauggaucauaugaggucaagccaucagggucagccucauccauggugaauggcguggugagauugcucaccaagccaugggauguuauccccauggucacacaaauagcuaugacugauaccacacccuucggacaacagaggguuuucaaagagaaaguugacacacgcacaccaagaccaaaacgaggcacagcacaaauuauggaggugacagccaagugguuguggggauuccucucuagaaauaaaaaacccagaaucugcacaagagaggaguucacaagaaaaguuaggucaaacgcagcaauuggagcaguguuuguugaugaaaaccaauggaacucagcaaaagaagcaguggaagacgaaagguuuugggaccucgugcacagagagagggagcuucauaaacagggaaaaugugccacgugugucuacaauaugauggguaaaagagagaaaaaacuaggagaguuuggaaaggcaaaaggaagucgugcaauaugguacaugugguugggagcacgcuuucuagaauuugaagcccuuggcuucaugaaugaagaccacugguucaguagggagaauucacucaguggaguggaaggagaaggacuacauaaacuuggauacauacucagagacauaucaaagauuccagggggaaauauguaugcagacgacacagcuggaugggacacaagaauaacagaggaugaucuucagaaugaggcuaaaaucaccgacaucauggagccugaacaugcucuacuggcuacgucaaucuucaagcugaccuaucaaaauaaggugguaagggugcaaagaccagcaaaaaguggaaccgugauggacgucauauccagacgugaccagagaggaaguggacaggucggaacuuauggccuaaacacuuucaccaacauggagguccaacuaauaagacaaauggaaucugaaggaaucuuuucacccagcgaauuggaaaauucaaaucuagcugagagaguucucgacugguuggaaaaacauggcgucgaaagguugaaaagaauggcaaucagcggagaugacuguguggugaaaccaacugaugacagguucgcaacagcuuuaacagcccugaaugacaugggaaaggugagaaaagacauaccgcaaugggaaccuucaaaaggauggaaugacuggcagcaagugccuuucuguucacaccacuuccaccaacugauuaugaaggaugggagggagauaguggugccaugccgcaaccaagaugaacuugugggcagggccagaguaucacaaggcgccggguggagccugagagaaacugcuugccuaggcaagucauaugcacaaauguggcagcugauguacuuccacaggagagaccugagacuggcggcuaaugcuaucuguucagccguuccaguuaauugggucccaaccagccgcaccaccuggucgauccaugcccaccaucaauggaugacaacagaagacauguugucaguauggaauaggguuuggauagaggaaaacccauggauggaggacaaaacucauguauccagcugggaagauguuccauacuuaggaaaaagggaagaucaaugguguggaucucugauaggcuuaacagcaagagccaccugggccaccaacauacaaguggccauaaaccaagugagaaggcuuauugggaacgagaauuauuuagacuacaugacaucaaugaagagauucaagaaugagagugaucccgaaggagcccucugguaa

SEQ ID NO: 6286 - RNA, 9879 nt, Artificial Sequence
  derived and/or modified CDS sequence (wt) from DENV-1__KM403584__SS-prME
uccgugaccaugcuccucaugcugcugcccacagcccuggcguuccauuugaccacacgagggggagagccacacaugauaguuagcaagcaggaaagaggaaagucacucuuguuuaagaccucugcaggugucaacaugugcacccucauugcaauggauuugggagaguuaugugaggauacaaugaccuacaaaugcccccggaucacugaagcggaaccagaugauguugauugcuggugcaaugccacagacacaugggugaccuaugggacguguucucagacuggcgaacaccgacgggauaaacguucugucgcauuggccccacacguggggcuuggucucgaaacaagaaccgaaacguggauguccucugaaggcgccuggaggcagauacaaaaaguggagacuugggccuugagacacccaggauucacggugauagcccuuuuucuagcacaugccauaggaacauccauuacccagaaagggaucaucuucauuuugcugaugcuggugacaccaucaauggccaugcgaugcgugggaauaggcaacagagacuucguugaaggacugucaggagcaacauggguggaugugguacuggagcauggaagcugugucaccaccauggcaaagaauaaaccaacauuggacauugaacucuugaagacggaggucacgaacccugccgucuugcgcaaacugugcauugaagcuaaaauaucaaacaccaccaccgauucaagauguccaacacaaggagaagcuacacugguggaagaacaagacgcgaacuuugugugucgacgaacauucguggacagaggcugggguaaugguuguggacuauucgggaagggaagcuuacuaacgugugcuaaguuuaagugugugacaaaacuugaaggaaagauaguucaauaugaaaacuuaaaauauucggugauagucacuguccacacuggggaccagcaccagguaggaaaugagacuacagaacauggaacaauugcaaccauaacaccucaagcucccacgucggaaguacagcugacugacuacggagcccuuacauuggacugcucaccuagaacagggcuggacuuuaaugagauggugcuguugacaaugaaagaaaaaucauggcuuguccacaaacaaugguuucuagacuuaccauugccuuggaccucgggggcuucaacaucucaagagacuuggaacagacaagaucugcuggucacauuuaagacagcucaugcaaagaagcaggaaguagucguacuggggucacaagaaggagcaaugcacacugcguugacuggggcgacagaaauccagacgucaggaacgacgacaaucuucgcaggacaccugaaauguagacuaaaaauggauaaacugacuuuaaaaggggugucauaugugaugugcacaggcucauuuaagcuagagaaggaaguggcugagacccagcauggaacuguccuagugcagguuaaauaugaaggaacagaugcaccaugcaagauuccaauuucaacccaagaugagaaaggagugacccagaaugggagauugauaacagccaaucccauagucacugacaaagaaaaaccagucaacauugaaacagaaccacccuuuggugagagcuacaucgugauaggggcgggugaaaaagcuuugaaacuaagcugguucaagaaaggaagcagcauagggaaaauguucgaagccaccgcccgaggagcacgaaggauggcuauccugggagacacagcaugggacuucgguuccauaggagggguguucacaucugugggaaaauugguacaccagguuuuuggaaccgcauaugggguccuguucagcgguguuucuuggaccaugaaaauaggaauagggauucugcugacauggcuaggauugaauucaaggagcacgucacucucgaugacgugcauugcaguuggcauggucacacuguaccuaggagucaugguucaagcggacucggggugugugaucaacuggaagggcagagaacucaaguguggaaguggcaucuuugucacuaaugaaguccacacuuggacagagcaauauaaauuucaggcugacuccccaaaaagacuaucagcagccauugggaaggcaugggaggaaggcguguguggaauucgaucagccacacgucuugagaacaucauguggaagcaaauaucaaaugaauugaaccacauucuacuugaaaaugacaugaaauucacagugguuguaggagacgccuauggaaucuugacccaaggaaaaaagaugauuaggccacaacccauggaacacaaauacucauggaaaagcuggggaaaagccaaaaucauaggagcagauacacagaauacuaccuucaucaucgauggcccagacacuccagaaugccccgaugaccagagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaacgagaccuggaagcuagcgagagccuccuucauagaagugaagacaugcaucuggccaagaucccacacucuauggagcaauggagucuuggaaagugaaaugauaaucccaaagauauauggaggaccaauaucucagcacaacuacagaccaggguauuucacacaaacagcagggccauggcaccuaggcaaguuggaacuagacuuuaauuugugugaaggcaccacaguuguuguggaugaacauuguggaaaucgagguccaucucuuagaacuacaacagucacaggaaagauaauccaugaauggugcugcagauccugcacgcuaccccccuuacgcuucagaggagaagacggauguugguauggcauggaaaucagaccaguuaaggagaaggaagagaaucuagucaggucaauggucucugcagggucaggagaaguggacaguuuuucauugggacuacuaugcguaucaauaaugauugaagaagugaugagauccagauggaguagaaagaugcugaugacuggaacacuggcuguuuucuuccuucuuauaaugggacaacugacauggaaugaucugaucagguuaugcaucaugguuggagccaaugucucagacagaauggggaugggaacaacguaccuagcuuuaauggccacuuuuaaaaugagaccgauguucgcuguugggcuauuauuucgcagacuaacauccagagaggugcuccuucucacaauuggacuaagccugguggcauccguggagcuaccaaauucuuuagaggagcuaggggacggacuugcgaugggcaucaugauguuaaaauuguugacugauuuucagucacaccaguuguggacuaccuuacugucucugacauucaucaaaacaacucuuucacuggauuaugcauggaagacaauggcuaugguauugucaaucguaucucucuuuccucuaugucuauccacgaccucucaaaaaacaacauggcuuccgguguuguuaggauccuuuggauguaaaccacuaaccauguuucuuauaacagaaaacaaaauuuggggaaggaaaaguuggccccucaaugaaggaauuauggcuguuggaauagucagcauuuuacuaaguucacuccucaaaaaugacgugccacuagccggcccacuaauagcuggaggcaugcugauagcauguuacgucauauccggaagcucagccgauuuaucauuggagagagcggcugaggucuccugggaagaagaagcagaacacucuggugccucacacaacauacuaguggagguccaagaugauggaacuaugaaaauaaaagaugaagagagagaugacacgcucacuauacuccucaaagcaacuuuguuggcaguuucagggguguacccaaugucaauaccagcaacccuuuuugugugguauuuuuggcagaaaaagaaacagagaucaggagucuugugggacacacccagcccucccgaaguagaaagagcaguucuugaugaugguaucuauagaaucuugcaaagaggacuguuggguaggucccagguaggagugggaguuuuucaagacggcguguuccacacaauguggcaugucaccaggggggcuguccucauguaccaagggaagaggcuggaaccaaguugggccagugucaaaaaagacuugaucucauauggaggagguuggagguuucaaggaucauggaacacgggagaagaaguacaggugauagcuguugaaccagggaaaaacccaaagaauguacagacaacgccgggcaccuucaagaccccugaaggcgaaguuggagccauagcccuagauuucaaaccuggcacaucuggaucucccaucgugaacagagagggaaaaauaguaggucuuuauggaaauggaguggugacaacaaguggaaccuacgucagugccauugcccaagcuaaagcgucacaagaagggccucuaccagagauugaggacgagguguuuaagaaaagaaaccuaacaauaauggaccuacauccaggaucaggaaaaacaagaagauaucuuccagccauaguccgugaggccauaaaaaggaaacugcgcacgcuaaucuuggcucccacaagaguugucgccucugaaauggcagaggcgcuuaaaggaaugccaauaagauaucagacaacagcaguaaagagugaacacacaggaaaggagauagucgaucucaugugccacgccacuuucaccaugcgucuccuaucuccagugagaguucccaauuacaacaugauuaucauggaugaagcacacuuuaccgauccagccagcauagcggccagaggguacaucucaacccgaguggguaugggugaagcagcugcgaucuuuaugacagccacucccccaggaucgguagaggccuuuccacagagcaaugcaguuauccaagaugaggaaagagacauuccugagagaucauggaacucaggcuacgacuggaucacugauuucccaggaaaaacagucugguuuguuccaagcaucaaaucaggaaaugacauugccaacugcuuaagaaaaaacgggaaacgggugauccaauugagcagaaaaaccuuugacacugaauaccagaaaacgaaaaacaaugauugggacuauguugucacaacagacauuuccgaaaugggagcaaauuuccgggccgacaggguaauagacccaaggcggugcuugaagccgguaauacuaaaagauggcccagagcgcgucauucuagcuggaccaaugccagugaccgcggccagugcugcccagaggagaggaagaauuggaaggaaccaaaacaaggaaggugaccaguauauuuacaugggacagccuuuaaauaaugaugaggaccacgcucauuggacagaagcaaaaaugcuccuugacaauauaaauacgccagaagggauuaucccagcccucuuugagccagagagagaaaagagugcagcaauagacggggaguauagacugcggggagaagcaaggaaaacguucguggagcuaaugagaagaggggaucuaccaguuuggcuaucuuacaaaguugccucagaaggcuuccaguacuccgacagaagauggugcuuugacggggaaaggaacaaccagguguuggaggagaacauggacguggagaucuggacaaaagaaggagaaagaaagaaauugcgaccucgcugguuagaugccagaaccuacucugauccacuggcccugcgcgaguuuaaagaguucgcagcaggaagaagaagugucucaggugaccuaauauuagaaauagggaaacucccacagcauuugacgcuaagggcccagaaugcuuuggacaacuuggucauguugcacaauuccgaacaagggggaaaagccuauagacaugcuauggaagaacuaccagacaccauagaaacauugaugcuacuagccuugauagcugugcugacugguggaguuacguuguuuuuccuaucaggaaaaggucuagggaaaacauccauuggccuacuuuguguaauggccucaaguguacuguuauggauggccaguguggagccccauuggauagcagccuccaucauacuagaguuuuuucugauggugcugcucauuccagagccagacagacagcguacuccacaggacaaucaacuagcauauguggugauagguuuguuauucaugauauugacaguggcagccaaugagaugggauuacuggaaaccacaaagaaagaccuggggauuggccauguagucgccgaaaaccaccaccaugccacaaugcuagacauagacuuacauccagcuucagccuggacccucuaugcaguagccacaacaauuaucacucccaugaugagacacacaauugaaaacacaacggcaaacauuucccugacagcuauugcaaaucaggcggcuauauuaaugggacuugacaagggauggccaauaucgaagauggacauaggagugccacuucucgccuuagggugcuauucccaggugaacccauugacacugacagcggcgguguuaauguuaguggcucauuaugccauaaucggaccuggacugcaagcaaaagcuaccagagaagcccaaaaaaggacugcggccggaauaaugaaaaauccaacuguagacgggauuguugcaauagauuuggauccugugguuuaugaugcaaaauuugaaaaacagcuaggccaaauaauguuacuaauacucugcacaucacagauucucuugaugcggacuacaugggccuuaugugaaucuaucacacuggcuacuggacccuugaccacucucugggagggaucuccuggaagauucuggaauaccacgauagcaguguccauggcaaacaucuucaggggaaguuauuuagcaggggcaggucuggccuucucauuaaugaaaucuuuaggaggagguaggagaggcacgggagcucaaggggaaacauugggagaaaaauggaaaagacaacuaaaccaacugagcaagucagaauuuaacacuuacaaaaggaguggaauuauggagguggacagaucugaagccaaggagggaaugaaaagaggagaaacaaccaaacaugcagugucgagaggaacagccaaacuuaggugguuuguggagaggaaccuugugaaaccggaagggaaagugauagaccucgguuguggaagagguggcuggucauauuacugcgcugggcugaagaaggucacagaagugaagggauacacaaaaggaggacccggucaugaggaaccuaucccaauggcgacuuauggauggaacauagugaagcuacacucuggaagggauguauucuuuacaccaccugagaaaugugacacccuuuugugugauauuggugaguccucuccgaauccaacuauagaagaaggaagaacguuacguguucuaaagaugguggaaccauggcucagaggaaaucaguuuugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaaugcugcugaaucgguucacaauggcucacaggaagccaacguaugaaagagacguggacuugggcgcuggaacaagacauguggcaguggaaccagagauagccaaccuagacauuauuggccagaggauagagaacauaaaaaaugaacauaagucaacauggcauuaugaugaggacaauccauacaaaacaugggccuaucauggaucauaugaggucaagccaucagggucagccucauccauggugaauggcguggugagauugcucaccaagccaugggauguuauccccauggucacacaaauagcuaugacugauaccacacccuucggacaacagaggguuuucaaagagaaaguugacacacgcacaccaagaccaaaacgaggcacagcacaaauuauggaggugacagccaagugguuguggggauuccucucuagaaauaaaaaacccagaauuugcacaagagaggaguucacaagaaaaguuaggucaaacgcagcaauuggagcaguguuuguugaugaaaaccaauggaacucagcaaaagaagcaguggaagacgaaagguuuugggaccucgugcacagagagagggagcuucauaaacagggaaaaugugccacgugugucuacaauaugauggguaaaagagagaaaaaacuaggagaguuuggaaaggcaaaaggaagucgugcaauaugguacaugugguugggagcacgcuuucuagaauuugaagcccuuggcuucaugaaugaagaccacugguucaguagggagaauucacucaguggaguggaaggagaaggacuacauaaacuuggauacauacucagagacauaucaaagauuccagggggaaauauguaugcagacgacacagcuggaugggacacaagaauaacagaggaugaucuucagaaugaggcuaaaaucaccgacaucauggagccugaacaugcucuacuggcuacgucaaucuucaaacugaccuaucaaaauaaggugguaagggugcaaagaccagcaaaaaguggaaccgugauggacgucauauccagacgugaccagagaggaaguggacaggucggaacuuauggccuaaacacuuucaccaacauggagguccaacuaauaagacaaauggaaucugaaggaaucuuuucacccagcgaauuggaaaauucaaaucuagcugagagaguucucgacugguuggaaaaacauggcgucgaaagguugaaaagaauggcaaucagcggagaugacuguguggugaaaccaacugaugacagguucgcaacagcuuuaacagcccugaaugacaugggaaaggugagaaaagacauaccgcaaugggaaccuucaaaaggauggaaugacuggcagcaagugccuuucuguucacaccacuuccaccaacugauuaugaaggaugggagggagauaguggugccaugccgcaaccaagaugaacuugugggcagggccagaguaucacaaggcgccggguggagccugagagaaacugcuugccuaggcaagucauaugcacaaauguggcagcugauguacuuccacaggagagaccugagacuggcggcuaaugcuaucuguucagccguuccaguuaauugggucccaaccagccgcaccaccuggucgauccaugcccaccaucaauggaugacaacagaagacauguugucaguauggaauaggguuuggauagaggaaaacccauggauggaggacaaaacucauguauccagcugggaagauguuccauacuuaggaaaaagggaagaucaaugguguggaucucugauaggcuuaacagcaagagccaccugggccaccaacauacaaguggccauaaaccaagugagaaggcuuauugggaaugagaauuauuuagacuacaugacaucaaugaagagauucaagaaugagagugaucccgaaggagcccucugguaa

SEQ ID NO: 6287 - RNA, 9879 nt, Artificial Sequence
  derived and/or modified CDS sequence (wt) from DENV-1__KM403633__SS-prME
uccgugaccaugcuccucaugcugcugcccacagcccuggcguuccauuugaccacacgagggggagagccacacaugauaguuagcaagcaggaaagaggaaagucacucuuguuuaagaccucugcaggugucaacaugugcacccucauugcaauggauuugggagaguuaugugaggauacaaugaccuacaaaugcccccggaucacugaagcggaaccagaugauguugauugcuggugcaaugccacagacacaugggugaccuaugggacguguucucagacuggcgaacaccgacgggauaaacguucugucgcauuggccccacacguggggcuuggucucgaaacaagaaccgaaacguggauguccucugaaggcgccuggaggcagauacaaaaaguggagacuugggccuugagacacccaggauucacggugauagcccuuuuuuuagcacaugccauaggaacauccauuacccagaaagggaucaucuucauuuugcugaugcuggugacaccaucaauggccaugcgaugcgugggaauaggcaacagagacuucguugaaggacugucaggagcaacauggguggaugugguacuggagcauggaagcugugucaccaccauggcaaagaauaaaccaacauuggacauugaacucuugaagacggaggucacgaacccugccgucuugcgcaaacugugcauugaagcuaaaauaucaaacaccaccaccgauucaagauguccaacacaaggagaagcuacacugguggaagaacaagacgcgaacuuugugugucgacgaacauucguggacagaggcugggguaaugguuguggacuauucgggaagggaagcuuacuaacgugugcuaaguuuaagugugugacaaaacuugaaggaaagauaguucaauaugaaaacuuaaaauauucggugauagucacuguccacacuggggaccagcaccagguaggaaaugagacuacagaacauggaacaauugcaaccauaacaccucaagcucccacgucggaaauacagcugacugacuacggagcccuuacauuggacugcucaccuagaacagggcuggacuuuaaugagauggugcuguugacaaugagagaaaaaucauggcuuguccacaaacaaugguuucuagacuuaccauuaccuuggaccucgggggcuucaacaucucaagagacuuggaacagacaagaucugcuggucacauuuaagacagcucaugcaaagaagcaggaaguagucguacuggggucacaagaaggagcaaugcacacugcguugacuggggcgacagaaauccagacgucaggaacgacgacaaucuucgcaggacaccugaaauguagacuaaaaauggauaaacugacuuuaaaaggggugucauaugugaugugcacaggcucauuuaagcuagagaaggaaguggcugagacccagcauggaacuguccuagugcagguuaaauaugaaggaacagaugcaccaugcaagauuccaauuucaacccaagaugagaaaggagugacccagaaugggagauugauaacagccaaucccauaguuacugacaaagaaaaaccagucaacauugaaacagaaccacccuuuggugagagcuacaucgugauaggggcgggugaaaaagcuuugaaacuaagcugguuuaagaaaggaagcagcauagggaaaauguucgaagccaccgcccgaggagcacgaaggauggcuauccugggagacacagcaugggacuucgguuccauaggagggguguucacaucugugggaaaauugguacaccagguuuuuggaaccgcauaugggguccuguucagcgguguuucuuggaccaugaaaauaggaauagggauucugcugacauggcuaggauugaauucaaggagcacgucacucucgaugacgugcauugcaguuggcauggucacacuguaccuaggagucaugguucaagcggacucggggugugugaucaacuggaagggcagagaacucaaguguggaaguggcaucuuugucacuaaugaaguccacacuuggacagagcaauacaaauuucaggcugacuccccaaaaagacuaucagcagccauugggaaggcaugggaggaaggcguguguggaauucgaucagccacacgucuugagaacaucauguggaagcaaauaucaaaugaauugaaccacauucuacuugaaaaugacaugaaauucacagugguuguaggagacgccaauggaaucuugacccaaggaaaaaagaugauuaggccacaacccauggaacacaaauacucauggaaaagcuggggaaaagccaaaaucauaggagcagauacacagaauacuaccuucaucaucgauggcccagacacuccagaaugccccgaugaccagagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaacgagaccuggaagcuagcgagagccuccuucauagaagugaagacaugcaucuggccaagaucccacacucuauggagcaauggagucuuggaaagugaaaugauaaucccaaagauauauggaggaccaauaucucagcacaacuacagaccaggguauuucacacaaacagcagggccauggcaccuaggcaaguuggaacuagacuuuaauuugugugaaggcaccacaguuguuguggaugaacauuguggaaaucgagguccaucucuuagaacuacaacagucacaggaaagauaauccaugaauggugcugcagauccugcacgcuaccccccuuacgcuucagaggagaagacggauguugguauggcauggaaaucagaccagucaaggagaaggaagagaaucuagucaggucaauggucucugcagggucaggagaaguggacaguuuuucauugggacuacuaugcguaucaauaaugauugaagaagugaugagauccagauggaguagaaagaugcugaugacuggaacacuggcuguuuucuuccuucuuauaaugggacaacugacauggaaugaucugaucagguuaugcaucaugguuggagccaaugucucagacagaauggggaugggaacaacguaccuagcuuuaauggccacuuuuaaaaugagaccgauguucgcuguugggcuauuauuucgcagacuaacauccagagaggugcuccuucucacaauuggacuaagccugguggcauccguggagcuaccaaauucuuuagaggagcuaggggacggacuugcgaugggcaucaugauguuaaaauuguugacugauuuucagucacaccaguuguggacuaccuuacugucucugacauucaucaaaacaacucuuucacuagauuaugcauggaagacaauggcuaugguauugucaaucguaucucucuuuccucuaugucuauccacgaccucucaaaaaacaacauggcuuccgguguuguuaggauccuuuggauguaaaccacuaaccauguuucuuauaacagaaaacaaaauuuggggaaggaaaaguuggccccucaaugaaggaauuauggcuguuggaauagucagcauuuuacuaaguucacuccucaaaaaugacgugccacuagccggcccacuaauagcuggaggcaugcugauagcauguuacgucauuuccggaagcucagccgauuuaucauuggagagagcggcugaggucuccugggaagaagaagcagaacacucuggugccucacacaacauacuaguggagguccaagaugauggaaccaugaaaauaaaagaugaagagagagaugacacgcucacuauacuccucaaagcaacuuuguuggcaguuucagggguguacccaaugucaauaccagcaacccuuuuugugugguauuuuuggcagaaaaagaaacagagaucaggagucuugugggacacacccagcccuccagaaguagaaagagcaguucuugaugaugguaucuauagaaucuugcaaagaggacuguuggguaggucccagguaggagugggaguuuuucaagacggcguguuccacacaauguggcaugucaccaggggggcuguccucauguaccaagggaagaggcuggaaccaaguugggccagugucaaaaaagacuugaucucauauggaggagguuggagguuucaaggaucauggaacacgggagaagaaguacaggugauagcuguugaaccagggaaaaacccaaagaauguacagacaacgccgggcaccuucaagaccccugaaggcgaaguuggagccauagcccuagauuucaaaccuggcacaucuggaucucccaucgugaacagagaggggaaaauaguaggucuuuauggaaauggaguggugacaacaaguggaaccuacgucagugccauugcccaagcuaaagcgucacaagaagggccucuaccagagauugaggacgagguguuuaagaaaagaaaccuaacaauaauggaccuacauccaggaucaggaaaaacaagaagauaucuuccagccauaguccgugaggccauaaaaaggaaacugcgcacgcuaaucuuggcucccacaagaguugucgccucugaaauggcagaggcgcuuaaaggaaugccaauaagauaucagacaacagcaguaaagagugaacacacaggaaaggagauagucgaucucaugugccacgccacuuucaccaugcgucuccuaucuccagugagaguucccaauuacaacaugauuaucauggaugaagcacacuuuaccgauccagccagcauagcggccagaggguacaucucaacccgaguggguaugggugaagcagcugcgaucuucaugacagccacucccccaggaucgguagaggccuuuccacagagcaaugcaguuauccaagaugaggaaagagacauuccugagagaucauggaacucaggcuacgacuggaucacugacuucccaggaaaaacagucugguuuguuccaagcaucaaaucaggaaaugacauugccaacugcuuaagaaaaaacgggaaacgggugauccaauugagcagaaaaaccuuugacacugaauaccagaaaacgaaaaacaaugauugggacuauguugucacaacagacauuuccgaaaugggagcaaauuuccgggccgauaggguaauagacccaaggcggugcuugaagccgguaauacuaaaagauggcccagagcgcgucauucuggccggaccaaugccagugaccgcggccagugcugcccagaggagaggaagaauuggaaggaaccaaaacaaggaaggugaccaguauauuuacaugggacagccuuuaaauaaugaugaggaccacgcucauuggacagaagcaaaaaugcuccuugacaauauaaauacgccagaagggauuaucccagcccucuuugagccagagagagaaaagagugcagcaauagacggggaguauagacugcggggagaagcaaggaaaacguucguggagcuaaugagaagaggggaucuaccaguuuggcuaucuuacaaaguugccucagaaggcuuccaguacuccgacagaagauggugcuuugacggggaaaggaacaaccagguguuggaggagaacauggacguggagaucuggacaaaagaaggagaaagaaagaaauugcgaccucgcugguuagaugccagaaccuacucugauccacuggcccugcgcgaguuuaaggaguucgcagcaggaagaagaagugucucaggugaccuaauauuagaaauagggaaacucccacagcauuugacgcuaagggcccagaaugcuuuggacaacuuggucauguugcacaauuccgaacaagggggaaaagccuauagacaugcuauggaagaacuaccagacaccauagaaacauugaugcuacuagccuugauagcugugcugacugguggaguuacguuguuuuuccuaucaggaaaaggucuagggaaaacauccauuggccuacuuuguguaauggccucaaguguacuguuauggauggccaguguggagccccauuggauagcggccuccaucauacuagaguuuuuucugauggugcugcuuauuccagagccagacagacagcguacuccacaggacaaucaacuagcauauguggugauagguuuguuauucaugauauugacaguggcagccaaugagaugggauuacuggaaaccacaaagaaagaccuggggauuggccauguagucgccgaaaaccaccaccaugccacaaugcuagacauagacuuacauccagcuucagccuggacccucuaugcaguagccacaacaauuaucacucccaugaugagacacacaauugaaaacacaacggcaaacauuucccugacagcuauugcaaaucaggcggcuauauuaaugggacuugacaagggauggccaauaucgaagauggacauaggagugccacuucucgccuuagggugcuauucccaggugaacccauugacacugacagcggcgguguuaauguuaguggcucauuaugccauaauuggaccuggacugcaagcaaaagcuaccagagaagcccaaaaaaggacugcggccggaauaaugaaaaauccaacuguagacgggauuguugcaauagauuuggauccugugguuuaugaugcaaaauuugaaaaacagcuaggccaaauaauguuacuaauacucugcacaucacagauucucuugaugcggacuacaugggccuuaugugaaucuaucacacuggcuacuggacccuugaccacucucugggagggaucuccuggaaaauucuggaauaccacgauagcaguguccauggcaaacaucuucaggggaaguuauuuagcaggggcaggucuggccuucucauuaaugaaaucuuuaggaggagguaggagagguacgggagcucaaggggaaacauugggagaaaaauggaaaagacaacuaaaccaacugagcaagucagaauuuaacacuuacaaaaggaguggaauuauggagguggacagauccgaagccaaggagggacugaaaagaggagaaacaaccaaacaugcagugucgagaggaacagccaaacuuaggugguuuguggagaggaaccuugugaaaccggaagggaaagugauagaccucgguuguggaagagguggcuggucauauuacugcgcugggcugaagaaggucacagaaguaaagggauacacaaaaggaggacccggucaugaggaaccuaucccaauggcgacuuauggauggaacauagugaagcuacacucuggaagggauguauucuuuacaccaccugagaaaugugacacccuuuugugugauauuggugaguccucuccgaauccaacuauagaagaaggaagaacguuacguguucuaaagaugguggaaccauggcucagaggaaaucaguuuugcauaaaaauccuaaauccuuauaugccaagugugguagaaacucuggagcaaaugcaaagaaaacauggagggaugcuagugcgaaacccacucucaagaaauuccacccaugaaauguacugggucucauguggaacaggaaacauugugucggcagugaacaugacauccagaaugcugcugaaucgguucacaauggcucacaggaagccaacguaugaaagagacguggacuugggcgcuggaacaagacauguggcaguggaaccagagauagccaaccuagacauuauuggccagaggauagagaacauaaaaaaugaacauaagucaacauggcauuaugaugaggacaauccauacaaaacaugggccuaucauggaucauaugaggucaagccaucagggucagccucauccauggugaauggcguggugagauugcucaccaagccaugggauguuauccccauggucacacaaauagcuaugacugauaccacacccuucggacaacagaggguuuucaaagagaaaguugacacacgcacaccaagaccaaaacgaggcacagcacaaauuauggaggugacagccaagugguuguggggauuccucucuagaaauaaaaaacccagaaucugcacaagagaggaguucacaagaaaaguuaggucaaacgcagcaauuggagcaguguuuguugaugaaaaccaauggaacucagcaaaagaagcaguggaagacgaaagguuuugggaccucgugcacagagagagggagcuucauaaacagggaaaaugugccacgugugucuacaauaugauggguaaaagagagaaaaaacuaggagaguuuggaaaggcaaaaggaagucgugcaauaugguacaugugguugggagcacgcuuucuagaauuugaagcccuuggcuucaugaaugaagaccacugguucaguagggagaauucacucaguggaguggaaggagaaggacuacauaaacuuggauacauacucagagacauaucaaagauuccagggggaaauauguaugcagacgacacagcuggaugggacacaagaauaacagaggaugaucuccagaaugaggcuaaaaucaccgacaucauggagccugaacaugcucuacuggcuacgucaaucuucaagcugaccuaucaaaauaaggugguaagggugcaaagaccagcaaaaaguggaaccgugauggacgucauauccagacgugaccagagaggaaguggacaggucggaacuuauggccuaaacacuuucaccaacauggagguccaacuaauaagacaaauggaaucugaaggaaucuuuucacccagcgaauuggaaaauucaaaucuagcugagagaguucucgacugguuggaaaaacauggcgucgaaagguugaaaagaauggcaaucagcggagaugacuguguggugaaaccaacugaugacagguucgcaacagcuuuaacagcccugaaugacaugggaaaggugagaaaagacauaccgcaaugggaaccuucaaaaggauggaaugacuggcagcaagugccuuucuguucacaccacuuccaccaacugauuaugaaggaugggagggagauaguggugccaugccgcaaccaagaugaacuugugggcagggccagaguaucacaaggcgccggguggagccugagagaaacugcuugccuaggcaagucauaugcacaaauguggcagcugauguacuuccacaggagagaccugagacuggcggcuaaugcuaucuguucagccguuccaguuaauugggucccaaccagccgcaccaccuggucgauccaugcccaccaucaauggaugacaacagaagacauguugucaguauggaauaggguuuggauagaggaaaacccauggauggaggacaaaacucauguauccagcugggaagauguuccauacuuaggaaaaagggaagaucaaugguguggaucucugauaggcuuaacagcaagagccaccugggccaccaacauacaaguggccauaaaccaagugagaaggcuuauugggaacgagaauuauuuagacuacaugacaucaaugaagagauucaagaaugagagugaucccgaaggagcccucugguaa

SEQ ID NO: 6288 - RNA, 9879 nt, Artificial Sequence
  derived and/or modified CDS sequence (wt) from DENV-1__KM403592__SS-prME
uccgugaccaugcuccucaugcugcugcccacagcccuggcguuccauuugaccacacgagggggagagccacacaugauaguuagcaagcaggaaagaggaaagucacucuuguuuaagaccucugcaggugucaacaugugcacccucauugcaauggauuugggagaguuaugugaggauacaaugaccuacaaaugcccccggaucacugaagcggaaccagaugauguugauugcuggugcaaugccacagacacaugggugaccuaugggacguguucucagacuggcgaacaccgacgggauaaacguucugucgcauuggccccacacguggggcuuggucucgaaacaagaaccgaaacguggauguccucugaaggcgccuggaggcagauacaaaaaguggagacuugggccuugagacacccaggauucacggugauagcccuuuuuuuagcacaugccauaggaacauccauuacccagaaagggaucaucuucauuuugcugaugcuggugacaccaucaauggccaugcgaugcgugggaauaggcaacagagacuucguugaaggacugucaggagcaacauggguggaugugguacuggagcauggaagcugugucaccaccauggcaaagaauaaaccaacauuggacauugaacucuugaagacggaggucacgaacccugccgucuugcgcaaacugugcauugaagcuaaaauaucaaacaccaccaccgauucaagauguccaacacaaggagaagcuacacugguggaagaacaagacgcgaacuuugugugucgacgaacauucguggacagaggcugggguaaugguuguggacuauucgggaagggaagcuuacuaacgugugcuaaguuuaagugugugacaaaacuugaaggaaagauaguucaauaugaaaacuuaaaauauucggugauagucacuguccacacuggggaccagcaccagguaggaaaugagacuacagaacauggaacaauugcaaccauaacaccucaagcucccacgucggaaauacagcugacugacuacggagcccuuacauuggacugcucaccuagaacagggcuggacuuuaaugagauggugcuguugacaaugaaagaaaaaucauggcuuguccacaaacaaugguuucuagacuuaccauugccuuggaccucgggggcuucaacaucucaagagacuuggaacagacaagaucugcuggucacauuuaagacagcucaugcaaagaagcaggaaguagucguacuggggucacaagaaggagcaaugcacacugcguugacuggggcgacagaaauccagacgucaggaacgacgacaaucuucgcaggacaccugaaauguagacuaaaaauggauaaacugacuuuaaaaggggugucauaugugaugugcacaggcucauuuaagcuagagaaggaaguggcugagacccagcauggaacuguccuagugcagguuaaauaugaaggaacagaugcaccaugcaagauuccaauuucaacccaagaugagaaaggaguggcccagaaugggagauugauaacagccaaucccauaguuacugacaaagaaaaaccagucaacauugaaacagaaccacccuuuggugagagcuacaucgugauaggggcgggugaaaaagcuuugaaacuaagcugguucaagaaaggaagcagcauagggaaaauguucgaagccaccgcccgaggagcacgaaggauggcuauccugggagacacagcaugggacuucgguuccauaggagggguguucacaucugugggaaaauugguacaccagguuuuuggaaccgcauaugggguccuguucagcgguguuucuuggaccaugaaaauaggaauagggauucugcugacauggcuaggauugaauucaaggagcacgucacucucgaugacgugcauugcaguuggcauggucacacuguaccuaggagucaugguucaagcggacucggggugugugaucaacuggaagggcagagaacucaaguguggaaguggcaucuuugucacuaaugaaguccacacuuggacagagcaauacaaauuucaggcugacuccccaaaaagacuaucagcagccauugggaaggcaugggaggaaggcguguguggaauucgaucagccacacgucuugagaacaucauguggaagcaaauaucaaaugaauugaaccacauucuacuugaaaaugacaugaaauucacagugguuguaggagacgccaauggaaucuugacccaaggaaaaaagaugauuaggccacaacccauggaacacaaauacucauggaaaagcuggggaaaagccaaaaucauaggagcagauacacagaauacuaccuucaucaucgauggcccagacacuccagaaugccccgaugaccagagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaacgagaccuggaagcuagcgagagccuccuucauagaagugaagacaugcaucuggccaagaucccacacucuauggagcaauggagucuuggaaagugaaaugauaaucccaaagauauauggaggaccaauaucucagcacaacuacagaccaggguauuucacacaaacagcagggccauggcaccuaggcaaguuggaacuagacuuuaauuugugugaaggcaccacaguuguuguggaugaacauuguggaaaucgagguccaucucuuagaacuacaacagucacaggaaagauaauccaugaauggugcugcagauccugcacgcuaccccccuuacgcuucagaggagaagacggauguugguauggcauggaaaucagaccaguuaaggagaaggaagagaaucuagucaggucaauggucucugcagggucaggagaaguggacaguuuuucauugggacuacuaugcguaucaauaaugauugaagaagugaugagauccagauggaguagaaagaugcugaugacuggaacacuggcuguuuucuuccuucuuauaaugggacaacugacauggaaugaucuggucagguuaugcaucaugguuggagccaaugucucagacagaauggggaugggaacaacguaccuagcuuuaauggccacuuuuaaaaugagaccgauguucgcuguugggcuauuauuucgcagacuaacauccagagaggugcuccuucucacaauuggacuaagccugguggcauccguggagcuaccaaauucuuuagaggagcuaggggacggacuugcgaugggcaucaugauguuaaaauuguugacugauuuucagucacaccaguuguggacuaccuuacugucucugacauucaucaaaacaacucuuucacuggauuaugcauggaagacaauggcuaugguauugucaaucguaucucucuuuccucuaugucuauccacgaccucucaaaaaacaacauggcuuccgguguuguuaggauccuuuggauguaaaccacuaaccauguuucuuauaacagaaaacaaaauuuggggaaggaaaaguuggccccucaaugaaggaauuauggcuguuggaauagucagcauuuuacuaaguucacuccucaaaaaugacgugccacuagccggcccacuaauagcuggaggcaugcugauagcauguuacgucauuuccggaagcucagccgauuuaucauuggagagagcggcugaggucuccugggaagaagaagcagaacacucuggugccucacacaacauacuaguggagguccaagaugauggaacuaugaaaauaaaagaugaagagagagaugacacgcucacuauacuccucaaagcaacuuuguuggcaguuucagggguguacccaaugucaauaccagcaacccuuuuugugugguauuuuuggcagaaaaagaaacagagaucaggagucuugugggacacacccagcccuccagaaguagaaagagcaguucuugaugaugguaucuauagaaucuugcaaagaggacuguuggguaggucccagguaggagugggaguuuuucaagacggcguguuccacacaauguggcaugucaccaggggggcuguccucauguaccaagggaagaggcuggaaccaaguugggccagugucaaaaaagacuugaucucauauggaggagguuggagguuucaaggaucauggaacacgggagaagaaguacaggugauagcuguugaaccagggaaaaacccaaagaauguacagacaaugccgggcaccuucaagaccccugaaggcgaaguuggagccauagcccuagauuucaaaccuggcacaucuggaucucccaucgugaacagagaggggaaaauaguaggucuuuauggaaauggaguggugacaacaaguggaaccuacgucagugccauugcccaagcuaaagcgucacaagaagggccucuaccagagauugaggacgagguguuuaagaaaagaaaccuaacaauaauggaccuacauccaggaucaggaaaaacaagaagauaucuuccagccauaguccgugaggccauaaaaaggaaacugcgcacgcuaaucuuggcucccacaagaguugucgccucugaaauggcagaggcgcuuaaaggaaugccaauaagauaucagacaacagcaguaaagagugaacacacaggaaaggagauagucgaucucaugugccacgccacuuucaccaugcgucuccuaucuccagugagaguucccaauuacaacaugauuaucauggaugaagcacacuuuaccgauccagccagcauagcggccagaggguacaucucaacccgaguggguaugggugaagcagcugcgaucuuuaugacagccacucccccaggaucgguagaggccuuuccacagagcaaugcaguuauccaagaugaggaaagagacauuccugagagaucauggaacucaggcuacgacuggaucacugacuucccaggaaaaacagucugguuuguuccaagcaucaaaucaggaaaugacauugccaacugcuuaagaaaaaacgggaaacgggugauccaauugagcagaaaaaccuuugacacugaauaccagaaaacgaaaaacaaugauugggacuauguugucacaacagacauuuccgaaaugggagcaaauuuccgggccgauaggguaauagacccaaggcggugcuugaagccgguaauacuaaaagauggcccagagcgcgucauucuggccggaccaaugccagugaccgcggccagugcugcccagaggagaggaagaauuggaaggaaccaaaacaaggaaggugaccaguauauuuacaugggacagccuuuaaauaaugaugaggaccacgcucauuggacagaagcaaaaaugcuccuugacaauauaaauacgccagaagggauuaucccagcccucuuugagccagagagagaaaagagugcagcaauagacggggaguauagacugcggggagaagcaaggaaaacguucguggagcuaaugagaagaggggaucuaccaguuuggcuaucuuacaaaguugccucagaaggcuuccaguacuccgacagaagauggugcuuugacggggaaaggaacaaccagguguuggaggagaacauggacguggagaucuggacaaaagaaggagaaagaaagaaauugcgaccucgcugguuagaugccagaaccuacucugauccacuggcccugcgcgaguuuaaagaguucgcagcaggaagaagaagugucucaggugaccuaauauuagaaauagggaaacucccacagcauuugacgcuaagggcccagaaugcuuuggacaacuuggucauguugcacaauuccgaacaagggggaaaagccuauagacaugcuauggaagaacuaccagacaccauagaaacauugaugcuacuagccuugauagcugugcugacugguggaguuacguuguuuuuccuaucaggaaaaggucuagggaaaacauccauuggccuacuuuguguaauggccucaaguguacuguuauggauggccaguguggagccccauuggauagcggccuccaucauacuagaguuuuuucugauggugcugcuuauuccagagccagacagacagcguacuccacaggacaaucaacuagcauauguggugauagguuuguuauucaugauauugacaguggcagccaaugagaugggauuacuggaaaccacaaagaaagaccuggggauuggccauguagucgccgaaaaccaccaccaugccacaaugcuagacauagacuuacauccagcuucagccuggacccucuaugcaguagccacaacaauuaucacucccaugaugagacacacaauugaaaacacaacggcaaacauuucccugacagcuauugcaaaucaggcggcuauauuaaugggacuugacaagggauggccaauaucgaagauggacauaggagugccacuucucgccuuagggugcuauucccaggugaacccauugacacugacagcggcgguguuaauguuaguggcucauuaugccauaaucggaccuggacugcaagcaaaagcuaccagagaagcccaaaaaaggacugcggccggaauaaugaaaaauccaacuguagacgggauuguugcaauagauuuggauccugugguuuaugaugcaaaauuugaaaaacagcugggccaaauaauguuacuaauacucugcacaucacagauucucuugaugcggacuacaugggccuuaugugaaucuaucacacuggcuacuggacccuugaccacucucugggagggaucuccuggaaaauucuggaauaccacgauagcaguguccauggcaaacaucuucaggggaaguuauuuagcaggggcaggucuggccuucucauuaaugaaaucuuuaggaggagguaggagagguacgggagcucaaggggaaacauugggagaaaaauggaaaagacaacuaaaccaacugagcaagucagaauuuaacacuuacaaaaggaguggaauuauggagguggacagauccgaagccaaggagggacugaaaagaggagaaacaaccaaacaugcagugucgagaggaacagccaaacuuaggugguuuguggagaggaaccuugugaaaccggaagggaaagugauagaccucgguuguggaagagguggcuggucauauuacugcgcugggcugaagaaggucacagaaguaaagggauacacaaaaggaggacccggucaugaggaaccuaucccaauggcgacuuauggauggaacauagugaagcuacacucuggaagggauguauucuuuacaccaccugagaaaugugacacccuuuugugugauauuggugaguccucuccgaauccaacuauagaagaaggaagaacguuacguguucuaaagaugguggaaccauggcucagaggaaaucaguuuugcauaaaaauccuaaauccuuauaugccaagugugguagaaacucuggagcaaaugcaaagaaaacauggagggaugcuagugcgaaacccacucucaagaaauuccacccaugaaauguacugggucucauguggaacaggaaacauugugucggcagugaacaugacauccagaaugcugcugaaucgguucacaauggcucacaggaagccaacguaugaaagagacguggacuugggcgcuggaacaagacauguggcaguggaaccagagauagccaaccuagacauuauuggccagaggauagagaacauaaaaaaugaacauaagucaacauggcauuaugaugaggacaauccauacaaaacaugggccuaucauggaucauaugaggucaagccaucagggucagccucauccauggugaauggcguggugagauugcucaccaagccaugggauguuauccccauggucacacaaauagcuaugacugauaccacacccuucggacaacagaggguuuucaaagagaaaguugacacacgcacaccaagaccaaaacgaggcacagcacaaauuauggaggugacagccaagugguuguggggauuccucucuagaaauaaaaaacccagaaucugcacaagagaggaguucacaagaaaaguuaggucaaacgcagcaauuggagcaguguuuguugaugaaaaccaauggaacucagcaaaagaagcaguggaagacgaaagguuuugggaccucgugcacagagagagggagcuucauaaacagggaaaaugugccacgugugucuacaauaugauggguaaaagagagaaaaaacuaggagaguuuggaaaggcaaaaggaagucgugcaauaugguacaugugguugggagcacgcuuucuagaauuugaagcccuuggcuucaugaaugaagaccacugguucaguagggagaauucacucaguggaguggaaggagaaggacuacauaaacuuggauacauacucagagacauaucaaagauuccagggggaaauauguaugcagacgacacagcuggaugggacacaagaauaacagaggaugaucuucagaaugaggcuaaaaucaccgacaucauggagccugaacaugcucuacuggcuacgucaaucuucaagcugaccuaucaaaauaaggugguaagggugcaaagaccagcaaaaaguggaaccgugauggacgucauauccagacgugaccagagaggaaguggacaggucggaacuuauggccuaaacacuuucaccaacauggagguccaacuaauaagacaaauggaaucugaaggaaucuuuucacccagcgaauuggaaaauucaaaucuagcugagagaguucucgacugguuggaaaaacauggcgucgaaagguugaaaagaauggcaaucagcggagaugacuguguggugaaaccaacugaugacagguucgcaacagcuuuaacagcccugaaugacaugggaaaggugagaaaagacauaccgcaaugggaaccuucaaaaggauggaaugacuggcagcaagugccuuucuguucacaccacuuccaccaacugauuaugaaggaugggagggagauaguggugccaugccgcaaccaagaugaacuugugggcagggccagaguaucacaaggcgccggguggagccugagagaaacugcuugccuaggcaagucauaugcacaaauguggcagcugauguacuuccacaggagagaccugagacuggcggcuaaugcuaucuguucagccguuccaguuaauugggucccaaccagccgcaccaccuggucgauccaugcccaccaucaauggaugacaacagaagacauguugucaguauggaauaggguuuggauagaggaaaacccauggauggaggacaaaacucauguauccagcugggaagauguuccauacuuaggaaaaagggaagaucaaugguguggaucucugauaggcuuaacagcaagagccaccugggccaccaacauacaaguggccauaaaccaagugagaaggcuuauugggaacgagaauuauuuagacuacaugacaucaaugaagagauucaagaaugagagugaucccgaaggagcccucugguaa

SEQ ID NO: 6289 - RNA, 9879 nt, Artificial Sequence
  derived and/or modified CDS sequence (wt) from DENV-1__KM403593__SS-prME
uccgugaccaugcuccucaugcugcugcccacagcccuggcguuccauuugaccacacgagggggagagccacacaugauaguuagcaagcaggaaagaggaaagucacucuuguuuaagaccucugcaggugucaacaugugcacccucauugcaauggauuugggagaguuaugugaggauacaaugaccuacaaaugcccccggaucacugaagcggaaccagaugauguugauugcuggugcaaugccacagacacaugggugaccuaugggacguguucucagacuggcgaacaccgacgggauaaacguucugucgcauuggccccacacguggggcuuggucucgaaacaagaaccgaaacguggauguccucugaaggcgccuggaggcagauacaaaaaguggagacuugggccuugagacacccaggauucacggugauagcccuuuuuuuagcacaugccauaggaacauccauuacccagaaagggaucaucuucauuuugcugaugcuggugacaccaucaauggccaugcgaugcgugggaauaggcaacagagacuucguugaaggacugucaggagcaacauggguggaugugguacuggagcauggaagcugugucaccaccauggcaaagaauaaaccaacauuggacauugaacucuugaagacggaggucacgaacccugccgucuugcgcaaacugugcauugaagcuaaaauaucaaacaccaccaccgauucaagauguccaacacaaggagaagcuacacugguggaagaacaagacgcgaacuuugugugucgacgaacauucguggacagaggcugggguaaugguuguggacuauucgggaagggaagcuuacuaacgugugcuaaguuuaagugugugacaaaacuugaaggaaagauaguucaauaugaaaacuuaaaauauucggugauagucacuguccacacuggggaccagcaccagguaggaaaugagacuacagaacauggaacaauugcaaccauaacaccucaagcucccacgucggaaauacagcugacugacuacggagcccuuacauuggacugcucaccuagaacagggcuggacuuuaaugagauggugcuguugacaaugaaagaaaaaucauggcuuguccacaaacaaugguuucuagacuuaccauugccuuggaccucgggggcuucaacaucucaagagacuuggaacagacaagaucugcuggucacauuuaagacagcucaugcaaagaagcaggaaguagucguacuggggucacaagaaggagcaaugcacacugcguugacuggggcgacagaaauccagacgucaggaacgacgacaaucuucgcaggacaccugaaauguagacuaaaaauggauaaacugacuuuaaaaggggugucauaugugaugugcacaggcucauuuaagcuagagaaggaaguggcugagacccagcauggaacuguccuagugcagguuaaauaugaaggaacagaugcaccaugcaagauuccaauuucaacccaagaugagaaaggaguggcccagaaugggagauugauaacagccaaucccauaguuacugacaaagaaaaaccagucaacauugaaacagaaccacccuuuggugagagcuacaucgugauaggggcgggugaaaaagcuuugaaacuaagcugguucaagaaaggaagcagcauagggaaaauguucgaagccaccgcccgaggagcacgaaggauggcuauccugggagacacagcaugggacuucgguuccauaggagggguguucacaucugugggaaaauugguacaccagguuuuuggaaccgcauaugggguccuguucagcgguguuucuuggaccaugaaaauaggaauagggauucugcugacauggcuaggauugaauucaaggagcacgucacucucgaugacgugcauugcaguuggcauggucacacuguaccuaggagucaugguucaagcggacucggggugugugaucaacuggaagggcagagaacucaaguguggaaguggcaucuuugucacuaaugaaguccacacuuggacagagcaauacaaauuucaggcugacuccccaaaaagacuaucagcagccauugggaaggcaugggaggaaggcguguguggaauucgaucagccacacgucuugagaacaucauguggaagcaaauaucaaaugaauugaaccacauucuacuugaaaaugacaugaaauucacagugguuguaggagacgccaauggaaucuugacccaaggaaaaaagaugauuaggccacaacccauggaacacaaauacucauggaaaagcuggggaaaagccaaaaucauaggagcagauacacagaauacuaccuucaucaucgauggcccagacacuccagaaugccccgaugaccagagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaacgagaccuggaagcuagcgagagccuccuucauagaagugaagacaugcaucuggccaagaucccacacucuauggagcaauggagucuuggaaagugaaaugauaaucccaaagauauauggaggaccaauaucucagcacaacuacagaccaggguauuucacacaaacagcagggccauggcaccuaggcaaguuggaacuagacuuuaauuugugugaaggcaccacaguuguuguggaugaacauuguggaaaucgagguccaucucuuagaacuacaacagucacaggaaagauaauccaugaauggugcugcagauccugcacgcuaccccccuuacgcuucagaggagaagacggauguugguauggcauggaaaucagaccaguuaaggagaaggaagagaaucuagucaggucaauggucucugcagggucaggagaaguggacaguuuuucauugggacuacuaugcguaucaauaaugauugaagaagugaugagauccagauggaguagaaagaugcugaugacuggaacacuggcuguuuucuuccuucuuauaaugggacaacugacauggaaugaucugaucagguuaugcaucaugguuggagccaaugucucagacagaauggggaugggaacaacguaccuagcuuuaauggccacuuuuaaaaugagaccgauguucgcuguugggcuauuauuucgcagacuaacauccagagaggugcuccuucucacaauuggacuaagccugguggcauccguggagcuaccaaauucuuuagaggagcuaggggacggacuugcgaugggcaucaugauguuaaaauuguugacugauuuucagucacaccaguuguggacuaccuuacugucucugacauucaucaaaacaacucuuucacuggauuaugcauggaagacaauggcuaugguauugucaaucguaucucucuuuccucuaugucuauccacgaccucucaaaaaacaacauggcuuccgguguuguuaggauccuuuggauguaaaccacuaaccauguuucuuauaacagaaaacaaaauuuggggaaggaaaaguuggccccucaaugaaggaauuauggcuguuggaauagucagcauuuuacuaaguucacuccucaaaaaugacgugccacuagccggcccacuaauagcuggaggcaugcugauagcauguuacgucauuuccggaagcucagccgauuuaucauuggagagagcggcugaggucuccugggaagaagaagcagaacacucuggugccucacacaacauacuaguggagguccaagaugauggaacuaugaaaauaaaagaugaagagagagaugacacgcucacuauacuccucaaagcaacuuuguuggcaguuucagggguguacccaaugucaauaccagcaacccuuuuugugugguauuuuuggcagaaaaagaaacagagaucaggagucuugugggacacacccagcccuccagaaguagaaagagcaguucuugaugaugguaucuauagaaucuugcaaagaggacuguuggguaggucccagguaggagugggaguuuuucaagacggcguguuccacacaauguggcaugucaccaggggggcuguccucauguaccaagggaagaggcuggaaccaaguugggccagugucaaaaaagacuugaucucauauggaggagguuggagguuucaaggaucauggaacacgggagaagaaguacaggugauagcuguugaaccagggaaaaacccaaagaauguacagacaacgccgggcaccuucaagaccccugaaggcgaaguuggagccauagcccuagauuucaaaccuggcacaucuggaucucccaucgugaacagagaggggaaaauaguaggucuuuauggaaauggaguggugacaacaaguggaaccuacgucagugccauugcccaagcuaaagcgucacaagaagggccucuaccagagauugaggacgagguguuuaagaaaagaaaccuaacaauaauggaccuacauccaggaucaggaaaaacaagaagauaucuuccagccauaguccgugaggccauaaaaaggaaacugcgcacgcuaaucuuggcucccacaagaguugucgccucugaaauggcagaggcgcuuaaaggaaugccaauaagauaucagacaacagcaguaaagagugaacacacaggaaaggagauagucgaucucaugugccacgccacuuucaccaugcgucuccuaucuccagugagaguucccaauuacaacaugauuaucauggaugaagcacacuuuaccgauccagccagcauagcggccagaggguacaucucaacccgaguggguaugggugaagcagcugcgaucuuuaugacagccacucccccaggaucgguagaggccuuuccacagagcaaugcaguuauccaagaugaggaaagagacauuccugagagaucauggaacucaggcuacgacuggaucacugacuucccaggaaaaacagucugguuuguuccaagcaucaaaucaggaaaugacauugccaacugcuuaagaaaaaacgggaaacgggugauccaauugagcagaaaaaccuuugacacugaauaccagaaaacgaaaaacaaugauugggacuauguugucacaacagacauuuccgaaaugggagcaaauuuccgggccgauaggguaauagacccaaggcggugcuugaagccgguaauacuaaaagauggcccagagcgcgucauucuggccggaccaaugccagugaccgcggccagugcugcccagaggagaggaagaauuggaaggaaccaaaacaaggaaggugaccaguauauuuacaugggacagccuuuaaauaaugaugaggaccacgcucauuggacagaagcaaaaaugcuccuugacaauauaaauacgccagaagggauuaucccagcccucuuugagccagagagagaaaagagugcagcaauagacggggaguauagacugcggggagaagcaaggaaaacguucguggagcuaaugagaagaggggaucuaccaguuuggcuaucuuacaaaguugccucagaaggcuuccaguacuccgacagaagauggugcuuugacggggaaaggaacaaccagguguuggaggagaacauggacguggagaucuggacaaaagaaggagaaagaaagaaauugcgaccucgcugguuagaugccagaaccuacucugauccacuggcccugcgcgaguuuaaagaguucgcagcaggaagaagaagugucucaggugaccuaauauuagaaauagggaaacucccacagcauuugacgcuaagggcccagaaugcuuuggacaacuuggucauguugcacaauuccgaacaagggggaaaagccuauagacaugcuauggaagaacuaccagacaccauagaaacauugaugcuacuagccuugauagcugugcugacugguggaguuacguuguuuuuccuaucaggaaaaggucuagggaaaacauccauuggccuacuuuguguaauggccucaaguguacuguuauggauggccaguguggagccccauuggauagcggccuccaucauacuagaguuuuuucugauggugcugcuuauuccagagccagacagacagcguacuccacaggacaaucaacuagcauauguggugauagguuuguuauucaugauauugacaguggcagccaaugagaugggauuacuggaaaccacaaagaaagaccuggggauuggccauguagucgccgaaaaccaccaccaugccacaaugcuagacauagacuuacauccagcuucagccuggacccucuaugcaguagccacaacaauuaucacucccaugaugagacacacaauugaaaacacaacggcaaacauuucccugacagcuauugcaaaucaggcggcuauauuaaugggacuugacaagggauggccaauaucgaagauggacauaggagugccacuucucgccuuagggugcuauucccaggugaacccauugacacugacagcggcgguguuaauguuaguggcucauuaugccauaaucggaccuggacugcaagcaaaagcuaccagagaagcccaaaaaaggacugcggccggaauaaugaaaaauccaacuguagacgggauuguugcaauagauuuggauccugugguuuaugaugcaaaauuugaaaaacagcuaggccaaauaauguuacuaauacucugcacaucacagauucucuugaugcggacuacaugggccuuaugugaaucuaucacacuggcuacuggacccuugaccacucucugggagggaucuccuggaaaauucuggaauaccacgauagcaguguccauggcaaacaucuucaggggaaguuauuuagcaggggcaggucuggccuucucauuaaugaaaucuuuaggaggagguaggagagguacgggagcucaaggggaaacauugggagaaaaauggaaaagacaacuaaaccaacugagcaagucagaauuuaacacuuacaaaaggaguggaauuauggagguggacagauccgaagccaaggagggacugaaaagaggagaaacaaccaaacaugcagugucgagaggaacagccaaacuuaggugguuuguggagaggaaccuugugaaaccggaagggaaagugauagaccucgguuguggaagagguggcuggucauauuacugcgcugggcugaagaaggucacagaaguaaagggauacacaaaaggaggacccggucaugaggaaccuaucccaauggcgacuuauggauggaacauagugaagcuacacucuggaagggauguauucuuuacaccaccugagaaaugugacacccuuuugugugauauuggugaguccucuccgaauccaacuauagaagaaggaagaacguuacguguucuaaagaugguggaaccauggcucagaggaaaucaguuuugcauaaaaauccuaaauccuuauaugccaagugugguagaaacucuggagcaaaugcaaagaaaacauggagggaugcuagugcgaaacccacucucaagaaauuccacccaugaaauguacugggucucauguggaacaggaaacauugugucggcagugaacaugacauccagaaugcugcugaaucgguucacaauggcucacaggaagccaacguaugaaagagacguggacuugggcgcuggaacaagacauguggcaguggaaccagagauagccaaccuagacauuauuggccagaggauagagaacauaaaaaaugaacauaagucaacauggcauuaugaugaggacaauccauacaaaacaugggccuaucauggaucauaugaggucaagccaucagggucagccucauccauggugaauggcguggugagauugcucaccaagccaugggauguuauccccauggucacacaaauagcuaugacugauaccacacccuucggacaacagaggguuuucaaagagaaaguugacacacgcacaccaagaccaaaacgaggcacagcacaaauuauggaggugacagccaagugguuguggggauuccucucuagaaauaaaaaacccagaaucugcacaagagaggaguucacaagaaaaguuaggucaaacgcagcaauuggagcaguguuuguugaugaaaaccaauggaacucagcaaaagaagcaguggaagacgaaagguuuugggaccucgugcacagagagagggagcuucauaaacagggaaaaugugccacgugugucuacaauaugauggguaaaagagagaaaaaacuaggagaguuuggaaaggcaaaaggaagucgugcaauaugguacaugugguugggagcacgcuuucuagaauuugaagcccuuggcuucaugaaugaagaccacugguucaguagggagaauucacucaguggaguggaaggagaaggacuacauaaacuuggauacauacucagagacauaucaaagauuccagggggaaauauguaugcagacgacacagcuggaugggacacaagaauaacagaggaugaucuucagaaugaggcuaaaaucaccgacaucauggagccugaacaugcucuacuggcuacgucaaucuucaagcugaccuaucaaaauaaggugguaagggugcaaagaccagcaaaaaguggaaccgugauggacgucauauccagacgugaccagagaggaaguggacaggucggaacuuauggccuaaacacuuucaccaacauggagguccaacuaauaagacaaauggaaucugaaggaaucuuuucacccagcgaauuggaaaauucaaaucuagcugagagaguucucgacugguuggaaaaacauggcgucgaaagguugaaaagaauggcaaucagcggagaugacuguguggugaaaccaacugaugacagguucgcaacagcuuuaacagcccugaaugacaugggaaaggugagaaaagacauaccgcaaugggaaccuucaaaaggauggaaugacuggcagcaagugccuuucuguucacaccacuuccaccaacugauuaugaaggaugggagggagauaguggugccaugccgcaaccaagaugaacuugugggcagggccagaguaucacaaggcgccggguggagccugagagaaacugcuugccuaggcaagucauaugcacaaauguggcagcugauguacuuccacaggagagaccugagacuggcggcuaaugcuaucuguucagccguuccaguuaauugggucccaaccagccgcaccaccuggucgauccaugcccaccaucaauggaugacaacagaagacauguugucaguauggaauaggguuuggauagaggaaaacccauggauggaggacaaaacucauguauccagcugggaagauguuccauacuuaggaaaaagggaagaucaaugguguggaucucugauaggcuuaacagcaagagccaccugggccaccaacauacaaguagccauaaaccaagugagaaggcuuauugggaacgagaauuauuuagacuacaugacaucaaugaagagauucaagaaugagagugaucccgaaggagcccucugguaa

SEQ ID NO: 6290 - RNA, 9879 nt, Artificial Sequence
  derived and/or modified CDS sequence (wt) from DENV-1__KM403603__SS-prME
uccgugaccaugcuccucaugcugcugcccacagcccuggcguuccauuugacuacacgagggggagagccacacaugauaguuagcaagcaggaaagaggaaagucacucuuguuuaagaccucugcaggugucaacaugugcacccucauugcaauggauuugggagaguuaugugaggauacaaugaccuacaaaugcccccggaucacugaagcggaaccagaugauguugauugcuggugcaaugccacagacacaugggugaccuaugggacguguucucagacuggcgaacaccgacgggauaaacguucugucgcauuggccccacacguggggcuuggucucgaaacaagaaccgaaacguggauguccucugaaggcgccuggaggcagauacaaaaaguggagacuugggccuugagacacccaggauucacggugauagcccuuuuuuuagcacaugccauaggaacauccauuacccagaaagggaucaucuucauuuugcugaugcuggugacaccaucaauggccaugcgaugcgugggaauaggcaacagagacuucguugaaggacugucaggagcaacauggguggaugugguauuggagcauggaagcugugucaccaccauggcaaagaauaaaccaacauuggacauugaacucuugaagacggaggucacgaacccugccgucuugcgcaaacugugcauugaagcuaaaauaucaaacaccaccaccgauucaagauguccaacacaaggagaagcuacacugguggaagaacaagacgcgaacuuugugugucgacgaacauucguggacagaggcugggguaaugguuguggacuauucgggaagggaagcuuacuaacgugugcuaaguuuaagugugugacaaaacuugaaggaaagauaguucaauaugaaaacuuaaaauauucggugauagucacuguccacacuggggaccagcaccagguaggaaaugagacuacagaacauggaacaauugcaaccauaacaccucaagcucccacgucggaaauacagcugacugacuacggagcccuuacauuggacugcucaccuagaacagggcuggacuuuaaugagauggugcuguugacaaugaaagaaaaaucauggcuuguccacaaacaaugguuucuagacuugccauugccuuggaccucgggggcuucaacaucucaagagacuuggaacagacaagaucugcuggucacauuuaagacagcucaugcaaagaagcaggaaguagucguacuggggucacaagaaggagcaaugcacacugcguugacuggggcgacagaaauccagacgucaggaacgacgacaaucuucgcaggacaccugaaauguagacuaaaaauggauaaacugacuuuaaaaggggugucauaugugaugugcacaggcucauuuaagcuagagaaggaaguggcugagacccagcauggaacuguccuagugcagguuaaauaugaaggaacagaugcaccaugcaagauuccaauuucaacccaagaugagaaaggagugacccagaaugggagauugauaacagccaaucccauaguuacugacaaagaaaaaccagucaacauugaaacagaaccacccuuuggugagagcuacaucgugauaggggcgggugaaaaagcuuugaaacuaagcugguucaagaaaggaagcagcauagggaaaauguucgaagccaccgcccgaggagcacgaaggauggcuauccugggagacacagcaugggacuucgguuccauaggagggguguucacaucugugggaaaauugguacaccagguuuuuggaaccgcauaugggguccuguucagcgguguuucuuggaccaugaaaauaggaauagggauucugcugacauggcuaggauugaauucaaggagcacgucacucucgaugacgugcauugcaguuggcauggucacacuguaccuaggagucaugguucaagcggacucggggugugugaucaacuggaagggcagagaacucaaguguggaaguggcaucuuugucacuaaugaaguccacacuuggacagagcaauacaaauuucaggcugacuccccaaaaagacuaucagcagccauugggaaggcaugggaggaaggcguguguggaauucgaucagccacacgucuugagaacaucauguggaagcaaauaucaaaugaauugaaccacauucuacuugaaaaugacaugaaguucacagugguuguaggagacgccaauggaaucuugacccaaggaaaaaagaugauuaggccacaacccauggaacacaaauacucauggaaaagcuggggaaaagccaaaaucauaggagcagauacacagaauacuaccuucaucaucgauggcccagacacuccagaaugccccgaugaccagagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaacgagaccuggaagcuagcgagagccuccuucauagaagugaagacaugcaucuggccaagaucccacacucuauggagcaauggagucuuggaaagugaaaugauaaucccaaagauauauggaggaccaauaucucagcacaacuacagaccaggguauuucacacaaacagcagggccauggcaccuaggcaaguuggaacuagacuuuaauuugugugaaggcaccacaguuguuguggaugaacauuguggaaaucgagguccaucucuuagaacuacaacagucacaggaaagauaauccaugaauggugcugcagauccugcacgcuaccccccuuacgcuucagaggagaagacggauguugguauggcauggaaaucagaccaguuaaggagaaggaagagaaucuagucaggucaauggucucugcagggucaggagaaguggacaguuuuucauugggacuacuaugcguaucaauaaugauugaagaagugaugagauccagauggaguagaaagaugcugaugacuggaacacuggcuguuuucuuccuucuuauaaugggacaacugacauggaaugaucugaucagguuaugcaucaugguuggagccaaugucucagacagaauggggaugggaacaacguaccuagcuuuaauggccacuuuuaaaaugagaccgauguucgcuguugggcuauuauuucgcagacuaacauccagagaggugcuccuucucacaauuggacuaagccugguggcauccguggagcuaccaaauucuuuagaggagcuaggggacggacuugcgaugggcaucaugauguugaaauuguugacugauuuucagucacaccaguuguggacuaccuuacugucucugacauucaucaaaacaacucuuucacuggauuaugcauggaagacaauggcuaugguauugucaaucguaucucucuuuccucuaugucuauccacgaccucucaaaaaacaacauggcuuccgguguuguuaggauccuuuggauguaaaccacuaaccauguuucuuauaacagaaaacaaaauuuggggaaggaaaaguuggccccucaaugaaggaauuauggcuguuggaauagucagcauuuuacuaaguucacuccucaaaaaugacgugccacuagccggcccacuaauagcuggaggcaugcugauagcauguuacgucauuuccggaagcucagccgauuuaucauuggagagagcggcugaggucuccugggaagaagaagcagaacacucuggugccucacacaacauacuaguggagguccaagaugauggaacuaugaaaauaaaagaugaagagagagaugacacgcucacuauacuccucaaagcaacuuuguuggcaguuucagggguguacccaaugucaauaccagcaacccuuuuugugugguauuuuuggcagaaaaagaaacagagaucaggagucuugugggacacacccagcccuccagaaguagaaagagcaguucuugaugaugguaucuauagaaucuugcaaagaggacuguuggguaggucccagguaggagugggaguuuuucaagacggcguguuccacacaauguggcaugucaccaggggggcuguccucauguaccaagggaagaggcuggaaccaaguugggccagugucaaaaaagacuugaucucauauggaggagguuggagguuucaaggaucauggaacacgggagaagaaguacaggugauagcuguugaaccagggaaaaacccaaagaauguacagacaacgccgggcaccuucaagaccccugaaggcgaaguuggagccauagcccuagauuucaaaccuggcacaucuggaucucccaucgugaacagagaggggaaaauaguaggucuuuauggaaauggaguggugacaacaaguggaaccuacgucagugccauugcccaagcuaaagcgucacaagaagggccucuaccagagauugaggacgagguguuuaagaaaagaaaccuaacaauaauggaccuacauccaggaucaggaaaaacaagaagauaucuuccagccauaguccgugaggccauaaaaaggaaacugcgcacgcuaaucuuggcucccacaagaguugucgccucugaaauggcagaggcgcuuaaaggaaugccaauaagauaucagacaacagcaguaaagagugaacacacaggaaaggagauagucgaucucaugugccacgccacuuucaccaugcgucuccuaucuccagugagaguucccaauuacaacaugauuaucauggaugaagcacacuuuaccgauccagccagcauagcggccagaggguacaucucaacccgaguggguaugggugaagcagcugcgaucuuuaugacagccacucccccaggaucgguagaggccuuuccacagagcaaugcaguuauccaagaugaggaaagagacauuccugagagaucauggaacucaggcuacgacuggaucacugacuucccaggaaaaacagucugguuuguuccaagcaucaaaucaggaaaugacauugccaacugcuuaagaaaaaacgggaaacgggugauccaauugagcagaaaaaccuuugacacugaauaccagaaaacgaaaaacaaugauugggacuauguugucacaacagacauuuccgaaaugggagcaaauuuccgggccgauaggguaauagacccaaggcggugcuugaagccgguaauacuaaaagauggcccagagcgcgucauucuggccggaccaaugccagugaccgcggccagugcugcccagaggagaggaagaauuggaaggaaccaaaacaaggaaggugaccaguauauuuacaugggacagccuuuaaauaaugaugaggaccacgcucauuggacagaagcaaaaaugcuccuugacaauauaaauacgccagaagggauuaucccagcccucuuugagccagagagagaaaagagugcagcaauagacggggaguauagacugcggggagaagcaaggaaaacguucguggagcuaaugagaagaggggaucuaccaguuuggcuaucuuacaaaguugccucagaaggcuuccaguacuccgacagaagauggugcuuugacggggaaaggaacaaccagguguuggaggagaacauggacguggagaucuggacaaaagaaggagaaagaaagaaauugcgaccucgcugguuagaugccagaaccuacucugauccacuggcccugcgcgaguuuaaagaguucgcagcaggaagaagaagugucucaggugaccuaauauuagaaauagggaaacucccacagcauuugacgcuaagggcccagaaugcuuuggacaacuuggucauguugcacaauuccgaacaagggggaaaagccuauagacaugcuauggaagaacuaccagacaccauagaaacauugaugcuacuagccuugauagcugugcugacugguggaguuacguuguuuuuccuaucaggaaaaggucuagggaaaacauccauuggccugcuuuguguaauggccucaaguguacuguuauggauggccaguguggagccccauuggauagcggccuccaucauacuagaguuuuuucugauggugcugcuuauuccagagccagacagacagcguacuccacaggacaaucaacuagcauauguggugauagguuuguuauucaugauauugacaguggcagccaaugagaugggauuacuggaaaccacaaagaaagaccuggggauuggccauguagucgccgaaaaccaccaccaugccacaaugcuagacauagacuuacauccagcuucagccuggacccucuaugcaguagccacaacaauuaucacucccaugaugagacacacaauugaaaacacaacggcaaacauuucccugacagcuauugcaaaucaggcggcuauauuaaugggacuugacaagggauggccaauaucgaagauggacauaggagugccacuucucgccuuagggugcuauucccaggugaacccauugacacugacagcggcgguguuaauguuaguggcucauuaugccauaaucggaccuggacugcaagcaaaagcuaccagagaagcccaaaaaaggacugcggccggaauaaugaaaaauccaacuguggacgggauuguugcaauagauuuggauccugugguuuaugaugcaaaauuugaaaaacagcuaggccaaauaauguuacuaauacucugcacaucacagauucucuugaugcggacuacaugggccuuaugugaaucuaucacacuggcuacuggacccuugaccacucucugggagggaucuccuggaaaauucuggaauaccacgauagcaguguccauggcaaacaucuucaggggaaguuauuuagcaggggcaggucuggccuucucauuaaugaaaacuuuaggaggagguaggagagguacgggagcucaaggggaaacauugggagaaaaauggaaaagacaacuaaaccaacugagcaagucagaauuuaacacuuacaaaaggaguggaauuauggagguggacagauccgaagccaaggagggacugaaaagaggagaaacaaccaaacaugcagugucgagaggaacagccaaacuuaggugguuuguggagaggaaccuugugaaaccggaagggaaagugauagaccucgguuguggaagagguggcuggucauauuacugcgcugggcugaagaaggucacagaaguaaagggauacacaaaaggaggacccggucaugaggaaccuaucccaauggcgacuuauggauggaacauagugaagcuacacucuggaagggauguauucuuuacaccaccugagaaaugugacacccuuuugugugauauuggugaguccucuccgaauccaacuauagaagaaggaagaacguuacguguucuaaagaugguggaaccauggcucagaggaaaucaguuuugcauaaaaauccuaaauccuuauaugccaagugugguagaaacucuggagcaaaugcaaagaaaacauggagggaugcuagugcgaaacccacucucaagaaauuccacccaugaaauguacugggucucauguggaacaggaaacauugugucggcagugaacaugacauccagaaugcugcugaaucgguucacaauggcucacaggaagccaacguaugaaagagacguggacuugggcgcuggaacaagacauguggcaguggaaccagagauagccaaccuagacauuauuggccagaggauagagaacauaaaaaaugaacauaagucaacauggcauuaugaugaggacaauccauacaaaacaugggccuaucauggaucauaugaggucaagccaucagggucagccucauccauggugaauggcguggugagauugcucaccaagccaugggauguuauccccauggucacacaaauagcuaugacugauaccacacccuucggacaacagaggguuuucaaagagaaaguugacacacgcacaccaagaccaaaacgaggcacagcacaaauuauggaggugacagccaagugguuguggggauuccucucuagaaauaaaaaacccagaaucugcacaagagaggaguucacaagaaaaguuaggucaaacgcagcaauuggagcaguguuuguugaugaaaaccaauggaacucagcaaaagaagcaguggaagacgaaagguuuugggaccucgugcacagagagagggagcuucauaaacagggaaaaugugccacgugugucuacaauaugauggguaaaagagagaaaaaacuaggagaguuuggaaaggcaaaaggaagucgugcaauaugguacaugugguugggagcacgcuuucuagaauuugaagcccuuggcuucaugaaugaagaccacugguucaguagggagaauucacucaguggaguggaaggagaaggacuacauaaacuuggauacauacucagagacauaucaaagauuccagggggaaauauguaugcagacgacacagcuggaugggacacaagaauaacagaggaugaucuucagaaugaggcuaaaaucaccgacaucauggagccugaacaugcucuacuggcuacgucaaucuucaagcugaccuaucaaaauaaggugguaagggugcaaagaccagcaaaaaguggaaccgugauggacgucauauccagacgugaccagagaggaaguggacaggucggaacuuauggccuaaacacuuucaccaacauggagguccaacuaauaagacaaauggaaucugaaggaaucuuuucacccagcgaauuggaaaauucaaaucuagcugagagaguucucgacugguuggaaaaacauggcgucgaaagguugaaaagaauggcaaucagcggagaugacuguguggugaaaccaacugaugacagguucgcaacagcuuuaacagcccugaaugacaugggaaaggugagaaaagacauaccgcaaugggaaccuucaaaaggauggaaugacuggcagcaagugccuuucuguucacaccacuuccaccaacugauaaugaaggaugggagggagauaguggugccaugccgcaaccaagaugaacuugugggcagggccagaguaucacaaggcgccggguggagccugagagaaacugcuugccuaggcaagucauaugcacaaauguggcagcugauguacuuccacaggagagaccugagacuggcggcuaaugcuaucuguucagccguuccaguuaauugggucccaaccagccgcaccaccuggucgauccaugcccaccaucaauggaugacaacagaagacauguugucaguauggaauaggguuuggauagaggaaaacccauggauggaggacaaaacucauguauccagcugggaagauguuccauacuuaggaaaaagggaagaucaaugguguggaucucugauaggcuuaacagcaagagccaccugggccaccaacauacaaguggccauaaaccaagugagaaggcuuauugggaacgagaauuauuuagacuacaugacaucaaugaagagauucaagaaugagagugaucccgaaggagcccucugguaa

SEQ ID NO: 6291 - RNA, 9879 nt, Artificial Sequence
  derived and/or modified CDS sequence (wt) from DENV-1__KM403585__SS-prME
uccgugaccaugcuccucaugcugcugcccacagcccuggcguuccauuugaccacacgagggggagagccacacaugauaguuagcaagcaggaaagaggaaagucacucuuguuuaagaccucugcaggugucaacaugugcacccucauugcaauggauuugggagaguuaugugaggauacaaugaccuacaaaugcccccggaucacugaagcggaaccagaugauguugauugcuggugcaaugccacagacacaugggugaccuaugggacguguucucagacuggcgaacaccgacgggauaaacguucugucgcauuggccccacacguggggcuuggucucgaaacaagaaccgaaacguggauguccucugaaggcgccuggaggcagauacaaaaaguggagacuugggccuugagacacccaggauucacggugauagcccuuuuucuagcacaugccauaggaacauccauuacccagaaagggaucaucuucauuuugcugaugcuggugacaccaucaauggccaugcgaugcgugggaauaggcaacagagacuucguugaaggacugucaggagcaacauggguggaugugguacuggagcauggaagcugugucaccaccauggcaaagaauaaaccaacauuggacauugaacucuugaagacggaggucacgaacccugccgucuugcgcaaacugugcauugaagcuaaaauaucaaacaccaccaccgauucaagauguccaacacaaggagaagcuacacugguggaagaacaagacgcgaacuuugugugucgacgaacauucguggacagaggcugggguaaugguuguggacuauucgggaagggaagcuuacuaacgugugcuaaguuuaagugugugacaaaacuugaaggaaggauaguucaauaugaaaacuuaaaauauucggugauagucacuguccacacuggggaccagcaccagguaggaaaugagacuacagaacauggaacaauugcaaccauaacaccucaagcucccacgucggaaguacagcugacugacuacggagcccuuacauuggacugcucaccuagaacagggcuggacuuuaaugagauggugcuguugacaaugaaagaaaaaucauggcuuguccacaaacaaugguuucuagacuuaccauugccuuggaccucgggggcuucaacaucucaagagacuuggaacagacaagaucugcuggucacauuuaagacagcucaugcaaagaagcaggaaguagucguacuggggucacaagaaggagcaaugcacacugcguugacuggggcgacagaaauccagacgucaggaacgacgacaaucuucgcaggacaccugaaauguagacuaaaaauggauaaacugacuuuaaaaggggugucauaugugaugugcacaggcucauuuaagcuagagaaggaaguggcugagacccagcauggaacuguccuagugcagguuaaauaugaaggaacagaugcaccaugcaagauuccaauuucaacccaagaugagaaaggagugacccagaaugggagauugauaacagccaaucccauagucacugacaaagaaaaaccagucaacauugaaacagaaccacccuuuggugagagcuacaucgugauaggggcgggugaaaaagcuuugaaacuaagcugguucaagaaaggaagcagcauagggaaaauguucgaagccaccgcccgaggagcacgaaggauggcuauccugggagacacagcaugggacuucgguuccauaggagggguguucacaucugugggaaaauugguacaccagguuuuuggaaccgcauaugggguccuguucagcgguguuucuuggaccaugaaaauaggaauagggauucugcugacauggcuaggauugaauucaaggagcacgucacucucgaugacgugcauugcaguuggcauggucacacuguaccuaggagucaugguucaagcggacucggggugugugaucaacuggaagggcagagaacucaaguguggaaguggcaucuuugucacuaaugaaguccacacuuggacagagcaauauaaauuucaggcugacuccccaaaaagacuaucagcagccauugggaaggcaugggaggaaggcguguguggaauucgaucagccacacgucuugagaacaucauguggaagcaaauaucaaaugaauugaaccacauucuacuugaaaaugacaugaaauucacagugguuguaggagacgccuauggaaucuugacccaaggaaaaaagaugauuaggccacaacccauggaacacaaauacucauggaaaagcuggggaaaagccaaaaucauaggagcagauacacagaauacuaccuucaucaucgauggcccagacacuccagaaugccccgaugaccagagagcauggaacauuugggaaguugaggacuauggguuuggaguuuucacgacaaauauauggcugaaauugcgugacuccuacacccaaaugugugaccaccggcuaaugucagcugccaucaaggacagcaaggcaguccaugcugacaugggguacuggauagaaagugaaaagaacgagaccuggaagcuagcgagagccuccuucauagaagugaagacaugcaucuggccaagaucccacacucuauggagcaauggagucuuggaaagugaaaugauaaucccaaagauauauggaggaccaauaucucagcacaacuacagaccaggguauuucacacaaacagcagggccauggcaccuaggcaaguuggaacuagacuuuaauuugugugaaggcaccacaguuguuguggaugaacauuguggaaaucgagguccaucucuuagaacuacaacagucacaggaaagauaauccaugaauggugcugcagauccugcacgcuaccccccuuacgcuucagaggagaagacggauguugguauggcauggaaaucagaccaguuaaggagaaggaagagaaucuagucaggucaauggucucugcagggucaggagaaguggacaguuuuucauugggacuacuaugcguaucaauaaugauugaagaagugaugagauccagauggaguagaaagaugcugaugacuggaacacuggcuguuuucuuccuucuuauaaugggacaacugacauggaaugaucugaucagguuaugcaucaugguuggagccaaugucucagacagaauggggaugggaacaacguaccuagcuuuaauggccacuuuuaaaaugagaccgauguucgcuguugggcuauuauuucgcagacuaacauccagagaggugcuccuucucacaauuggacuaagccugguggcauccguggagcuaccaaauucuuuagaggagcuaggggacggacuugcgaugggcaucaugauguuaaaauuguugacugauuuucagucacaccaguuguggacuaccuuacugucucugacauucaucaaaacaacucuuucacuggauuaugcauggaagacaauggcuaugguauugucaaucguaucucucuuuccucuaugucuauccacgaccucucaaaaaacaacauggcuuccgguguuguuaggauccuuuggauguaaaccacuaaccauguuucuuauaacagaaaacaaaauuuggggaaggaaaaguuggccccucaaugaaggaauuauggcuguuggaauagucagcauuuuacuaaguucacuccucaaaaaugacgugccacuagccggcccacuaauagcuggaggcaugcugauagcauguuacgucauauccggaagcucagccgauuuaucauuggagagagcggcugaggucuccugggaagaagaagcagaacauucuggugccucacacaacauacuaguggagguccaagaugauggaacuaugaaaauaaaagaugaagagagagaugacacgcucacuauacuccucaaagcaacuuuguuggcaguuucagggguguacccaaugucaauaccagcaacccuuuuugugugguauuuuuggcagaaaaagaaacagagaucaggagucuugugggacacacccagcccuccugaaguagaaagagcaguucuugaugaugguaucuauagaaucuugcaaagaggacuguuggguaggucccagguaggagugggaguuuuucaagacggcguguuccacacaauguggcaugucaccaggggggcuguccucauguaccaagggaagaggcuggaaccaaguugggccagugucaaaaaagacuugaucucauauggaggagguuggagguuucaaggaucauggaacacgggagaagaaguacaggugauagcuguugaaccagggaaaaacccaaagaauguacagacaacgccgggcaccuucaagaccccugaaggcgaaguuggagccauagcccuagauuucaaaccuggcacaucuggaucucccaucgugaacagagagggaaaaauaguaggucuuuauggaaauggaguggugacaacaaguggaaccuacgucagugccauugcccaagcuaaagcgucacaagaagggccucuaccagagauugaggacgagguguuuaagaaaagaaaccuaacaauaauggaccuacauccaggaucaggaaaaacaagaagauaucuuccagccauaguccgugaggccauaaaaaggaaacugcgcacgcuaaucuuggcucccacaagaguugucgccucugaaauggcagaggcgcuuaaaggaaugccaauaagauaucagacaacagcaguaaagagugaacacacaggaaaggagauagucgaucucaugugccacgccacuuucaccaugcgucuccuaucuccagugagaguucccaauuacaacaugauuaucauggaugaagcacacuuuaccgauccagccagcauagcggccagaggguacaucucaacccgaguggguaugggugaagcagcugcgaucuuuaugacagccacucccccaggaucgguagaggccuuuccacagagcaaugcaguuauccaagaugaggaaagagacauuccugagagaucauggaacucaggcuacgacuggaucacugauuucccaggaaaaacagucugguuuguuccaagcaucaaaucaggaaaugacauugccaacugcuuaagaaaaaacgggaaacgggugauccaauugagcagaaaaaccuuugacacugaauaccagaaaacgaaaaacaaugauugggacuauguugucacaacagacauuuccgaaaugggagcaaauuuccgggccgacaggguaauagacccaaggcggugcuugaagccgguaauacuaaaagauggcccagagcgcgucauucuagcuggaccaaugccagugaccgcggccagugcugcccagaggagaggaagaauuggaaggaaccaaaacaaggaaggugaccaguauauuuacaugggacagccuuuaaauaaugaugaggaccacgcucauuggacagaagcaaaaaugcuccuugacaauauaaauacgccagaagggauuaucccagcccucuuugagccagagagagaaaagagugcagcaauagacggggaguauagacugcggggagaagcaaggaaaacguucguggagcuaaugagaagaggggaucuaccaguuuggcuaucuuacaaaguugccucagaaggcuuccaguacuccgacagaagauggugcuuugacggggaaaggaacaaccagguguuggaggagaacauggacguggagaucuggacaaaagaaggagaaaggaagaaauugcgaccucgcugguuagaugccagaaccuacucugauccacuggcccugcgcgaguuuaaagaguucgcagcaggaagaagaagugucucaggugaccuaauauuagaaauagggaaacucccacagcauuugacgcuaagggcccagaaugcuuuggacaacuuggucauguugcacaauuccgaacaagggggaaaagccuauagacaugcuauggaagaacuaccagacaccauagaaacauugaugcuacuagccuugauagcugugcugacugguggaguuacguuguuuuuccuaucaggaaaaggucuagggaaaacauccauuggccuacuuuguguaauggccucaaguguacuguuauggauggccaguguggagccccauuggauagcagccuccaucauacuagaguuuuuucugauggugcugcucauuccagagccagacagacagcguacuccacaggacaaucaacuagcauauguggugauagguuuguuauucaugauauugacaguggcagccaaugagaugggauuacuggaaaccacaaagaaagaccuggggauuggccauguagucgccgaaaaccaccaccaugccacaaugcuagacauagacuuacauccagcuucagccuggacccucuaugcaguagccacaacaauuaucacucccaugaugagacacacaauugaaaacacaacggcaaacauuucccugacagcuauugcaaaucaggcggcuauauuaaugggacuugacaagggauggccaauaucgaagauggacauaggagugccacuucucgccuuagggugcuauucccaggugaacccauugacacugacagcggcgguguuaauguuaguggcucauuaugccauaaucggaccuggacugcaagcaaaagcuaccagagaagcccaaaaaaggacugcggccggaauaaugaaaaauccaacuguagacgggauuguugcaauagauuuggauccugugguuuaugaugcaaaauuugaaaaacagcuaggccaaauaauguuacuaauacucugcacaucacagauucucuugaugcggacuacaugggccuuaugugaaucuaucacacuggcuacuggacccuugaccacucucugggagggaucuccuggaagauucuggaauaccacgauagcaguguccauggcaaacaucuucaggggaaguuauuuagcaggggcaggucuggccuucucauuaaugaaaucuuuaggaggagguaggagaggcacgggagcucaaggggaaacauugggagaaaaauggaaaagacaacuaaaccaacugagcaagucagaauuuaacacuuacaaaaggaguggaauuguggagguggacagaucugaagccaaggagggaaugaaaagaggagaaacaaccaaacaugcagugucgagaggaacagccaaacuuaggugguuuguggagaggaaccuugugaaaccggaagggaaagugauagaccucgguuguggaagagguggcuggucauauuacugcgcugggcugaagaaggucacagaagugaagggauacacaaaaggaggacccggucaugaggaaccuaucccaauggcgacuuauggauggaacauagugaagcuacacucuggaagggauguauucuuuacaccaccugagaaaugugacacccuuuugugugauauuggugaguccucuccgaauccaacuauagaagaaggaagaacguuacguguucuaaagaugguggaaccauggcucagaggaaaucaguuuugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaaugcugcugaaucgguucacaauggcucacaggaagccaacguaugaaagagacguggacuugggcgcuggaacaagacauguggcaguggaaccagagauagccaaccuagacauuauuggccagaggauagagaacauaaaaaaugaacauaagucaacauggcauuaugaugaggacaauccauacaaaacaugggccuaucauggaucauaugaggucaagccaucagggucagccucauccauggugaauggcguggugagauugcucaccaagccaugggauguuauccccauggucacacaaauagcuaugacugauaccacacccuucggacaacagaggguuuucaaagagaaaguugacacacgcacaccaagaccaaaacgaggcacagcacaaauuauggaggugacagccaagugguuguggggauuccucucuagaaauaaaaaacccagaauuugcacaagagaggaguucacaagaaaaguuaggucaaacgcagcaauuggagcaguguuuguugaugaaaaccaauggaacucagcaaaagaagcaguggaagacgaaagguuuugggaccucgugcacagagagagggagcuucauaaacagggaaaaugugccacgugugucuacaauaugauggguaaaagagagaaaaaacuaggagaguuuggaaaggcaaaaggaagucgugcaauaugguacaugugguugggagcacgcuuucuagaauuugaagcccuugguuucaugaaugaagaccacugguucaguagggagaauucacucaguggaguggaaggagaaggacuacauaaacuuggauacauacucagagacauaucaaagauuccagggggaaauauguaugcagacgacacagcuggaugggacacaagaauaacagaggaugaucuucagaaugaggcuaaaaucaccgacaucauggagccugaacaugcucuacuggcuacgucaaucuucaaacugaccuaucaaaauaaggugguaagggugcaaagaccagcaaaaaguggaaccgugauggacgucauauccagacgugaccagagaggaaguggacaggucggaacuuauggccuaaacacuuucaccaacauggagguccaacuaauaagacaaauggaaucugaaggaaucuuuucacccagcgaauuggaaaauucaaaucuagcugagagaguucucgacugguuggaaaaacauggcgucgaaagguugaaaagaauggcaaucagcggagaugacuguguggugaaaccaacugaugacagguucgcaacagcuuuaacagcccugaaugacaugggaaaggugagaaaagacauaccgcaaugggaaccuucaaaaggauggaaugacuggcagcaagugccuuucuguucacaccacuuccaccaacugauuaugaaggaugggagggagauaguggugccaugccgcaaccaagaugaacuugugggcagggccagaguaucacaaggcgccggguggagccugagagaaacugcuugccuaggcaagucauaugcacaaauguggcagcugauguacuuccacaggagagaccugagacuggcggcuaaugcuaucuguucagccguuccaguuaauugggucccaaccagccgcaccaccuggucgauccaugcccaccaucaauggaugacaacagaagacauguugucaguauggaauaggguuuggauagaggaaaacccauggauggaggacaaaacucauguauccagcugggaagauguuccauacuuaggaaaaagggaagaucaaugguguggaucucugauaggcuuaacagcaagagccaccugggccaccaacauacaaguggccauaaaccaagugagaaggcuuauugggaaugagaauuauuuagacuacaugacaucaaugaagagauucaagaaugagagugaucccgaaggagcccucugguaa

SEQ ID NO: 6292 - RNA, 9879 nt, Artificial Sequence
  derived and/or modified CDS sequence (wt) from DENV-1__KM403595__SS-prME
uccgugaccaugcuccucaugcugcugcccacagcccuggcguuccauuugaccacacgagggggagagccacacaugauaguuagcaagcaggaaagaggaaagucacucuuguuuaagaccucugcaggugucaacaugugcacccucauugcaauggauuugggagaguuaugugaggauacaaugaccuacaaaugcccccggaucacugaagcggaaccagaugauguugauugcuggugcaaugccacagacacaugggugaccuaugggacguguucucagacuggcgaacaccgacgggauagacguucugucgcauuggccccacacguggggcuuggucucgaaacaagaaccgaaacguggauguccucugaaggcgccuggaggcagauacaaagaguggagacuugggccuugagacacccaggauucacggugauagcccuuuuuuuagcacaugccauaggaacauccauuacccagaaagggaucaucuucauuuugcugaugcuggugacaccaucaauggccaugcgaugcgugggaauaggcaacagagacuucguugaaggacugucaggagcaacauggguggaugugguacuggagcauggaagcugugucaccaccauggcaaagaauaaaccaacauuggacauugaacucuugaagacggaggucacgaacccugccgucuugcgcaaacugugcauugaagcuaaaauaucaaacaccaccaccgauucaagauguccaacacaaggagaagcuacacugguggaagaacaagacgcgaacuuugugugucgacgaacauucguggacagaggcugggguaaugguuguggacuauucgggaagggaagcuuacuaacgugugcuaaguuuaagugugugacaaaacuugaaggaaagauaguucaauaugaaaacuuaaaauauucggugauagucacuguccacacuggggaccagcaccagguaggaaaugagacuacagaacauggaacaauugcaaccauaacaccucaagcucccacgucggaaauacagcugacugacuacggagcccuuacauuggacugcucaccuagaacagggcuggacuuuaaugagauggugcuguugacaaugaaagaaaaaucauggcuuguccacaaacaaugguuucuagacuuaccauugccuuggaccucgggggcuucaacaucucaagagacuuggaacagacaagaucugcuggucacauuuaagacagcucaugcaaagaagcaggaaguagucguacuggggucacaagaaggagcaaugcacacugcguugacuggggcgacagaaauccagacgucaggaacgacgacaaucuucgcaggacaccugaaauguagacuaaaaauggauaaacugacuuuaaaaggggugucauaugugaugugcacaggcucauuuaagcuagagaaggaaguggcugagacccagcauggaacuguccuagugcagguuaaauaugaaggaacagaugcaccaugcaagauuccaauuucaacccaagaugagaaaggagugacccagaaugggagauugauaacagccaaucccauaguuacugacaaagaaaaaccagucaacauugaaauagaaccacccuuuggugagagcuacaucgugauaggggcgggugaaaaagcuuugaaacuaagcugguucaagaaaggaagcagcauagggaaaauguucgaagccaccgcccgaggagcacgaaggauggcuauccugggagacacagcaugggacuucgguuccauaggagggguguucacaucugugggaaaauugguacaccagguuuuuggaaccgcauaugggguccuguucagcgguguuucuuggaccaugaaaauaggaauagggauucugcugacauggcuaggauugaauucaaggagcacgucacucucgaugacgugcauugcaguuggcauggucacacuguaccuaggagucaugguucaagcggacucggggugugugaucaacuggaagggcagagaacucaaguguggaaguggcaucuuugucacuaaugaaguccacacuuggacagagcaauacaaauuucaggcugacuccccaaaaagacuaucagcagccauugggaaggcaugggaggaaggcguguguggaauucgaucagccacacgucuugagaacaucauguggaagcaaauaucaaaugaauugaaccacauucuacuugaaaaugacaugaaauucacagugguuguaggagacgccaauggaaucuugacccaaggaaaaaagaugauuaggccacaacccauggaacacaaauacucauggaaaagcuggggaaaagccaaaaucauaggagcagauacacagaauacuaccuucaucaucgauggcccagacacuccagaaugccccgaugaccagagagcauggaacauuugggaaguugaggacuauggguuuggaguuuucacgacaaacauauggcugaaauugcgugacuccuacacccaaaugugugaucaccggcuaaugucagcugccaucaaggacagcaaggcaguccaugcugacaugggguacuggauagaaagugaaaagaacgagaccuggaagcuagcgagagccuccuucauagaagugaagacaugcaucuggccaagaucccacacucuauggagcaauggagucuuggaaagugaaaugauaaucccaaagauauauggaggaccaauaucucagcacaacuacagaccaggguauuucacacaaacagcagggccauggcaccuaggcaaguuggaacuagacuuuaauuugugugaaggcaccacaguuguuguggaugaacauuguggaaaucgagguccaucucuuagaacuacaacagucacaggaaagauaauccaugaauggugcugcagauccugcacgcuaccccccuuacgcuucagaggagaagacggauguugguauggcauggaaaucagaccaguuaaggagaaggaagagaaucuagucaggucaauggucucugcagggucaggagaaguggacaguuuuucauugggacuacuaugcguaucaauaaugauugaagaagugaugagauccagauggaguagaaagaugcugaugacuggaacacuggcuauuuucuuccuucuuauaaugggacaacugacauggaaugaucugaucagguuaugcaucaugguuggagccaaugucucagacagaauggggaugggaacaacguaccuagcuuuaauggccacuuuuaaaaugagaccgauguucgcuguugggcuauuauuucgcagacuaacauccagagaggugcuccuucucacaauuggacuaagccugguggcauccguggagcuaccaaauucuuuagaggagcuaggggacggacuugcgaugggcaucaugauguuaaaauuguugacugauuuucagucacaccaguuguggacuaccuuacugucucugacauucaucaaaacaacucuuucacuggauuaugcauggaagacaauggcuaugguauugucaaucguaucucucuuuccucuaugucuauccacgaccucucaaaaaacaacauggcuuccgguguuguuaggauccuuuggauguaaaccacuaaccauguuucuuauaacagaaaacaaaauuuggggaaggaaaaguuggccccucaaugaaggaauuauggcuguuggaauagucagcauuuuacuaaguucacuccucaaaaaugacgugccacuagccggcccacuaauagcuggaggcaugcugauagcauguuacgucauuuccggaagcucagccgauuuaucauuggagagagcggcugaggucuccugggaagaagaagcagaacacucuggugccucacacaacauacuaguggagguccaagaugauggaacuaugaaaauaaaagaugaagagagagaugacacgcucacuauacuccucaaagcaacuuuguuggcaguuucagggguguacccaaugucaauaccagcaacccuuuuugugugguauuuuuggcagaaaaagaaacagagaucaggagucuugugggacacacccagcccuccagaaguagaaagagcaguucuugaugaugguaucuauagaaucuugcaaagaggacuguuggguaggucccagguaggagugggaguuuuucaagacggcguguuccacacaauguggcaugucaccaggggggcuguccucauguaccaagggaagaggcuggaaccaaguugggccagugucaaaaaagacuugaucucauauggaggagguuggagguuucaaggaucauggaacacgggagaagaaguacaggugauagcuguugaaccagggaaaaacccaaagaauguacagacaacgccgggcaccuucaagaccccugaaggcgaaguuggagccauagcccuagauuucaaaccuggcacaucuggaucucccaucgugaacagagaggggaaaauaguaggucuuuauggaaauggaguggugacaacaaguggaaccuacgucagugccauugcccaagcuaaagcgucacaagaagggccucuaccagagauugaggacgagguguuuaagaaaagaaaccuaacaauaauggaccuacauccaggaucaggaaaaacaagaagauaucuuccagccauaguccgugaggccauaaaaaggaaacugcgcacgcuaaucuuggcucccacaagaguugucgccucugaaauggcagaggcgcuuaaaggaaugccaauaagauaucagacaacagcaguaaagagugaacacacaggaaaggagauagucgaucucaugugccacgccacuuucaccaugcgucuccuaucuccagugagaguucccaauuacaacaugauuaucauggaugaagcacacuuuaccgauccagccagcauagcggccagaggguacaucucaacccgaguggguaugggugaagcagcugcgaucuuuaugacagccacucccccaggaucgguagaggccuuuccacagagcaaugcaguuauccaagaugaggaaagagacauuccugagagaucauggaacucaggcuacgacuggaucacugauuucccaggaaaaacagucugguuuguuccaagcaucaaaucaggaaaugacauugccaacugcuuaagaaaaaacgggaaacgggugauccaauugagcagaaaaaccuuugacacugaauaccagaaaacgaaaaacaaugauugggacuauguugucacaacagacauuuccgaaaugggagcaaauuuccgggccgauaggguaauagacccaaggcggugcuugaagccgguaauacuaaaagauggcccagagcgcgucauucuggccggaccaaugccagugaccgcggccagugcugcccagaggagaggaagaauuggaaggaaccaaaacaaggaaggugaccaguauauuuacaugggacagccuuuaaauaaugaugaggaccacgcucauuggacagaagcaaaaaugcuccuugacaauauaaauacgccagaagggauuaucccagcccucuuugagccagagagagaaaagagugcagcaauagacggggaguauagacugcggggagaagcaaggaaaacguucguggagcuaaugagaagaggggaucuaccaguuuggcuaucuuacaaaguugccucagaaggcuuccaguacuccgacagaagauggugcuuugacggggaaaggaacaaccagguguuggaggagaacauggacguggagaucuggacaaaagaaggagaaagaaagaaauugcgaccucgcugguuagaugccagaaccuacucugauccacuggcccugcgcgaguuuaaagaguucgcagcaggaagaagaagugucucaggugaccuaauauuagaaauagggaaacucccacagcauuugacgcuaagggcccagaaugcuuuggacaacuuggucauguugcacaauuccgaacaagggggaaaagccuauagacaugcuauggaagaacuaccagacaccauagaaacauugaugcuacuagccuugauagcugugcugacugguggaguuacguuguuuuuccuaucaggaaaaggucuagggaaaacauccauuggccuacuuuguguaauggccucaaguguacuguuauggauggccaguguggagccccauuggauagcggccuccaucauacuagaguuuuuucugauggugcugcuuauuccagagccagacagacagcguacuccacaggacaaucaacuagcauauguggugauagguuuguuauucaugauauugacaguggcagccaaugagaugggauuacuggaaaccacaaagaaagaccuggggauuggccauguagucgccgaaaaccaccaccaugccacaaugcuagacauagacuuacauccagcuucagccuggacccucuaugcaguagccacaacaauuaucacucccaugaugagacacacaauugaaaacacaacggcaaacauuucccugacagcuauugcaaaucaggcggcuauauuaaugggacuugacaagggauggccaauaucgaagauggacauaggagugccacuucucgccuuagggugcuauucccaggugaacccauugacacugacagcggcgguguuaauguuaguggcucauuaugccauaaucggaccuggacugcaagcaaaagcuaccagagaagcccaaaaaaggacugcggccggaauaaugaaaaauccaacuguagacgggauuguugcaauagauuuggauccugugguuuaugaugcaaaauuugaaaaacagcuaggccaaauaauguuacuaauacucugcacaucacagauucucuugaugcggacuacaugggccuuaugugaaucuaucacacuggcuacuggacccuugaccacucucugggagggaucuccuggaaaauucuggaauaccacgauagcaguguccauggcaaacaucuucaggggaaguuauuuagcaggggcaggucuggccuucucauuaaugaaaucuuuaggaggagguaggagagguacgggagcucaaggggaaacauugggagaaaaauggaaaagacaacuaaaccaacugagcaagucagaauuuaacacuuacaaaaggaguggaauuauggagguggacagauccgaagccaaggagggacugaaaagaggagaaacaaccaaacaugcagugucgagaggaacagccaaacuuaggugguuuguggagaggaaccuugugaaaccggaagggaaagugauagaccucgguuguggaagagguggcuggucauauuacugcgcugggcugaagaaggucacagaaguaaagggauacacaaaaggaggacccggucaugaggaaccuaucccaauggcgacuuauggauggaacauagugaagcuacacucuggaagggauguauucuuuacaccaccugagaaaugugacacccuuuugugugauauuggugaguccucuccgaauccaacuauagaagaaggaagaacguuacguguucuaaagaugguggaaccauggcucagaggaaaucaguuuugcauaaaaauccuaaauccuuauaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaaugcugcugaaucgguucacaauggcucacaggaagccaacguaugaaagagacguggacuugggcgcuggaacaagacauguggcaguggaaccagagacagccaaccuagacauuauuggccagaggauagagaacauaaaaaaugaacauaagucaacauggcauuaugaugaggacaauccauacaaaacaugggccuaucauggaucauaugaggucaagccaucagggucagccucauccauggugaauggcguggugagauugcucaccaagccaugggauguuauccccauggucacacaaauagcuaugacugauaccacacccuucggacaacagaggguuuucaaagagaaaguugacacacgcacaccaagaccaaaacgaggcacagcacaaauuauggaggugacagccaagugguuguggggauuccucucuagaaauaaaaaacccagaaucugcacaagagaggaguucacaagaaaaguuaggucaaacgcagcaauuggagcaguguuuguugaugaaaaccaauggaacucagcaaaagaagcaguggaagacgaaagguuuugggaccucgugcacagagagagggagcuucauaaacagggaaaaugugccacgugugucuacaauaugauggguaaaagagagaaaaaacuaggagaguuuggaaaggcaaaaggaagucgugcaauaugguacaugugguugggagcacgcuuucuagaauuugaagcccuuggcuucaugaaugaagaccacugguucaguagggagaauucacucaguggaguggaaggagaaggacuacauaaacuuggauacauacucagagacauaucaaagauuccagggggaaauauguaugcagacgacacagcuggaugggacacaagaauaacagaggaugaucuucagaaugaggcuaaaaucaccgacaucauggagccugaacaugcucuacuggcuacgucaaucuucaagcugaccuaucaaaauaaggugguaagggugcaaagaccagcaaaaaguggaaccgugauggacgucauauccagacgugaccagagaggaaguggacaggucggaacuuauggccuaaacacuuucaccaacauggagguccaacuaauaagacaaauggaaucugaaggaaucuuuucacccagcgaauuggaaaauucaaaucuagcugagagaguucucgacugguuggaaaaacauggcgucgaaagguugaaaagaauggcaaucagcggagaugacuguguggugaaaccaacugaugacagguucgcaacagcuuuaacagcccugaaugacaugggaaaggugagaaaagacauaccgcaaugggaaccuucaaaaggauggaaugacuggcagcaagugccuuucuguucacaccacuuccaccaacugauuaugaaggaugggagggagauaguggugccaugccgcaaccaagaugaacuugugggcagggccagaguaucacaaggcgccggguggagccugagagaaacugcuugccuaggcaagucauaugcacaaauguggcagcugauguacuuccacaggagagaccugagacuggcggcuaaugcuaucuguucagccguuccaguuaauugggucccaaccagccgcaccaccuggucgauccaugcccaccaucaauggaugacaacagaagacauguugucaguauggaauaggguuuggauagaggaaaacccauggauggaggacaaaacucauguauccagcugggaagauguuccauacuuaggaaaaagggaagaucaaugguguggaucucugauaggcuuaacagcaagagccaccugggccaccaacauacaaguggccauaaaccaagugagaaggcuuauugggaacgagaauuauuuagacuacaugacaucaaugaagagauucaagaaugagagugaucccgaaggagcccucugguaa

SEQ ID NO: 6293 - RNA, 9879 nt, Artificial Sequence
  derived and/or modified CDS sequence (wt) from DENV-1__KM403604__SS-prME
uccgugaccaugcuccucaugcugcugcccacagcccuggcguuccauuugaccacacgagggggagagccacacaugauaguuagcaagcaggaaagaggaaagucacucuuguuuaagaccucugcaggugucaacaugugcacccucauugcaauggauuugggagaguuaugugaggauacaaugaccuacaaaugcccccggaucacugaagcggaaccagaugauguugauugcuggugcaaugccacagacacaugggugaccuaugggacguguucucagacuggcgaacaccgacgggauaaacguucugucgcauuggccccacacguggggcuuggucucgaaacaagaaccgaaacguggauguccucugaaggcgccuggaggcagauacaaaaaguggagacuugggccuugagacacccaggauucacggugauagcccuuuuuuuagcacaugccauaggaacauccauuacccagaaagggaucaucuucauuuugcugaugcuggugacaccaucaauggccaugcgaugcgugggaauaggcaacagagacuucguugaaggacugucaggagcaacauggguggaugugguauuggagcauggaagcugugucaccaccauggcaaagaauaaaccaacauuggacauugaacucuugaagacggaggucacgaacccugccgucuugcgcaaacugugcauugaagcuaaaauaucaaacaccaccaccgauucaagauguccaacacaaggagaagcuacacugguggaagaacaagacgcgaacuuugugugucgacgaacauucguggacagaggcugggguaaugguuguggacuauucgggaagggaagcuuacuaacgugugcuaaguuuaagugugugacaaaacuugaaggaaagauaguucaauaugaaaacuuaaaauauucggugauagucacuguccacacuggggaccagcaccagguaggaaaugagacuacagaacaaggaacaauugcaaccauaacaccucaagcucccacgucggaaauacagcugacugacuacggagcccuuacauuggacugcucaccuagaacagggcuggacuuuaaugagauggugcuguugacaaugaaagaaaaaucauggcuuguccacaaacaaugguuucuagacuuaccauugccuuggaccucgggggcuucaacaucucaagagacuuggaacagacaagaucugcuggucacauuuaagacagcucaugcaaagaagcaggaaguagucguacuggggucacaagaaggagcaaugcacacugcguugacuggggcgacagaaauccagacgucaggaacgacgacaaucuucgcaggacaccugaaauguagacuaaaaauggauaaacugacuuuaaaaggggugucauaugugaugugcacaggcucauuuaagcuagagaaggaaguggcugagacccagcauggaacuguccuagugcagguuaaauaugaaggaacagaugcaccaugcaagauuccaauuucaacccaagaugagaaaggagugacccagaaugggagauugauaacagccaaucccauaguuacugacaaagaaaaaccagucaacauugaaacagaaccacccuuuggugagagcuacaucgugauaggggcgggugaaaaagcuuugaaacuaagcugguucaagaaaggaagcagcauagggaaaauguucgaagccaccgcccgaggagcacgaaggauggcuauccugggagacacagcaugggacuucgguuccauaggagggguguucacaucugugggaaaauugguacaccagguuuuuggaaccgcauaugggguccuguucagcgguguuucuuggaccaugaaaauaggaauagggauucugcugacauggcuaggauugaauucaaggagcacgucacucucaaugacgugcauugcaguuggcauggucacacuguaccuaggagucaugguucaagcggacucggggugugugaucaacuggaagggcagagaacucaaguguggaaguggcaucuuugucacuaaugaaguccacacuuggacagagcaauacaaauuucaggcugacuccccaaaaagacuaucagcagccauugggaaggcaugggaggaaggcguguguggaauucgaucagccacacgucuugagaacaucauguggaagcaaauaucaaaugaauugaaccacauucuacuugaaaaugacaugaaauucacagugguuguaggagacgccaauggaaucuugacccaaggaaaaaagaugauuaggccacaacccauggaacacaaauacucauggaaaagcuggggaaaagccaaaaucauaggagcagauacacagaauacuaccuucaucaucgauggcccagacacuccagaaugccccgaugaccagagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaacgagaccuggaagcuagcgagagccuccuucauagaagugaagacaugcaucuggccaagaucccacacucuauggagcaauggagucuuggaaagugaaaugauaaucccaaagauauauggaggaccaauaucucagcacaacuacagaccaggguauuucacacaaacagcagggccauggcaccuaggcaaguuggaacuagacuuuaauuugugugaaggcaccacaguuguuguggaugaacauuguggaaaucgagguccaucucuuagaacuacaacagucacaggaaagauaauccaugaauggugcugcagauccugcacgcuaccccccuuacgcuucagaggagaagacggauguugguauggcauggaaaucagaccaguuaaggagaaggaagagaaucuagucaggucaauggucucugcagggucaggagaaguggacaguuuuucauugggacuacuaugcguaucaauaaugauugaagaagugaugagauccagauggaguagaaagaugcugaugacuggaacacuggcuguuuucuuccuucuuauaaugggacaacugacauggaaugaucugaucagguuaugcaucaugguuggagccaaugucucagacagaauggggaugggaacaacguaccuagcuuuaauggccacuuuuaaaaugagaccgauguucgcuguugggcuauuauuucgcagacuaacauccagagaggugcuccuucucacaauuggacuaagccugguggcauccguggagcuaccaaauucuuuagaggagcuaggggacggacuugcgaugggcaucaugauguuaaaauuguugacugauuuucagucacaccaguuguggacuaccuuacugucucugacauucaucaaaacaacucuuucacuggauuaugcauggaagacaauggcuaugguauugucaaucguaucucucuuuccucuaugucuauccacgaccucucaaaaaacaacauggcuuccgguguuguuaggauccuuuggauguaaaccacuaaccauguuucuuauaacagaaaacaaaauuuggggaaggaaaaguuggccccucaaugaaggaauuauggcuguuggaauagucagcauuuuacuaaguucacuccucaaaaaugacgugccacuagccggcccacuaauagcuggaggcaugcugauagcauguuacgucauuuccggaagcucagccgauuuaucauuggagagagcggcugaggucuccugggaagaagaagcagaacacucuggugccucacacaacauacuaguggagguccaagaugauggaacuaugaaaauaaaagaugaagagagagaugacacgcucacuauacuccucaaagcaacuuuguuggcaguuucagggguguacccaaugucaauaccagcaacccuuuuugugugguauuuuuggcagaaaaagaaacagagaucaggagucuugugggacacacccagcccuccagaaguagaaagagcaguucuugaugaugguaucuauagaaucuugcaaagaggacuguuggguaggucccagguaggagugggaguuuuucaagacggcguguuccacacaauguggcaugucaccaggggggcuguccucauguaccaagggaagaggcuggaaccaaguugggccagugucaaaaaagacuugaucucauauggaggagguuggagguuucaaggaucauggaacacgggagaagaaguacaggugauagcuguugaaccagggaaaaacccaaagaauguacagacaacgccgggcaccuucaagaccccugaaggcgaaguuggagccauagcccuagauuucaaaccuggcacaucuggaucucccaucgugaacagagaggggaaaauaguaggucuuuauggaaauggaguggugacaacaaguggaaccuacgucagugccauugcccaagcuaaagcgucacaagaagggccucuaccagagauugaggacgagguguuuaagaaaagaaaccuaacaauaauggaccuacauccaggaucaggaaaaacaagaagauaucuuccagccauaguccgugaggccauaaaaaggaaacugcgcacgcuaaucuuggcccccacaagaguugucgccucugaaauggcagaggcgcuuaaaggaaugccaauaagauaucagacaacagcaguaaagagugaacacacaggaaaggagauagucgaucucaugugccacgccacuuucaccaugcgucuccuaucuccagugagaguucccaauuacaacaugauuaucauggaugaagcacacuuuaccgauccagccagcauagcggccagaggguacaucucaacccgaguggguaugggugaagcagcugcgaucuuuaugacagccacucccccaggaucgguagaggccuuuccacagagcaaugcaguuauccaagaugaggaaagagacauuccugagagaucauggaacucaggcuacgacuggaucacugacuucccaggaaaaacagucugguuuguuccaagcaucaaaucaggaaaugacauugccaacugcuuaaggaaaaacgggaaacgggugauccaauugagcagaaaaaccuuugacacugaauaccagaaaacgaaaaacaaugauugggacuauguugucacaacagacauuuccgaaaugggagcaaauuuccgggccgauaggguaauagacccaaggcggugcuugaagccgguaauacuaaaagauggcccagagcgcgucauucuggccggaccaaugccagugaccgcggccagugcugcccagaggagaggaagaauuggaaggaaccaaaacaaggaaggugaccaguauauuuacaugggacagccuuuaaauaaugaugaggaccacgcucauuggacagaagcaaaaaugcuccuugacaauauaaauacgccagaagggauuaucccagcccucuuugagccagagagagaaaagagugcagcaauagacggggaguauagacugcggggagaagcaaggaaaacguucguggagcuaaugagaagaggggaucuaccaguuuggcuaucuuacaaaguugccucagaaggcuuccaguacuccgacagaagauggugcuuugacggggaaaggaacaaccagguguuggaggagaacauggacguggagaucuggacaaaagaaggagaaagaaagaaauugcgaccucgcugguuagaugccagaaccuacucugauccacuggcccugcgcgaguuuaaagaguucgcagcaggaagaagaagugucucaggugaccuaauauuagaaauagggaaacucccacagcauuugacgcuaagggcccagaaugcuuuggacaacuuggucauguugcacaauuccgaacaagggggaaaagccuauagacaugcuauggaagaacuaccagacaccauagaaacauugaugcuacuagccuugauagcugugcugacugguggaguuacguuguuuuuccuaucaggaaaaggucuagggaaaacauccauuggccuacuuuguguaauggccucaaguguacuguuauggauggccaguguggagccccauuggauagcggccuccaucauacuagaguuuuuucugauggugcugcuuauuccagagccagacagacagcguacuccacaggacaaucaacuagcauauguggugauagguuuguuauucaugauauugacaguggcagccaaugagaugggauuacuggaaaccacaaagaaagaccuggggauuggccauguagucgccgaaaaccaccaccaugccacaaugcuagacauagacuuacauccagcuucagccuggacccucuaugcaguagccacaacaauuaucacucccaugaugagacacacaauugaaaacacaacggcaaacauuucccugacagcuauugcaaaucaggcggcuauauuaaugggacuugacaagggauggccaauaucgaagauggacauaggagugccacuucucgccuuagggugcuauucccaggugaacccauugacacugacagcggcggugcuaauguuaguggcucauuaugccauaaucggaccuggacugcaagcaaaagcuaccagagaagcccaaaaaaggacugcggccggaauaaugaaaaauccaacuguggacgggauuguugcaauagauuuggauccugugguuuaugaugcaaaauuugaaaaacagcuaggccaaauaauguuacuaauacucugcacaucacagauucucuugaugcggacuacaugggccuuaugugaaucuaucacacuggcuacuggacccuugaccacucucugggagggaucuccuggaaaauucuggaauaccacgauagcaguguccauggcaaacaucuucaggggaaguuauuuagcaggggcaggucuggccuucucauuaaugaaaucuuuaggaggagguaggagagguacgggagcucaaggggaaacauugggagaaaaauggaaaagacaacuaaaccaacugagcaagucagaauuuaacacuuacaaaaggaguggaauuauggagguggacagauccgaagccaaggagggacugaaaagaggagaaacaaccaaacaugcagugucgagaggaacagccaaacuuaggugguuuguggagaggaaccuugugaaaccggaagggaaagugauagaccucgguuguggaagagguggcuggucauauuacugcgcugggcugaagaaggucacagaaguaaagggauacacaaaaggaggacccggucaugaggaaccuaucccaauggcgacuuauggauggaacauagugaagcuacacucuggaagggauguauucuuuacaccaccugagaaaugugacacccuuuugugugauauuggugaguccucuccgaauccaacuauagaagaaggaagaacguuacguguucuaaagaugguggaaccauggcucagaggaaaucaguuuugcauaaaaauccuaaauccuuauaugccaagugugguagaaacucuggagcaaaugcaaagaaaacauggagggaugcuagugcgaaacccacucucaagaaauuccacccaugaaauguacugggucucauguggaacaggaaacauugugucggcagugaacaugacauccagaaugcugcugaaucgguucacaauggcucacaggaagccaacguaugaaagagacguggacuugggcgcuggaacaagacauguggcaguggaaccagagauagccaaccuagacauuauuggccagaggauagagaacauaaaaaaugaacauaagucaacauggcauuaugaugaggacaauccauacaaaacaugggccuaucauggaucauaugaggucaagccaucagggucagccucauccauggugaauggcguggugagauugcucaccaagccaugggauguuauccccauggucacacaaauagcuaugacugauaccacacccuucggacaacagaggguuuucaaagagaaaguugacacacgcacaccaagaccaaaacgaggcacagcacaaauuauggaggugacagccaagugguuauggggauuccucucuagaaauaaaaaacccagaaucugcacaagagaggaguucacaagaaaaguuaggucaaacgcagcaauuggagcaguguuuguugaugaaaaccaauggaacucagcaaaagaagcaguggaagacgaaagguuuugggaccucgugcacagagagagggagcuucauaaacagggaaaaugugccacgugugucuacaauaugauggguaaaagagagaaaaaacuaggagaguuuggaaaggcaaaaggaagucgugcaauaugguacaugugguugggagcacgcuuucuagaauuugaagcccuuggcuucaugaaugaagaccacugguucaguagggagaauucacucaguggaguggaaggagaaggacuacauaaacuuggauacauacucagagacauaucaaagauuccagggggaaauauguaugcagacgacacagcuggaugggacacaagaauaacagaggaugaucuucagaaugaggcuaaaaucaccgacaucauggagccugaacaugcucuacuggcuacgucaaucuucaagcugaccuaucaaaauaaggugguaagggugcaaagaccagcaaaaaguggaaccgugauggacgucauauccagacgugaccagagaggaaguggacaggucggaacuuauggccuaaacacuuucaccaacauggagguccaacuaauaagacaaauggaaucugaaggaaucuuuucacccagcgaauuggaaaauucaaaucuagcugagagaguucucgacugguuggaaaaacauggcgucgaaagguugaaaagaauggcaaucagcggagaugacuguguggugaaaccaacugaugacagguucgcaacagcuuuaauagcccugaaugacaugggaaaggugagaaaagacauaccgcaaugggaaccuucaaaaggauggaaugacuggcagcaagugccuuucuguucacaccacuuccaccaacugauaaugaaggaugggagggagauaguggugccaugccgcaaccaagaugaacuugugggcagggccagaguaucacaaggcgccggguggagccugagagaaacugcuugccuaggcaagucauaugcacaaauguggcagcugauguacuuccacaggagagaccugagacuggcggcuaaugcuaucuguucagccguuccaguuaauugggucccaaccagccgcaccaccuggucgauccaugcccaccaucaauggaugacaacagaagacauguugucaguauggaauaggguuuggauagaggaaaacccauggauggaggacaaaacucauguauccagcugggaagauguuccauacuuaggaaaaagggaagaucaaugguguggaucucugauaggcuuaacagcaagagccaccugggccaccaacauacaaguggccauaaaccaagugagaaggcuuauugggaacgagaauuauuuagacuacaugacaucaaugaagagauucaagaaugagagugaucccgaaggagcccucugguaa

SEQ ID NO: 6294 - RNA, 9879 nt, Artificial Sequence
  derived and/or modified CDS sequence (wt) from DENV-1__KM403588__SS-prME
uccgugaccaugcuccucaugcugcugcccacagcccuggcguuccauuugaccacacgagggggagagccacacaugauaguuagcaagcaggaaagaggaaagucacucuuguuuaagaccucugcaggugucaacaugugcacccucauugcaauggauuugggagaguuaugugaggauacaaugaccuacaaaugcccccggaucacugaagcggaaccagaugauguugauugcuggugcaaugccacagacacaugggugaccuaugggacguguucucagacuggcgaacaccgacgggauaaacguucugucgcauuggccccacacguggggcuuggucucgaaacaagaaccgaaacguggauguccucugaaggcgccuggaggcagauacaaaaaguggagacuugggccuugagacacccaggauucacggugauagcccuuuuuuuagcacaugccauaggaacauccauuacccagaaagggaucaucuucauuuugcugaugcuggugacaccaucaauggccaugcgaugcgugggaauaggcaacagagacuucguugaaggacugucaggagcaacauggguggaugugguacuggagcauggaagcugugucaccaccauggcaaagaauaaaccaacauuggacauugaacucuugaagacggaggucacgaacccugccgucuugcgcaaacugugcauugaagcuaaaauaucaaacaccaccaccgauucaagauguccaacacaaggagaagcuacacugguggaagaacaagacgcgaacuuugugugucgacgaacauucguggacagaggcugggguaaugguuguggacuauucgggaagggaagcuuacuaacgugugcuaaguuuaagugugugacaaaacuugaaggaaagauaguucaauaugaaaacuuaaaauauucggugauagucacuguccacacuggggaccagcaccagguaggaaaugagacuacagaacauggaacaauugcaaccauaacaccucaagcucccacgucggaaauacagcugacugacuacggagcccuuacauuggacugcucaccuagaacagggcuggacuuuaaugagauggugcuguugacaaugaaagaaaaaucauggcuuguccacaaacaaugguuucuagacuuaccauugccuuggaccucgggggcuucaacaucucaagagacuuggaacagacaagaucugcuggucacauuuaagacagcucaugcaaagaagcaggaaguagucguacuggggucacaagaaggagcaaugcacacugcguugacuggggcgacagaaauccagacgucaggaacgacgacaaucuucgcaggacaccugaaauguagacuaaaaauggguaaacugacuuuaaaaggggugucauaugugaugugcacaggcucauuuaagcuagagaaggaaguggcugagacccagcauggaacuguccuagugcagguuaaauaugaaggaacagaugcaccaugcaagauuccaauuucaacccaagaugagaaaggagugacccagaaugggagauugauaacagccaaucccauaguuacugacaaagaaaaaccagucaacauugaaacagaaccacccuuuggugagagcuacaucgugauaggggcgggugaaaaagcuuugaaacuaagcugguucaagaaaggaagcagcauagggaaaauguucgaagccaccgcccgaggagcacgaaggauggcuauccugggagacauagcaugggacuucgguuccauaggagggguguucacaucugugggaaaauugguacaccagguuuuuggaaccgcauaugggguccuguucagcgguguuucuuggaccaugaaaauaggaauagggauucugcugacauggcuaggauugaauucaaggagcacgucacucucgaugacgugcauugcaguuggcauggucacacuguaccuaggagucaugguucaagcggacucggggugugugaucaacuggaagggcagagaacucaaguguggaaguggcaucuuugucacuaaugaaguccacacuuggacagagcaauacaaauuucaggcugacuccccaaaaagacuaucagcagccauugggaaggcaugggaggaaggcguguguggaauucgaucagccacacgucuugagaacaucauguggaagcaaauaucaaaugaauugaaccacauucuacuugaaaaugacaugaaauucacagugguuguaggagacgccaauggaaucuugacccaaggaaaaaagaugauuaggccacaacccauggaacacaaauacucauggaaaagcuggggaaaagccaaaaucauaggagcagauacacagaauacuaccuucaucaucgauggcccagacacuccagaaugccccgaugaccagagagcauggaacauuugggaaguugaggacuauggguuuggaguuuucacgacaaacauauggcugaaauugcgugacuccuacacccaaaugugugaccaccggcuaaugucagcugccaucagggacagcaaggcaguccaugcugacaugggguacuggauagaaagugaaaagaacgagaccuggaagcuagcgagagccuccuucauagaagugaagacaugcaucuggccaagaucccacacucuauggagcaauggagucuuggaaagugaaaugauaaucccaaagauauauggaggaccaauaucucagcacaacuacagaccaggguauuucacacaaacagcagggccauggcaccuaggcaaguuggaacuagacuuuaauuugugugaaggcaccacaguuguuguggaugaacauuguggaaaucgagguccaucucuuagaacuacaacagucacaggaaagauaauccaugaauggugcugcagauccugcacgcuaccccccuuacgcuucagaggagaagacggauguugguauggcauggaaaucagaccaguuaaggagaaggaagagaaucuagucaggucaauggucucugcagggucaggagaaguggacaguuuuucauugggacuacuaugcguaucaauaaugauugaagaagugaugagauccagauggaguagaaagaugcugaugacuggaacacuggcuguuuucuuccuucuuauaaugggacaacugacauggaaugaucugaucagguuaugcaucaugguuggagccaaugucucagacagaauggggaugggaacaacguaccuagcuuuaauggccacuuuuaaaaugagaccgauguucgcuguugggcuauuauuucgcagacuaacauccagagaggugcuccuucucacaauuggacuaagccugguggcauccguggagcuaccaaauucuuuagaggagcuaggggacggacuugcgaugggcaucaugauguuaaaauuguugacugauuuucagucacaccaguuguggacuaccuuacugucucugacauucaucaaaacaacucuuucacuggauuaugcauggaagacaauggcuaugguauugucaaucguaucucucuuuccucuaugucuauccacgaccucucaaaaaacaacauggcuuccgguguuguuaggauccuuuggauguaaaccacuaaccauguuucuuauaacagaaaacaaaauuuggggaaggaaaaguuggccccucaaugaaggaauuauggcuguuggaauagucagcauuuuacuaaguucacuccucaaaaaugacgugccacuagccggcccacuaauagcuggaggcauguugauagcauguuacgucauuuccggaagcucagccgauuuaucauuggagagagcggcugaggucuccugggaagaagaagcagaacacucuggugccucacacaacauacuaguggagguccaagaugauggaacuaugaaaauaaaagaugaagagagagaugacacgcucacuauacuccucaaagcaacuuuguuggcaguuucagggguguacccaaugucaauaccagcaacccuuuuugugugguauuuuuggcagaaaaagaaacagagaucaggagucuugugggacacacccagcccuccagaaguagaaagagcaguucuugaugaugguaucuauagaaucuugcaaagaggacuguuggguaggucccagguaggagugggaguuuuucaagacggcguauuccacacaauguggcaugucaccaggggggcuguccucauguaccaagggaagaggcuggaaccaaguugggccagugucaaaaaagacuugaucucauauggaggagguuggagguuucaaggaucauggaacacgggagaagaaguacaggugauagcuguugaaccagggaaaaacccaaagaauguacagacaacgccgggcaccuucaagaccccugaaggcgaaguuggagccauagcccuagauuucaaaccuggcacaucuggaucucccaucgugaacagagaggggaaaauaguaggucuuuauggaaauggaguggugacaacaaguggaaccuacgucagugccauugcccaagcuaaagcgucacaagaagggccucuaccagagauugaggacgagguguuuaagaaaagaaaccuaacaauaauggaccuacauccaggaucaggaaaaacaagaagauaucuuccagccauaguccgugaggccauaaaaaggaaacugcgcacgcuaaucuuggcucccacaagaguugucgccucugaaauggcagaggcgcuuaaaggaaugccaauaagauaucagacaacagcaguaaagagugaacacacaggaaaggagauagucgaucucaugugccacgccacuuucaccaugcgucuccuaucuccagugagaguucccaauuacaacaugauuaucauggaugaagcacacuuuaccgauccagccagcauagcggccagaggguacaucucaacccgaguggguaugggugaagcagcugcgaucuuuaugacagccacucccccaggaucgguagaggccuuuccacagagcaaugcaguuauccaagaugaggaaagagacauuccugagagaucauggaacucaggcuacgacuggaucacugacuucccaggaaaaacagucugguuuguuccaagcaucaaaucaggaaaugacauugccaacugcuuaagaaaaaacgggaaacgggugauccaauugagcagaaaaaccuuugacacugaauaccagaaaacgaaaaacaaugauugggacuauguugucacaacagacauuuccgaaaugggagcaaauuuccgggccgauaggguaauagacccaaggcggugcuugaagccgguaauacuaaaagauggcccagagcgcgucauucuggccggaccaaugccaguggccgcggccagugcugcccagaggagaggaagaauuggaaggaaccaaaacaaggaaggugaccaguauauuuacaugggacagccuuuaaauaaugaugaggaccacgcucauuggacagaagcaaaaaugcuccuugacaauauaaauacgccagaagggauuaucccagcccucuuugagccagagagagaaaagagugcagcaauagacggggaguauagacugcggggagaagcaaggaaaacguucguggagcuaaugagaagaggggaucuaccaguuuggcuaucuuacaaaguugccucagaaggcuuccaguacuccgacagaagauggugcuuugacggggaaaggaacaaccagguguuggaggagaacauggacguggagaucuggacaaaagaaggagaaagaaagaaauugcgaccucgcugguuagaugccagaaccuacucugauccacuggcccugcgcgaguuuaaagaguucgcagcaggaagaagaagugucucaggugaccuaauauuagaaauagggaaacucccacagcauuugacgcuaagggcccagaaugcuuuggacaacuuggucauguugcacaauuccgaacaagggggaaaagccuauagacaugcuauggaagaacuaccagacaccauagaaacauugaugcuacuagccuugauagcugugcugacugguggaguuacguuguuuuuccuaucaggaaaaggucuagggaaaacauccauuggccuacuuuguguaauggccucaaguguacuguuauggauggccaguguggagccccauuggauagcggccuccaucauacuagaguuuuuucugauggugcugcuuauuccagagccagacagacagcguacuccacaggacaaucaacuagcauauguggugauagguuuguuauucaugauauugacaguggcagccaaugagaugggauuacuggaaaccacaaagaaagaccuggggauuggccauguagucgccgaaaaccaccaccaugccacaaugcuagacauagacuuacauccagcuucagccuggacccucuaugcaguagccacaacaauuaucacucccaugaugagacacacaauugaaaacacaacggcaaacauuucccugacagcuauugcaaaucaggcggcuauauuaaugggacuugacaagggauggccaauaucgaagauggacauaggagugccacuucucgccuuagggugcuauucccaggugaacccauugacacugacagcggcgguguuaauguuaguggcucauuaugccauaaucggaccuggacugcaagcaaaagcuaccagagaagcccaaaaaaggacugcggccggaauaaugaaaaauccaacuguagacgggauuguugcaauagauuuggauccugugguuuaugaugcaaaauuugaaaaacagcuaggccaaauaauguuacuaauacucugcacaucacagauucucuugaugcggacuacaugggccuuaugugaaucuaucacacuggcuacuggacccuugaccacucucugggagggaucuccuggaaaauucuggaauaccacgauagcaguguccauggcaaacaucuucaggggaaguuauuuagcaggggcaggucuggccuucucauuaaugaaaucuuuaggaggagguaggagagguacgggagcucaaggggaaacauugggagaaaaauggaaaagacaacuaaaccaacugagcaagucagaauuuaacacuuacaaaaggaguggaauuauggagguggacagauccgaagccaaggagggacugaaaagaggagaaacaaccaaacaugcagugucgaggggaacagccaaacuuaggugguuuguggagaggaaccuugugaaaccggaagggaaagugauagaccucgguuguggaagagguggcuggucauauuacugcgcugggcugaagaaggucacagaaguaaagggauacacaaaaggaggacccggucaugaggaaccuaucccaauggcgaccuauggauggaacauagugaagcuacacucuggaagggauguauucuuuacaccaccugagaaaugugacacccuuuugugugauauuggugaguccucuccgaauccaacuauagaagaaggaagaacguuacguguucuaaagaugguggaaccauggcucagaggaaaucaguuuugcauaaaaauccuaaauccuuauaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaaugcugcugaaucgguucacaauggcucacaggaagccaacguaugaaagagacguggacuugggcgcuggaacaagacauguggcaguggaaccagagauagccaaccuagacauuauuggccagaggauagagaacauaaaaaaugaacauaagucaacauggcauuaugaugaggacaauccauacaaaacaugggccuaucauggaucauaugaggucaagccaucagggucagccucauccauggugaauggcguggugagauugcucaccaagccaugggauguuauccccauggucacacaaauagcuaugacugauaccacacccuucggacaacagaggguuuucaaagagaaaguugacacacgcacaccaagaccaaaacgaggcacagcacaaauuauggaggugacagccaagugguuguggggauuccucucuagaaauaaaaaacccagaaucugcacaagagaggaguucacaagaaaaguuaggucaaacgcagcaauuggagcaguguuuguugaugaaaaccaauggaacucagcaaaagaagcaguggaagacgaaagguuuugggaccucgugcacagagagagggagcuucauaaacagggaaaaugugccacgugugucuacaauaugauggguaaaagagagaaaaaacuaggagaguuuggaaaggcaaaaggaagucgugcaauaugguacaugugguugggagcacgcuuucuagaauuugaagcccuuggcuucaugaaugaagaccacugguucaguagggagaauucacucaguggaguggaaggagaaggacuacauaaacuuggauacauacucagagacauaucaaagauuccagggggaaauauguaugcagacgacacagcuggaugggacacaagaauaacagaggaugaucuucagaaugaggcuaaaaucaccgacaucauggagccugaacaugcucuacuggcuacgucaaucuucaagcugaccuaucaaaauaaggugguaagggugcaaagaccagcaaaaaguggaaccgugauggacgucauauccagacgugaccagagaggaaguggacaggucggaacuuauggccuaaacacuuucaccaacauggagguccaacuaauaagacaaauggaaucugaaggaaucuuuucacccagcgaauuggaaaauucaaaucuagcugagagaguucucgacugguuggaaaaacauggcgucgaaagguugaaaagaauggcaaucagcggagaugacuguguggugaaaccaacugaugacagguucgcaacagcuuuaacagcccugaaugacaugggaaaggugagaaaagacauaccgcaaugggaaccuucaaaaggauggaaugacuggcagcaagugccuuucuguucacaccacuuccaccaacugauuaugaaggaugggagggagauaguggugccaugccgcaaccaagaugaacuugugggcagggccagaguaucacaaggcgccggguggagccugagagaaacugcuugccuaggcaagucauaugcacaaauguggcagcugauguacuuccacaggagagaccugagacuggcggcuaaugcuaucuguucagccguuccaguuaauugggucccaaccagccgcaccaccuggucgauccaugcccaccaucaauggaugacaacagaagacauguugucaguauggaauaggguuuggauagaggaaaacccauggauggaggacaaaacucauguauccagcugggaagauguuccauacuuaggaaaaagggaagaucaaugguguggaucucugauaggcuuaacagcaagagccaccugggccaccaacauacaaguggccauaaaccaagugagaaggcuuauugggaacgagaauuauuuagacuacaugacaucaaugaagagauucaagaaugagagugaucccgaaggagcccucugguaa

SEQ ID NO: 6295 - RNA, 9879 nt, Artificial Sequence
  derived and/or modified CDS sequence (wt) from DENV-1__KM403605__SS-prME
uccgugaccaugcuccucaugcugcugccuacagcccuggcguuccauuugacuacacgagggggagagccacacaugauaguuagcaagcaggaaagaggaaagucacucuuguuuaagaccucugcaggugucaacaugugcacccucauugcaauggauuugggagaguuaugugaggauacaaugaccuacaaaugcccccggaucacugaagcggaaccagaugauguugauugcuggugcaaugccacagacacaugggugaccuaugggacguguucucagacuggcgaacaccgacgggauaaacguucugucgcauuggccccacacguggggcuuggucucgaaacaagaaccgaaacguggauguccucugaaggcgccuggaggcagauacaaaaaguggagacuugggccuugagacacccaggauucacggugauagcccuuuuuuuagcacaugccauaggaacauccauuacccagaaagggaucaucuucauuuugcugaugcuggugacaccaucaauggccaugcgaugcgugggaauaggcaacagagacuucguugaaggacugucaggagcaacauggguggaugugguauuggagcauggaagcugugucaccaccauggcaaagaauaaaccaacauuggacauugaacucuugaagacggaggucacgaacccugccgucuugcgcaaacugugcauugaagcuaaaauaucaaacaccaccaccgauucaagauguccaacacaaggagaagcuacacugguggaagaacaagacgcgaacuuugugugucgacgaacauucguggacagaggcugggguaaugguuguggacuauucgggaagggaagcuuacuaacgugugcuaaguuuaagugugugacaaaacuugaaggaaagauaguucaauaugaaaacuuaaaauauucggugauagucacuguccacacuggggaccagcaccagguaggaaaugagacuacagaacauggaacaauugcaaccauaacaccucaagcucccacgucggaaauacagcugacugacuacggagcccuuacauuggacugcucaccuagaacagggcuggacuuuaaugagauggugcuguugacaaugaaagaaaaaucauggcuuguccacaaacaaugguuucuagacuuaccauugccuuggaccucgggggcuucaacaucucaagagacuuggaacagacaagaucugcuggucacauuuaagacagcucaugcaaagaagcaggaaguagucguacuggggucacaagaaggagcaaugcacacugcguugacuggggcgacagaaauccagacgucaggaacgacgacaaucuucgcaggacaccugaaauguagacuaaaaauggauaaacugacuuuaaaaggggugucauaugugaugugcacaggcucauuuaagcuagagaaggaaguggcugagacccagcauggaacuguccuagugcagguuaaauaugaaggaacagaugcaccaugcaagauuccaauuucaauccaagaugagaaaggagugacccagaaugggagauugauaacagccaaucccauaguuacugacaaagaaaaaccagucaacauugaaacagaaccacccuuuggugagagcuacaucgugauaggggcgggugaaaaagcuuugaaacuaagcugguucaagaaaggaagcagcauagggaaaauguucgaagccaccgcccgaggagcacgaaggauggcuauccugggagacacagcaugggacuucgguuccauaggagggguguucacaucugugggaaaauugguacaccagguuuuuggaaccgcauaugggguccuguucagcgguguuucuuggaccaugaaaauaggaauagggauucugcugacauggcuaggauugaauucaaggagcacgucacucucgaugacgugcauugcaguuggcauggucacacuguaccuaggagucaugguucaagcggacucggggugugugaucaacuggaagggcagagaacucaaguguggaaguggcaucuuugucacuaaugaaguccacacuuggacagagcaauacaaauuucaggcugacuccccaaaaagacuaucagcagccauugggaaggcaugggaggaaggcguguguggaauucgaucagccacacgucuugagaacaucauguggaagcaaauaucaaaugaauugaaccacauucuacuugaaaaugacaugaaauucacagugguuguaggagacgccaauggaaucuugacccaaggaaaaaagaugauuaggccacaacccauggaacacaaauacucauggaaaagcuggggaaaagccaaaaucauaggagcagauacacagaauacuaccuucaucaucgauggcccagacacuccagaaugccccgaugaccagagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaacgagaccuggaagcuagcgagagccuccuucauagaagugaagacaugcaucuggccaagaucccacacucuauggagcaauggagucuuggaaagugaaaugauaaucccaaagauauauggaggaccaauaucucagcacaacuacagaccaggguauuucacacaaacagcagggccauggcaccuaggcaaguuggaacuagacuuuaauuugugugaaggcaccacaguuguuguggaugaacauuguggaaaucgagguccaucucuuagaacuacaacagucacaggaaagauaauccaugaauggugcugcagauccugcacgcuaccccccuuacgcuucagaggagaagacggauguugguauggcauggaaaucagaccaguuaaggagaaggaagagaaucuagucaggucaauggucucugcagggucaggagaaguggacaguuuuucauugggacuacuaugcguaucaauaaugauugaagaagugaugagauccagauggaguagaaagaugcugaugacuggaacacuggcuguuuucuuccuucuuauaaugggacaacugacauggaaugaucugaucagguuaugcaucaugguuggagccaaugucucagacagaauggggaugggaacaacguaccuagcuuuaauggccacuuuuaaaaugagaccgauguucgcuguugggcuauuauuucgcagacuaacauccagagaggugcuccuucucacaauuggacuaagccugguggcauccguggagcuaccaaauucuuuagaggagcuaggggacggacuugcgaugggcaucaugauguugaaauuguugacugauuuucagucacaccaguuguggacuaccuuacugucucugacauucaucaaaacaacucuuucacuggauuaugcauggaagacaauggcuaugguauugucaaucguaucucucuuuccucuaugucuauccacgaccucucaaaaaacaacauggcuuccgguguuguuaggauccuuuggauguaaaccacuaaccauguuucuuauaacagaaaacaaaauuuggggaaggaaaaguuggccccucaaugaaggaauuauggcuguuggaauagucagcauuuuacuaaguucacuccucaaaaaugacgugccacuagccggcccacuaauagcuggaggcaugcugauagcauguuacgucauuuccggaagcucagccgauuuaucauuggagagagcggcugaggucuccugggaagaagaagcagaacacucuggugccucacacaacauacuaguggagguccaagaugauggaacuaugaaaauaaaagaugaagagagagaugacacgcucacuauacuccucaaagcaacuuuguuggcaguuucagggguguacccaaugucaauaccagcaacccuuuuugugugguauuuuuggcagaaaaagaaacagagaucaggagucuugugggacacacccagcccuccagaaguagaaagagcaguucuugaugaugguaucuauagaaucuugcaaagaggacuguuggguaggucccagguaggagugggaguuuuucaagacggcguguuccacacaauguggcaugucaccaggggggcuguccucauguaccaagggaagaggcuggaaccaaguugggccagugucaaaaaagacuugaucucauauggaggagguuggagguuucaaggaucauggaacacgggagaagaaguacaggugauagcuguugaaccagggaaaaacccaaagaauguacagacaacgccgggcaccuucaagaccccugaaggcgaaguuggagccauagcccuagauuucaaaccuggcacaucuggaucucccaucgugaacagagaggggaaaauaguaggucuuuauggaaauggaguggugacaacaaguggaaccuacgucagugccauugcccaagcuaaagcgucacaagaagggccucuaccagagauugaggacgagguguuuaagaaaagaaaccuaacaauaauggaccuacauccaggaucaggaaaaacaagaagauaucuuccagccauaguccgugaggccauaaaaaggaaacugcgcacgcuaaucuuggcucccacaagaguugucgccucugaaauggcagaggcgcuuaaaggaaugccaauaagauaucagacaacagcaguaaagagugaacacacaggaaaggagauagucgaucucaugugccacgccacuuucaccaugcgucuccuaucuccagugagaguucccaauuacaacaugauuaucauggaugaagcacacuuuaccgauccagccagcauagcggccagaggguacaucucaacccgaguggguaugggugaagcagcugcgaucuuuaugacagccacucccccaggaucgguagaggccuuuccacagagcaaugcaguuauccaagaugaggaaagagacauuccugagagaucauggaacucaggcuacgacuggaucacugacuucccaggaaaaacagucugguuuguuccaagcaucaaaucaggaaaugacauugccaacugcuuaagaaaaaacgggaaacgggugauccaauugagcagaaaaaccuuugacacugaauaccagaaaacgaaaaacaaugauugggacuauguugucacaacagacauuuccgaaaugggagcaaauuuccgggccgauaggguaauagacccaaggcggugcuugaagccgguaauacuaaaagauggcccagagcgcgucauucuggccggaccaaugccagugaccgcggccagugcugcccagaggagaggaagaauuggaaggaaccaaaacaaggaaggugaccaguauauuuacaugggacagccuuuaaauaaugaugaggaccacgcucauuggacagaagcaaaaaugcuccuugacaauauaaauacgccagaagggauuaucccagcccucuuugagccagagagagaaaagagugcagcaauagacggggaguauagacugcggggagaagcaaggaaaacguucguggagcuaaugagaagaggggaucuaccaguuuggcuaucuuacaaaguugccucagaaggcuuccaguacuccgacagaagauggugcuuugacggggaaaggaacaaccagguguuggaggagaacauggacguggagaucuggacaaaagaaggagaaagaaagaaauugcgaccucgcugguuagaugccagaaccuacucugauccacuggcccugcgcgaguuuaaagaguucgcagcaggaagaagaagugucucaggugaccuaauauuagaaauagggaaacucccacagcauuugacgcuaagggcccagaaugcuuuggacaacuuggucauguugcacaauuccgaacaagggggaaaagccuauagacaugcuauggaagaacuaccagacaccauagaaacauugaugcuacuagccuugauagcugugcugacugguggaguuacguuguuuuuccuaucaggaaaaggucuagggaaaacauccauuggccugcuuuguguaauggccucaaguguacuguuauggauggccaguguggagccccauuggauagcggccuccaucauacuagaguuuuuucugauggugcugcuuauuccagagccagacagacagcguacuccacaggacaaucaacuagcauauguggugauagguuuguuauucaugauauugacaguggcagccaaugagaugggauuacuggaaaccacaaagaaagaccuggggauuggccauguagucgccgaaaaccaccaccaugccacaaugcuagacauagacuuacauccagcuucagccuggacccucuaugcaguagccacaacaauuaucacucccaugaugagacacacaauugaaaacacaacggcaaacauuucccugacagcuauugcaaaucaggcggcuauauuaaugggacuugacaagggauggccaauaucgaagauggacauaggagugccacuucucgccuuagggugcuauucccaggugaacccauugacacugacagcggcgguguuaauguuaguggcucauuaugccauaaucggaccuggacugcaagcaaaagcuaccagagaagcccaaaaaaggacugcggccggaauaaugaaaaauccaacuguggacgggauuguugcaauagauuuggauccugugguuuaugaugcaaaauuugaaaaacagcuaggccaaauaauguuacuaauacucugcacaucacagauucucuugaugcggacuacaugggccuuaugugaaucuaucacacuggcuacuggacccuugaccacucucugggagggaucuccuggaaaauucuggaauaccacgauagcaguguccauggcaaacaucuucaggggaaguuauuuagcaggggcaggucuggccuucucauuaaugaaaacuuuaggaggagguaggagagguacgggagcucaaggggaaacauugggagaaaaauggaaaagacaacuaaaccaacugagcaagucagaauuuaacacuuacaaaaggaguggaauuauggagguggacagauccgaagccaaggagggacugaaaagaggagaaacaaccaaacaugcagugucgagaggaacagccaaacuuaggugguuuguggagaggaaccuugugaaaccggaagggaaagugauagaccucgguuguggaagagguggcuggucauauuacugcgcugggcugaagaaggucacagaaguaaagggauacacaaaaggaggacccggucaugaggaaccuaucccaauggcgacuuauggauggaacauagugaagcuacacucuggaagggauguauucuuuacaccaccugagaaaugugacacccuuuugugugauauuggugaguccucuccgaauccaacuauagaagaaggaagaacguuacguguucuaaagaugguggaaccauggcucagaggaaaucaguuuugcauaaaaauccuaaauccuuauaugccaagugugguagaaacucuggagcaaaugcaaagaaaacauggagggaugcuagugcgaaacccacucucaagaaauuccacccaugaaauguacugggucucauguggaacaggaaacauugugucggcagugaacaugacauccagaaugcugcugaaucgguucacaauggcucacaggaagccaacguaugaaagagacguggacuugggcgcuggaacaagacauguggcaguggaaccagagauagccaaccuagacauuauuggccagaggauagagaacauaaaaaaugaacauaagucaacauggcauuaugaugaggacaauccauacaaaacaugggccuaucauggaucauaugaggucaagccaucagggucagccucauccauggugaauggcguggugagauugcucaccaagccaugggauguuauccccauggucacacaaauagcuaugacugauaccacacccuucggacaacagaggguuuucaaagagaaaguugacacacgcacaccaagaccaaaacgaggcacagcacaaauuauggaggugacagccaagugguuguggggauuccucucuagaaauaaaaaacccagaaucugcacaagagaggaguucacaagaaaaguuaggucaaacgcagcaauuggagcaguguuuguugaugaaaaccaauggaacucagcaaaagaagcaguggaagacgaaagguuuugggaccucgugcacagagagagggagcuucauaaacagggaaaaugugccacgugugucuacaauaugauggguaaaagagagaaaaaacuaggagaguuuggaaaggcaaaaggaagucgugcaauaugguacaugugguugggagcacgcuuucuagaauuugaagcccuuggcuucaugaaugaagaccacugguucaguagggagaauucacucaguggaguggaaggagaaggacuacauaaacuuggauacauacucagagacauaucaaagauuccagggggaaauauguaugcagacgacacagcuggaugggacacaagaauaacagaggaugaucuucagaaugaggcuaaaaucaccgacaucauggagccugaacaugcucuacuggcuacgucaaucuucaagcugaccuaucaaaauaaggugguaagggugcaaagaccagcaaaaaguggaaccgugauggacgucauauccagacgugaccagagaggaaguggacaggucggaacuuauggccuaaacacuuucaccaacauggagguccaacuaauaagacaaauggaaucugaaggaaucuuuucacccagcgaauuggaaaauucaaaucuagcugagagaguucucgacugguuggaaaaacauggcgucgaaagguugaaaagaauggcaaucagcggagaugacugugaggugaaaccaacugaugacagguucgcaacagcuuuaacagcccugaaugacaugggaaaggugagaaaagacauaccgcaaugggaaccuucaaaaggauggaaugacuggcagcaagugccuuucuguucacaccacuuccaccaacugauaaugaaggaugggagggagauaguggugccaugccgcaaccaagaugaacuugugggcagggccagaguaucacaaggcgccggguggagccugagagaaacugcuugccuaggcaagucauaugcacaaauguggcagcugauguacuuccacaggagagaccugagacuggcggcuaaugcuaucuguucagccguuccaguuaauugggucccaaccagccgcaccaccuggucgauccaugcccaccaucaauggaugacaacagaagacauguugucaguauggaauaggguuuggauagaggaaaacccauggauggaggacaaaacucauguauccagcugggaagauguuccauacuuaggaaaaagggaagaucaaugguguggaucucugauaggcuuaacagcaagagccaccugggccaccaacauacaaguggccauaaaccaagugagaaggcuuauugggaacgagaauuauuuagacuacaugacaucaaugaagagauucaagaaugagagugaucccgaaggagcccucugguaa

SEQ ID NO: 6296 - RNA, 9879 nt, Artificial Sequence
  derived and/or modified CDS sequence (wt) from DENV-1__KM403606__SS-prME
uccgugaccaugcuccucaugcugcugcccacagcccuggcguuccauuugacuacacgagggggagagccacacaugauaguuagcaagcaggaaagaggaaagucacucuuguuuaagaccucugcaggugucaacaugugcacccucauugcaauggauuugggagaguuaugugaggauacaaugaccuacaaaugcccccggaucacugaagcggaaccagaugauguugauugcuggugcaaugccacagacacaugggugaccuaugggacguguucucagacuggcgaacaccgacgggauaaacguucugucgcauuggccccacacguggggcuuggucucgaaacaagaaccgaaacguggauguccucugaaggcgccuggaggcagauacaaaaaguggagacuugggccuugagacacccaggauucacggugauagcccuuuuuuuagcacaugccauaggaacauccauuacccagaaagggaucaucuucauuuugcugaugcuggugacaccaucaauggccaugcgaugcgugggaauaggcaacagagacuucguugaaggacugucaggagcaacauggguggaugugguauuggagcauggaagcugugucaccaccauggcaaagaauaaaccaacauuggacauugaacucuugaagacggaggucacgaacccugccgucuugcgcaaacugugcauugaagcuaaaauaucaaacaccaccaccgauucaagauguccaacacaaggagaagcuacacugguggaagaacaagacgcgaacuuugugugucgacgaacauucguggacagaggcugggguaaugguuguggacuauucgggaagggaagcuuacuaacgugugcuaaguuuaagugugugacaaaacuugaaggaaagauaguucaauaugaaaacuuaaaauauucggugauagucacuguccacacuggggaccagcaccagguaggaaaugagacuacagaacauggaacaauugcaaccauaacaccucaagcucccacguuggaaauacagcugacugacuacggagcccuuacauuggacugcucaccuagaacagggcuggacuuuaaugagauggugcuguugacaaugaaagaaaaaucauggcuuguccacaaacaaugguuucuagacuuaccauugccuuggaccucgggggcuucaacaucucaagagacuuggaacagacaagaucugcuggucacauuuaagacagcucaugcaaagaagcaggaaguagucguacuggggucacaagaaggagcaaugcacacugcguugacuggggcgacagaaauccagacgucaggaacgacgacaaucuucgcaggacaccugaaauguagacuaaaaauggauaaacugacuuuaaaaggggugucauaugugaugugcacaggcucauuuaagcuagagaaggaaguggcugagacccagcauggaacuguccuagugcagguuaaauaugaaggaacagaugcaccaugcaagauuccaauuucaacccaagaugagaaaggagugacccagaaugggagauugauaacagccaaucccauaguuacugacaaagaaaaaccagucaacauugaaacagaaccacccuuuggugagagcuacaucgugauaggggcgggugaaaaagcuuugaaacuaagcugguucaagaaaggaagcagcauagggaaaauguucgaagccaccgcccgaggagcacgaaggauggcuauccugggagacacagcaugggacuucgguuccauaggagggguguucacaucugugggaaaauugguacaccagguuuuuggaaccgcauaugggguccuguucagcgguguuucuuggaccaugaaaauaggaauagggauucugcugacauggcuaggauugaauucaaggagcacgucacucucgaugacgugcauugcaguuggcauggucacacuguaccuaggagucaugguucaagcggacucggggugugugaucaacuggaagggcagagaacucaaguguggaaguggcaucuuugucacuaaugaaguccacacuuggacagagcaauacaaauuucaggcugacuccccaaaaagacuaucagcagccauugggaaggcaugggaggaaggcguguguggaauucgaucagccacacgucuugagaacaucauguggaagcaaauaucaaaugaauugaaccacauucuacuugaaaaugacaugaaauucacagugguuguaggagacgccaauggaaucuugacccaaggaaaaaagaugauuaggccacaacccauggaacacaaauacucauggaaaagcuggggaaaagccaaaaucauaggagcagacacacagaauacuaccuucaucaucgauggcccagacacuccagaaugccccgaugaccagagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaacgagaccuggaagcuagcgagagccuccuucauagaagugaagacaugcaucuggccaagaucccacacucuauggagcaauggagucuuggaaagugaaaugauaaucccaaagauauauggaggaccaauaucucagcacaacuacagaccaggguauuucacacaaacagcagggccauggcaccuaggcaaguuggaacuagacuuuaauuugugugaaggcaccacaguuguuguggaugaacauuguggaaaucgagguccaucucuuagaacuacaacagucacaggaaagauaauccaugaauggugcugcagauccugcacgcuaccccccuuacgcuucagaggagaagacggauguugguauggcauggaaaucagaccaguuaaggagaaggaagagaaucuagucaggucaauggucucugcagggucaggagaaguggacaguuuuucauugggacuacuaugcguaucaauaaugauugaagaagugaugagauccagauggaguagaaagaugcugaugacuggaacacuggcuguuuucuuccuucuuauaaugggacaacugacauggaaugaucugaucagguuaugcaucaugguuggagccaaugucucagacagaauggggaugggaacaacguaccuagcuuuaauggccacuuuuaaaaugagaccgauguucgcuguugggcuauuauuucgcagacuaacauccagagaggugcuccuucucacaauuggacuaagccugguggcauccguggagcuaccaaauucuuuagaggagcuaggggacggacuugcgaugggcaucaugauguugaaauuguugacugauuuucagucacaccaguuguggacuaccuuacugucucugacauucaucaaaacaacucuuucacuggauuaugcauggaagacaauggcuaugguauugucaaucguaucucucuuuccucuaugucuauccacgaccucucaaaaaacaacauggcuuccgguguuguuaggauccuuuggauguaaaccacuaaccauguuucuuauaacagaaaacaaaauuuggggaaggaaaaguuggccccucaaugaaggaauuauggcuguuggaauagucagcauuuuacuaaguucacuccucaaaaaugacgugccacuagccggcccacuaauagcuggaggcaugcugauagcauguuacgucauuuccggaagcucagccgauuuaucauuggagagagcggcugaggucuccugggaagaagaagcagaacacucuggugccucacacaacauacuaguggagguccaagaugauggaacuaugaaaauaaaagaugaagagagagaugacacgcucacuauacuccucaaagcaacuuuguuggcaguuucagggguguacccaaugucaauaccagcaacccuuuuugugugguauuuuuggcagaaaaagaaacagagaucaggagucuugugggacacacccagcccuccagaaguagaaagagcaguucuugaugaugguaucuauagaaucuugcaaagaggacuguuggguaggucccagguaggagugggaguuuuucaagacggcguguuccacacaauguggcaugucaccaggggggcuguccucauguaccaagggaagaggcuggaaccaaguugggccagugucaaaaaagacuugaucucauauggaggagguuggagguuucaaggaucauggaacacgggagaagaaguacaggugauagcuguugaaccagggaaaaacccaaagaauguacagacaacgccgggcaccuucaagaccccugaaggcgaaguuggagccauagcccuagauuucaaaccuggcacaucuggaucucccaucgugaacagagaggggaaaauaguaggucuuuauggaaauggaguggugacaacaaguggaaccuacgucagugccauugcccaagcuaaagcgucacaagaagggccucuaccagagauugaggacgagguguuuaagaaaagaaaccuaacaauaauggaccuacauccaggaucaggaaaaacaagaagauaucuuccagccauaguccgugaggccauaaaaaggaaacugcgcacgcuaaucuuggcucccacaagaguugucgccucugaaauggcagaggcgcuuaaaggaaugccaauaagauaucagacaacagcaguaaagagugaacacacaggaaaggagauagucgaucucaugugccacgccacuuucaccaugcgucuccuaucuccagugagaguucccaauuacaacaugauuaucauggaugaagcacacuuuaccgauccagccagcauagcggccagaggguacaucucaacccgaguggguaugggugaagcagcugcgaucuuuaugacagccacucccccaggaucgguagaggccuuuccacagagcaaugcaguuauccaagaugaggaaagagacauuccugagagaucauggaacucaggcuacgacuggaucacugacuucccaggaaaaacagucugguuuguuccaagcaucaaaucaggaaaugacauugccaacugcuuaagaaaaaacgggaaacgggugauccaauugagcagaaaaaccuuugacacugaauaccagaaaacgaaaaacaaugauugggacuauguugucacaacagacauuuccgaaaugggagcaaauuuccgggccgauaggguaauagacccaaggcggugcuugaagccgguaauacuaaaagauggcccagagcgcgucauucuggccggaccaaugccagugaccgcggccagugcugcccagaggagaggaagaauuggaaggaaccaaaacaaggaaggugaccaguauauuuacaugggacagccuuuaaauaaugaugaggaccacgcucauuggacagaagcaaaaaugcuccuugacaauauaaauacgccagaagggauuaucccagcccucuuugagccagagagagaaaagagugcagcaauagacggggaguauagacugcggggagaagcaaggaaaacguucguggagcuaaugagaagaggggaucuaccaguuuggcuaucuuacaaaguugccucagaaggcuuccaguacuccgacagaagauggugcuuugacggggaaaggaacaaccagguguuggaggagaacauggacguggagaucuggacaaaagaaggagaaagaaagaaauugcgaccucgcugguuagaugccagaaccuacucugauccacuggcccugcgcgaguuuaaagaguucgcagcaggaagaagaagugucucaggugaccuaauauuagaaauagggaaacucccacagcauuugacgcuaagggcccagaaugcuuuggacaacuuggucauguugcacaauuccgaacaagggggaaaagccuauagacaugcuauggaagaacuaccagacaccauagaaacauugaugcuacuagccuugauagcugugcugacugguggaguuacguuguuuuuccuaucaggaaaaggucuagggaaaacauccauuggccugcuuuguguaauggccucaaguguacuguuauggauggccaguguggagccccauuggauagcggccuccaucauacuagaguuuuuucugauggugcugcuuauuccagagccagacagacagcguacuccacaggacaaucaacuagcauauguggugauagguuuguuauucaugauauugacaguggcagccaaugagaugggauuacuggaaaccacaaagaaagaccuggggauuggccauguagucgccgaaaaccaccaccaugccacaaugcuagacauagacuuacauccagcuucagccuggacccucuaugcaguagccacaacaauuaucacucccaugaugagacacacaauugaaaacacaacggcaaacauuucccugacagcuauugcaaaucaggcggcuauauuaaugggacuugacaagggauggccaauaucgaagauggacauaggagugccacuucucgccuuagggugcuauucccaggugaacccauugacacugacagcggcgguguuaauguuaguggcucauuaugccauaaucggaccuggacugcaagcaaaagcuaccagagaagcccaaaaaaggacugcggccggaauaaugaaaaauccaacuguggacgggauuguugcaauagauuuggauccugugguuuaugaugcaaaauuugaaaaacagcuaggccaaauaauguuacuaauacucugcacaucacagauucucuugaugcggacuacaugggccuuaugugaaucuaucacacuggcuacuggacccuugaccacucucugggagggaucuccuggaaaauucuggaauaccacgauagcaguguccauggcaaacaucuucaggggaaguuauuuagcaggggcaggucuggccuucucauuaaugaaaacuuuaggaggagguaggagagguacgggagcucaaggggaaacauugggagaaaaauggaaaagacaacuaaaccaacugagcaagucagaauuuaacacuuacaaaaggaguggaauuauggagguggacagauccgaagccaaggagggacugaaaagaggagaaacaaccaaacaugcagugucgagaggaacagccaaacuuaggugguuuguggagaggaaccuugugaaaccggaagggaaagugauagaccucgguuguggaagagguggcuggucauauuacugcgcugggcugaagaaggucacagaaguaaagggauacacaaaaggaggacccggucaugaggaaccuaucccaauggcgacuuauggauggaacauagugaagcuacacucuggaagggauguauucuuuacaccaccugagaaaugugacacccuuuugugugauauuggugaguccucuccgaauccaacuauagaagaaggaagaacguuacguguucuaaagaugguggaaccauggcucagaggaaaucaguuuugcauaaaaauccuaaauccuuauaugccaagugugguagaaacucuggagcaaaugcaaagaaaacauggagggaugcuagugcgaaacccacucucaagaaauuccacccaugaaauguacugggucucauguggaacaggaaacauugugucggcagugaacaugacauccagaaugcugcugaaucgguucacaauggcucacaggaagccaacguaugaaagagacguggacuugggcgcuggaacaagacauguggcaguggaaccagagauagccaaccuagacauuauuggccagaggauagagaacauaaaaaaugaacauaagucaacauggcauuaugaugaggacaauccauacaaaacaugggccuaucauggaucauaugaggucaagccaucagggucagccucauccauggugaauggcguggugagauugcucaccaagccaugggauguuauccccauggucacacaaauagcuaugacugauaccacacccuucggacaacagaggguuuucaaagagaaaguugacacacgcacaccaagaccaaaacgaggcacagcacaaauuauggaggugacagccaagugguuguggggauuccucucuagaaauaaaaaacccagaaucugcacaagagaggaguucacaagaaaaguuaggucaaacgcagcaauuggagcaguguuuguugaugaaaaccaauggaacucagcaaaagaagcaguggaagacgaaagguuuugggaccucgugcacagagagagggagcuucauaaacagggaaaaugugccacgugugucuacaauaugauggguaaaagagagaaaaaacuaggagaguuuggaaaggcaaaaggaagucgugcaauaugguacaugugguugggagcacgcuuucuagaauuugaagcccuuggcuucaugaaugaagaccacugguucaguagggagaauucacucaguggaguggaaggagaaggacuacauaaacuuggauacauacucagagacauaucaaagauuccagggggaaauauguaugcagacgacacagcuggaugggacacaagaauaacagaggaugaucuucagaaugaggcuaaaaucaccgacaucauggagccugaacaugcucuacuggcuacgucaaucuucaagcugaccuaucaaaauaaggugguaagggugcaaagaccagcaaaaaguggaaccgugauggacgucauauccagacgugaccagagaggaaguggacaggucggaacuuauggccuaaacacuuucaccaacauggagguccaacuaauaagacaaauggaaucugaaggaaucuuuucacccagcgaauuggaaaauucaaaucuagcugagagaguucucgacugguuggaaaaacauggcgucgaaagguugaaaagaauggcaaucagcggagaugacuguguggugaaaccaacugaugacagguucgcaacagcuuuaacagcccugaaugacaugggaaaggugagaaaagacauaccgcaaugggaaccuucaaaaggauggaaugacuggcagcaagugccuuucuguucacaccacuuccaccaacugauaaugaaggaugggagggagauaguggugccaugccgcaaccaagaugaacuugugggcagggccagaguaucacaaggcgccggguggagccugagagaaacugcuugccuaggcaagucauaugcacaaauguggcagcugauguacuuccacaggagagaccugagacuggcggcuaaugcuaucuguucagccguuccaguuaauugggucccaaccagccgcaccaccuggucgauccaugcccaccaucaauggaugacaacagaagacauguugucaguauggaauaggguuuggauagaggaaaacccauggauggaggacaaaacucauguauccagcugggaagauguuccauacuuaggaaaaagggaagaucaaugguguggaucucugauaggcuuaacagcaagagccaccugggccaccaacauacaaguggccauaaaccaagugagaaggcuuauugggaacgagaauuauuuagacuacaugacaucaaugaagagauucaagaaugagagugaucccgaaggagcccucugguaa

SEQ ID NO: 6297 - RNA, 9879 nt, Artificial Sequence
  derived and/or modified CDS sequence (wt) from DENV-1__KM403591__SS-prME
uccgugaccaugcuccucaugcugcugcccacagcccuggcguuccauuugaccacacgagggggagagccacacaugauaguuagcaagcaggaaagaggaaagucacucuuguuuaagaccucugcaggugucaacaugugcacccucauugcaauggauuugggagaguuaugugaagauacaaugaccuacaaaugcccccggaucacugaagcggaaccagaugauguugauugcuggugcaaugccacagacacaugggugaccuaugggacguguucucagacuggcgaacaccgacgggauaaacguucugucgcauuggccccacacguggggcuuggucucgaaacaagaaccgaaacguggauguccucugaaggcgccuggaggcagauacaaaaaguggagacuugggccuugagacacccaggauucacggugauagcccuuuuuuuagcacaugccauaggaacauccauuacccagaaagggaucaucuucauuuugcugaugcuggugacaccaucaauggccaugcgaugcgugggaauaggcaacagagacuucguugaaggacugucaggagcaacauggguggaugugguacuggagcauggaagcugugucaccaccauggcaaagaauaaaccaacauuggacauugaacucuugaagacggaggucacgaacccugccgucuugcgcaaacugugcauugaagcuaaaauaucaaacaccaccaccgauucaagauguccaacacaaggagaggcuacacugguggaagaacaagacgcgaacuuugugugucgacgaacauucguggacagaggcugggguaaugguuguggacuauucgggaagggaagcuuacuaacgugugcuaaguuuaagugugugacaaaacuugaaggaaagauaguucaauaugaaaacuuaaaauauucggugauagucacuguccacacuggggaccagcaccagguaggaaaugagacuacagaacauggaacaauugcaaccauaacaccucaagcucccacgucggaaauacagcugacugacuacggagcccuuacauuggacugcucaccuagaacagggcuggacuuuaaugagauggugcuguugacaaugaaagaaaaaucauggcuuguccacaaacaaugguuucuagacuuaccauugccuuggaccucgggggcuucaacaucucaagagacuuggaacagacaagaucugcuggucacauuuaagacagcucaugcaaagaagcaggaaguagucguacuggggucacaagaaggagcaaugcacacugcguugacuggggcgacagaaauccagacgucaggaacgacgacaaucuucgcaggacaccugaaauguagacuaaaaauggguaaacugacucuaaaaggggugucauaugugaugugcacaggcucauuuaagcuagagaaggaaguggcugagacccagcauggaacuguccuagugcagguuaaauaugaaggaacagaugcaccaugcaagauuccaauuucaacccaagaugagaaaggagugacccagaaugggagauugauaacagccaaucccauaguuacugacaaagaaaaaccagucaacauugaaacagaaccacccuuuggugagagcuacaucgugauaggggcgggugaaaaagcuuugaaacuaagcugguucaagaaaggaagcagcauagggaaaauguucgaagccaccgcccgaggagcacgaaggauggcuauccugggagacacagcaugggacuucgguuccauaggagggguguucacaucugugggaaaauugguacaccagguuuuuggaaccgcauaugggguccuguucagcgguguuucuuggaccaugaaaauaggaauagggauccugcugacauggcuaggauugaauucaaggagcacgucacucucgaugacgugcauugcaguuggcauggucacacuguaccuaggaguuaugguucaagcggacucggggugugugaucaacuggaagggcagagaacucaaguguggaaguggcaucuuugucacuaaugaaguccacacuuggacagagcaauacaaauuucaggcugacuccccaaaaagacuaucagcagccauugggaaggcaugggaggaaggcguguguggaauucgaucagccacacgucuugagaacaucauguggaagcaaauaucaaaugaauugaaccacauucuacuugaaaaugacaugaaauucacagugguuguaggagacgccaauggaaucuugacccaaggaaaaaagaugauuaggccacaacccauggaacacaaauacucauggaaaagcuggggaaaagccaaaaucauaggagcagauacacagaauacuaccuucaucaucgauggcccagacacuccagaaugccccgaugaccagagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaacgagaccuggaagcuagcgagagccuccuucauagaagugaagacaugcaucuggccaagaucccacacucuauggagcaauggagucuuggaaagugaaaugauaaucccaaagauauauggaggaccaauaucucagcacaacuacagaccaggguauuucacacaaacagcagggccauggcaccuaggcaaguuggaacuagacuuuaauuugugugaaggcaccacaguuguuguggaugaacauuguggaaaucgagguccaucucuuagaacuacaacaguuacaggaaagauaauccaugaauggugcugcagauccugcacgcuaccccccuuacgcuucagaggagaagacggauguugguauggcauggaaaucagaccaguuaaggagaaggaagagaaucuagucaggucaauggucucugcagggucaggagaaguggacaguuuuucauugggacuacuaugcguaucaauaaugauugaagaagugaugagauccagauggaguagaaagaugcugaugacuggaacacuggcuguuuucuuccuucucauaaugggacaacugacauggaaugaucugaucagguuaugcaucaugguuggagccaaugucucagacagaauggggaugggaacaacguaccuagcuuuaauggccacuuuuaaaaugagaccgauguucgcuguugggcuauuauuucgcagacuaacauccagagaggugcuccuucucacaauuggacuaagccugguggcauccguggagcuaccaaauucuuuagaggagcuaggggacggacuugcgaugggcaucaugauguuaaaauuguugacugauuuucagucacaccaguuguggacuaccuuacugucucugacauucaucaaaacaacucuuucacuggauuaugcauggaagacaauggcuaugguauugucaaucguaucucucuuuccucuaugucuauccacgaccucucaaaaaacaacauggcuuccgguguuguuaggauccuuuggauguaaaccacuaaccauguuucuuauaacagaaaacaaaauuuggggaaggaaaaguuggccccucaaugaaggaauuauggcuguuggaauagucagcaucuuacuaaguucacuccucaaaaaugacgugccacuagccggcccacuaauagcuggaggcaugcugauagcauguuacgucauuuccggaagcucagccgauuuaucauuggagagagcggcugaggucuccugggaagaagaagcagaacacucuggugccucacacaacauacuaguggagguccaagaugauggaacuaugaaaauaaaagaugaagagagagaugacacgcucacuauacuccucaaagcaacuuuguuggcaguuucagggguguacccaaugucaauaccagcaacccuuuuugugugguauuuuuggcagaaaaagaaacagagaucaggagucuugugggacacacccagcccuccagaaguagaaagagcaguucuugaugaugguaucuauagaaucuugcaaagaggacuguuggguaggucccagguaggagugggaguuuuucaagacggcguauuccacacaauguggcaugucaccaggggggcuguccucauguaccaagggaagaggcuggaaccaaguugggccagugucaaaaaagacuugaucucauauggaggagguuggagguuucaaggaucauggaacacgggagaagaaguacaggugauagcuguugaaccagggaaaaacccaaagaauguacagacaacgccgggcaccuucaagaccccugaaggcgaaguuggagccauagcccuagauuucaaaccuggcacaucuggaucucccaucgugaacagagaggggaaaauaguaggucuuuauggaaauggaguggugacaacaaguggaaccuacgucagugccauugcccaagcuaaagcgucacaagaagggccucuaccagagauugaggacgagguguuuaagaaaagaaaccuaacaauaauggaccuacauccaggaucaggaaaaacaaaaagauaucuuccagccauaguccgugaggccauaaaaaggaaacugcgcacgcuaaucuuggcucccacaagaguugucgccucugaaauggcagaggcgcuuaaaggaaugccaauaagauaucagacaacagcaguaaagagugaacacacaggaaaggagauagucgaucucaugugccacgccacuuucaccaugcgucuccuaucuccagugagaguucccaauuacaacaugauuaucauggaugaagcacacuuuaccgauccagccagcauagcggccagaggguacaucucaacccgaguggguaugggugaagcagcugcgaucuuuaugacagccacucccccaggaucgguagaggccuuuccacagagcaaugcaguuauccaagaugaggaaagagacauuccugagagaucauggaacucaggcuacgacuggaucacugacuucccaggaaaaacagucugguuuguuccaagcaucaaaucaggaaaugacauugccaacugcuuaagaaaaaacgggaaacgggugauccaauugagcagaaaaaccuuugacacugaauaccaaaaaacgaaaaacaaugauugggacuauguugucacaacagacauuuccgaaaugggagcaaauuuccgggccgauaggguaauagacccaaggcggugcuugaagccgguaauacuaaaagauggcccagagcgcgucauucuggccggaccaaugccagugaccgcggccagugcugcccagaggagaggaagaauuggaaggaaccaaaacaaggaaggugaccaguauauuuacaugggacagccuuuaaauaaugaugaggaccacgcucauuggacagaagcaaaaaugcuccuugacaauauaaauacgccagaagggauuaucccagcccucuuugagccagagagagaaaagagugcagcaauagacggggaguauagacugcggggagaagcaaggaaaacguucguggagcuaaugagaagaggggaucuaccaguuuggcuaucuuacaaaguugccucagaaggcuuccaguacuccgacagaagauggugcuuugacggggaaaggaacaaccagguguuggaggagaacauggacguggagaucuggacaaaagaaggagaaagaaagaaauugcgaccucgcugguuagaugccagaaccuacucugauccacuggcccugcgcgaguuuaaagaguucgcagcaggaagaagaagugucucaggugaccuaauauuagaaauagggaaacucccacagcauuugacgcuaagggcccagaaugcuuuggacaacuuggucauguugcacaauuccgaacaagggggaaaagccuauagacaugcuauggaagaacuaccagacaccauagaaacauugaugcuacuagccuugauagcugugcugacugguggaguuacguuguuuuuccuaucaggaaaaggucuagggaaaacauccauuggccuacuuuguguaauggccucaaguguacuguuauggauggccaguguggagccccauuggauagcggccuccaucauacuagaguuuuuucugauggugcugcuuauuccagagccagacagacagcguacuccacaggacaaucaacuagcauauguggugauagguuuguuauucaugauauugacaguggcagccaaugagaugggauuacuggaaaccacaaagaaagaccuggggauuggccauguagucgccgaaaaccaccaccaugccacaaugcuagacauagacuuacauccagcuucagccuggacccucuaugcaguagccacaacaauuaucacucccaugaugagacacacaauugaaaacacaacggcaaacauuucccugacagcuauugcaaaucaggcggcuauauuaaugggacuugacaagggauggccaauaucgaagauggacauaggagugccacuucucgccuuagggugcuauucccaggugaacccauugacacugacagcggcgguguuaauguuaguggcucauuaugccauaaucggaccuggacugcaagcaaaagcuaccagagaagcccaaaaaaggacugcggccggaauaaugaaaaauccaacuguagacgggauuguugcaauagauuuggauccugugguuuaugaugcaaaauuugaaaaacagcuaggccaaauaauguuacuaauacucugcacaucacagauucucuugaugcggacuacaugggccuuaugugaaucuaucacacuggcuacuggacccuugaccacucucugggagggaucuccuggaaaauucuggaauaccacgauagcaguguccauggcaaacaucuucaggggaaguuauuuagcaggggcaggucuggccuucucauuaaugaaaucuuuaggaggagguaggagagguacgggagcucaaggggaaacauugggagaaaaauggaaaagacaacuaaaccaacugagcaagucagaauuuaacacuuacaaaaggaguggaauuauggagguggacagauccgaagccaaggagggacugaaaagaggagaaacaaccaaacaugcagugucgagaggaacagccaaacuuaggugguuuguggagaggaaccuugugaaaccggaagggaaagugauagaccucgguuguggaagagguggcuggucauauuacugcgcugggcugaagaaggucacagaaguaaagggauacacaaaaggaggacccggucaugaggaaccuaucccaauggcgaccuauggauggaacauagugaagcuacacucuggaagggauguauucuuuacaccaccugagaaaugugacacccuuuugugugauauuggugaguccucuccgaauccaacuauagaagaaggaagaacguuacguguucuaaagaugguggaaccauggcucagaggaaaucaguuuugcauaaaaauccuaaauccuuauaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaaugcugcugaaucgguucacaauggcucacaggaaaccaacguaugaaagagacguggacuugggcgcuggaacaagacauguggcaguggaaccagagauagccaaccuagacauuauuggccagaggauagagaacauaaaaaaugaacauaagucaacauggcauuaugaugaggacaauccauacaaaacaugggccuaucauggaucauaugaggucaagccaucagggucagccucauccauggugaauggcguggugagauugcucaccaagccaugggauguuauccccauggucacacaaauagcuaugacugauaccacacccuucggacaacagaggguuuucaaagagaaaguugacacacgcacaccaagaccaaaacgaggcacagcacaaauuauggaggugacagccaagugguuguggggauuccucucuagaaauaaaaaacccagaaucugcacaagagaggaguucacaagaaaaguuaggucaaacgcagcaauuggagcaguguuuguugaugaaaaccaauggaacucagcaaaagaagcaguggaagacgaaagguuuugggaccucgugcacagagagagggagcuucauaaacagggaaaaugugccacgugugucuacaauaugauggguaaaagagagaaaaaacuaggagaguuuggaaaggcaaaaggaagucgugcaauaugguacaugugguugggagcacgcuuucuagaauuugaagcccuuggcuucaugaaugaagaccacugguucaguagggagaauucacucaguggaguggaaggagaaggacuacauaaacuuggauacauacucagagacauaucaaagauuccagggggaaauauguaugcagacgacacagcuggaugggacacaagaauaacagaggaugaucuucagaaugaggcuaaaaucaccgacaucauggagccugaacaugcucuacuggcuacgucaaucuucaagcugaccuaucaaaauaaggugguaagggugcaaagaccagcaaaaaguggaaccgugauggacgucauauccagacgugaccagagaggaaguggacaggucggaacuuauggccuaaacacuuucaccaacauggagguccaacuaauaagacaaauggaaucugaaggaaucuuuucacccagcgaauuggaaaauucaaaucuagcugagagaguucucgacugguuggaaaaacauggcgucgaaagguugaaaagaauggcaaucagcggagaugacuguguggugaaaccaacugaugacagguucgcaacagcuuuaacagcccugaaugacaugggaaaggugagaaaagacauaccgcaaugggaaccuucaaaaggauggaaugacuggcagcaagugccuuucuguucacaccacuuccaccaacugauuaugaaggaugggagggagauaguggugccaugccgcaaccaagaugaacuugugggcagggccagaguaucacaaggcgccggguggagccugagagaaacugcuugccuaggcaagucauaugcacaaauguggcagcugauguacuuccacaggagagaucugagacuggcggcuaaugcuaucuguucagccguuccaguuaauugggucccaaccagccgcaccaccuggucgauccaugcccaccaucaauggaugacaacagaagacauguugucaguauggaauaggguuuggauagaggaaaacccauggauggaggacaaaacucauguauccagcugggaagauguuccauacuuaggaaaaagggaagaucaaugguguggaucucugauaggcuuaacagcaagagccaccugggccaccaacauacaaguggccauaaaccaagugagaaggcuuauugggaacgagaauuauuuagacuacaugacaucaaugaagagauucaagaaugagagugaucccgaaggagcccucugguaa

SEQ ID NO: 6298 - RNA, 9879 nt, Artificial Sequence
  derived and/or modified CDS sequence (wt) from DENV-1__KM403607__SS-prME
uccgugaccaugcuccucaugcugcugccuacagcccuggcguuccauuugacuacacgagggggagagccacacaugauaguuagcaagcaggaaagaggaaagucacucuuguuuaagaccucugcaggugucaacaugugcacccucauugcaauggauuugggagaguuaugugaggauacaaugaccuacaaaugcccccggaucacugaagcggaaccagaugauguugauugcuggugcaaugccacagacacaugggugaccuaugggacguguucucagacuggcgaacaccgacgggauaaacguucugucgcauuggccccacacguggggcuuggucucgaaacaagaaccgaaacguggauguccucugaaggcgccuggaggcagauacaaaaaguggagacuugggccuugagacacccaggauucacggugauagcccuuuuuuuagcacaugccauaggaacauccauuacccagaaagggaucaucuucauuuugcugaugcuggugacaccaucaauggccaugcgaugcgugggaauaggcaacagagacuucguugaaggacugucaggagcaacauggguggaugugguauuggagcauggaagcugugucaccaccauggcaaagaauaaaccaacauuggacauugaacucuugaagacggaggucacgaacccugccgucuugcgcaaacugugcauugaagcuaaaauaucaaacaccaccaccgauucaagauguccaacacaaggagaagcuacacugguggaagaacaagacgcgaacuuugugugucgacgaacauucguggacagaggcugggguaaugguuguggacuauucgggaagggaagcuuacuaacgugugcuaaguuuaagugugugacaaaacuugaaggaaagauaguucaauaugaaaacuuaaaauauucggugauagucacuguccacacuggggaccagcaccagguaggaaaugagacuacagaacauggaacaauugcaaccauaacaccucaagcucccacgucggaaauacagcugacugacuacggagcccuuacauuggacugcucaccuagaacagggcuggacuuuaaugagauggugcuguugacaaugaaagaaaaaucauggcuuguccacaaacaaugguuucuagacuuaccauugccuuggaccucgggggcuucaacaucucaagagacuuggaacagacaagaucugcuggucacauuuaagacagcucaugcaaagaagcaggaaguagucguacuggggucacaagaaggagcaaugcacacugcguugacuggggcgacagaaauccagacgucaggaacgacgacaaucuucgcaggacaccugaaauguagacuaaaaauggauaaacugacuuuaaaaggggugucauaugugaugugcacaggcucauuuaagcuagagaaggaaguggcugagacccagcauggaacuguccuagugcagguuaaauaugaaggaacagaugcaccaugcaagauuccaauuucaauccaagaugagaaaggagugacccagaaugggagauugauaacagccaaucccauaguuacugacaaagaaaaaccagucaacauugaaacagaaccacccuuuggugagagcuacaucgugauaggggcgggugaaaaagcuuugaaacuaagcugguucaagaaaggaagcagcauagggaaaauguucgaagccaccgcccgaggagcacgaaggauggcuauccugggagacacagcaugggacuucgguuccauaggagggguguucacaucugugggaaaauugguacaccagguuuuuggaaccgcauaugggguccuguucagcgguguuucuuggaccaugaaaauaggaauagggauucugcugacauggcuaggauugaauucaaggagcacgucacucucgaugacgugcauugcaguuggcauggucacacuguaccuaggagucaugguucaagcggacucggggugugugaucaacuggaagggcagagaacucaaguguggaaguggcaucuuugucacuaaugaaguccacacuuggacagagcaauacaaauuucaggcugacuccccaaaaagacuaucagcagccauugggaaggcaugggaggaaggcguguguggaauucgaucagccacacgucuugagaacaucauguggaagcaaauaucaaaugaauugaaccacauucuacuugaaaaugacaugaaauucacagugguuguaggagacgccaauggaaucuugacccaaggaaaaaagaugauuaggccacaacccauggaacacaaauacucauggaaaagcuggggaaaagccaaaaucauaggagcagauacacagaauacuaccuucaucaucgauggcccagacacuccagaaugccccgaugaccagagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaacgagaccuggaagcuagcgagagccuccuucauagaagugaagacaugcaucuggccaagaucccacacucuauggagcaauggagucuuggaaagugaaaugauaaucccaaagauauauggaggaccaauaucucagcacaacuacagaccaggguauuucacacaaacagcagggccauggcaccuaggcaaguuggaacuagacuuuaauuugugugaaggcaccacaguuguuguggaugaacauuguggaaaucgagguccaucucuuagaacuacaacagucacaggaaagauaauccaugaauggugcugcagauccugcacgcuaccccccuuacgcuucagaggagaagacggauguugguauggcauggaaaucagaccaguuaaggagaaggaagagaaucuagucaggucaauggucucugcagggucaggagaaguggacaguuuuucauugggacuacuaugcguaucaauaaugauugaagaagugaugagauccagauggaguagaaagaugcugaugacuggaacacuggcuguuuucuuccuucuuauaaugggacaacugacauggaaugaucugaucagguuaugcaucaugguuggagccaaugucucagacagaauggggaugggaacaacguaccuagcuuuaauggccacuuuuaaaaugagaccgauguucgcuguugggcuauuauuucgcagacuaacauccagagaggugcuccuucucacaauuggacuaagccugguggcauccguggagcuaccaaauucuuuagaggagcuaggggacggacuugcgaugggcaucaugauguugaaauuguugacugauuuucagucacaccaguuguggacuaccuuacugucucugacauucaucaaaacaacucuuucacuggauuaugcauggaagacaauggcuaugguauugucaaucguaucucucuuuccucuaugucuauccacgaccucucaaaaaacaacauggcuuccgguguuguuaggauccuuuggauguaaaccacuaaccauguuucuuauaacagaaaacaaaauuuggggaaggaaaaguuggccccucaaugaaggaauuauggcuguuggaauagucagcauuuuacuaaguucacuccucaaaaaugacgugccacuagccggcccacuaauagcuggaggcaugcugauagcauguuacgucauuuccggaagcucagccgauuuaucauuggagagagcggcugaggucuccugggaagaagaagcagaacacucuggugccucacacaacauacuaguggagguccaagaugauggaacuaugaaaauaaaagaugaagagagagaugacacgcucacuauacuccucaaagcaacuuuguuggcaguuucagggguguacccaaugucaauaccagcaacccuuuuugugugguauuuuuggcagaaaaagaaacagagaucaggagucuugugggacacacccagcccuccagaaguagaaagagcaguucuugaugaugguaucuauagaaucuugcaaagaggacuguuggguaggucccagguaggagugggaguuuuucaagacggcguguuccacacaauguggcaugucaccaggggggcuguccucauguaccaagggaagaggcuggaaccaaguugggccagugucaaaaaagacuugaucucauauggaggagguuggagguuucaaggaucauggaacacgggagaagaaguacaggugauagcuguugaaccagggaaaaacccaaagaauguacagacaacgccgggcaccuucaagaccccugaaggcgaaguuggagccauagcccuagauuucaaaccuggcacaucuggaucucccaucgugaacagagaggggaaaauaguaggucuuuauggaaauggaguggugacaacaaguggaaccuacgucagugccauugcccaagcuaaagcgucacaagaagggccucuaccagagauugaggacgagguguuuaagaaaagaaaccuaacaauaauggaccuacauccaggaucaggaaaaacaagaagauaucuuccagccauaguccgugaggccauaaaaaggaaacugcgcacgcuaaucuuggcucccacaagaguugucgccucugaaauggcagaggcgcuuaaaggaaugccaauaagauaucagacaacagcaguaaagagugaacacacaggaaaggagauagucgaucucaugugccacgccacuuucaccaugcgucuccuaucuccagugagaguucccaauuacaacaugauuaucauggaugaagcacacuuuaccgauccagccagcauagcggccagaggguacaucucaacccgaguggguaugggugaagcagcugcgaucuuuaugacagccacucccccaggaucgguagaggccuuuccacagagcaaugcaguuauccaagaugaggaaagagacauuccugagagaucauggaacucaggcuacgacuggaucacugacuucccaggaaaaacagucugguuuguuccaagcaucaaaucaggaaaugacauugccaacugcuuaagaaaaaacgggaaacgggugauccaauugagcagaaaaaccuuugacacugaauaccagaaaacgaaaaacaaugauugggacuauguugucacaacagacauuuccgaaaugggagcaaauuuccgggccgauaggguaauagacccaaggcggugcuugaagccgguaauacuaaaagauggcccagagcgcgucauucuggccggaccaaugccagugaccgcggccagugcugcccagaggagaggaagaauuggaaggaaccaaaacaaggaaggugaccaguauauuuacaugggacagccuuuaaauaaugaugaggaccacgcucauuggacagaagcaaaaaugcuccuugacaauauaaauacgccagaagggauuaucccagcccucuuugagccagagagagaaaagagugcagcaauagacggggaguauagacugcggggagaagcaaggaaaacguucguggagcuaaugagaagaggggaucuaccaguuuggcuaucuuacaaaguugccucagaaggcuuccaguacuccgacagaagauggugcuuugacggggaaaggaacaaccagguguuggaggagaacauggacguggagaucuggacaaaagaaggagaaagaaagaaauugcgaccucgcugguuagaugccagaaccuacucugauccacuggcccugcgcgaguuuaaagaguucgcagcaggaagaagaagugucucaggugaccuaauauuagaaauagggaaacucccacagcauuugacgcuaagggcccagaaugcuuuggacaacuuggucauguugcacaauuccgaacaagggggaaaagccuauagacaugcuauggaagaacuaccagacaccauagaaacauugaugcuacuagccuugauagcugugcugacugguggaguuacguuguuuuuccuaucaggaaaaggucuagggaaaacauccauuggccugcuuuguguaauggccucaaguguacuguuauggauggccaguguggagccccauuggauagcggccuccaucauacuagaguuuuuucugauggugcugcuuauuccagagccagacagacagcguacuccacaggacaaucaacuagcauauguggugauagguuuguuauucaugauauugacaguggcagccaaugagaugggauuacuggaaaccacaaagaaagaccuggggauuggccauguagucgccgaaaaccaccaccaugccacaaugcuagacauagacuuacauccagcuucagccuggacccucuaugcaguagccacaacaauuaucacucccaugaugagacacacaauugaaaacacaacggcaaacauuucccugacagcuauugcaaaucaggcggcuauauuaaugggacuugacaagggauggccaauaucgaagauggacauaggagugccacuucucgccuuagggugcuauucccaggugaacccauugacacugacagcggcgguguuaauguuaguggcucauuaugccauaaucggaccuggacugcaagcaaaagcuaccagagaagcccaaaaaaggacugcggccggaauaaugaaaaauccaacuguggacgggauuguugcaauagauuuggauccugugguuuaugaugcaaaauuugaaaaacagcuaggccaaauaauguuacuaauacucugcacaucacagauucucuugaugcggacuacaugggccuuaugugaaucuaucacacuggcuacuggacccuugaccacucucugggagggaucuccuggaaaauucuggaauaccacgauagcaguguccauggcaaacaucuucaggggaaguuauuuagcaggggcaggucuggccuucucauuaaugaaaacuuuaggaggagguaggagagguacgggagcucaaggggaaacauugggagaaaaauggaaaagacaacuaaaccaacugagcaagucagaauuuaacacuuacaaaaggaguggaauuauggagguggacagauccgaagccaaggagggacugaaaagaggagaaacaaccaaacaugcagugucgagaggaacagccaaacuuaggugguuuguggagaggaaccuugugaaaccggaagggaaagugauagaccucgguuguggaagagguggcuggucauauuacugcgcugggcugaagaaggucacagaaguaaagggauacacaaaaggaggacccggucaugaggaaccuaucccaauggcgacuuauggauggaacauagugaagcuacacucuggaagggauguauucuuuacaccaccugagaaaugugacacccuuuugugugauauuggugaguccucuccgaauccaacuauagaagaaggaagaacguuacguguucuaaagaugguggaaccauggcucagaggaaaucaguuuugcauaaaaauccuaaauccuuauaugccaagugugguagaaacucuggagcaaaugcaaagaaaacauggagggaugcuagugcgaaacccacucucaagaaauuccacccaugaaauguacugggucucauguggaacaggaaacauugugucggcagugaacaugacauccagaaugcugcugaaucgguucacaauggcucacaggaagccaacguaugaaagagacguggacuugggcgcuggaacaagacauguggcaguggaaccagagauagccaaccuagacauuauuggccagaggauagagaacauaaaaaaugaacauaagucaacauggcauuaugaugaggacaauccauacaaaacaugggccuaucauggaucauaugaggucaagccaucagggucagccucauccauggugaauggcguggugagauugcucaccaagccaugggauguuauccccauggucacacaaauagcuaugacugauaccacacccuucggacaacagaggguuuucaaagagaaaguugacacacgcacaccaagaccaaaacgaggcacagcacaaauuauggaggugacagccaagugguuguggggauuccucucuagaaauaaaaaacccagaaucugcacaagagaggaguucacaagaaaaguuaggucaaacgcagcaauuggagcaguguuuguugaugaaaaccaauggaacucagcaaaagaagcaguggaagacgaaagguuuugggaccucgugcacagagagagggagcuucauaaacagggaaaaugugccacgugugucuacaauaugauggguaaaagagagaaaaaacuaggagaguuuggaaaggcaaaaggaagucgugcaauaugguacaugugguugggagcacgcuuucuagaauuugaagcccuuggcuucaugaaugaagaccacugguucaguagggagaauucacucaguggaguggaaggagaaggacuacauaaacuuggauacauacucagagacauaucaaagauuccagggggaaauauguaugcagacgacacagcuggaugggacacaagaauaacagaggaugaucuucagaaugaggcuaaaaucaccgacaucauggagccugaacaugcucuacuggcuacgucaaucuucaagcugaccuaucaaaauaaggugguaagggugcaaagaccagcaaaaaguggaaccgugauggacgucauauccagacgugaccagagaggaaguggacaggucggaacuuauggccuaaacacuuucaccaacauggagguccaacuaauaagacaaauggaaucugaaggaaucuuuucacccagcgaauuggaaaauucaaaucuagcugagagaguucucgacugguuggaaaaacauggcgucgaaagguugaaaagaauggcaaucagcggagaugacuguguggugaaaccaacugaugacagguucgcaacagcuuuaacagcccugaaugacaugggaaaggugagaaaagacauaccgcaaugggaaccuucaaaaggauggaaugacuggcagcaagugccuuucuguucacaccacuuccaccaacugauaaugaaggaugggagggagauaguggugccaugccgcaaccaagaugaacuugugggcagggccagaguaucacaaggcgccggguggagccugagagaaacugcuugccuaggcaagucauaugcacaaauguggcagcugauguacuuccacaggagagaccugagacuggcggcuaaugcuaucuguucagccguuccaguuaauugggucccaaccagccgcaccaccuggucgauccaugcccaccaucaauggaugacaacagaagacauguugucaguauggaauaggguuuggauagaggaaaacccauggauggaggacaaaacucauguauccagcugggaagauguuccauacuuaggaaaaagggaagaucaaugguguggaucucugauaggcuuaacagcaagagccaccugggccaccaacauacaaguggccauaaaccaagugagaaggcuuauugggaacgagaauuauuuagacuacaugacaucaaugaagagauucaagaaugagagugaucccgaaggagcccucugguaa

SEQ ID NO: 6299 - RNA, 9879 nt, Artificial Sequence
  derived and/or modified CDS sequence (wt) from DENV-1__KM403581__SS-prME
uccgugaccaugcuccucaugcugcugcccacagcccuggcguuccauuugaccacacgagggggagagccacacaugauaguuagcaagcaggaaagaggaaagucacucuuguuuaagaccucugcaggugucaacaugugcacccucauugcaauggauuugggagaguuaugugaggauacaaugaccuacaaaugcccccggaucacugaagcggaaccagaugauguugauugcuggugcaaugccacagacacaugggugaccuaugggacguguucucagacuggcgaacaccgacgggauagacguucugucgcauuggccccacacguggggcuuggucucgaaacaagaaccgaaacguggauguccucugaaggcgccuggaggcagauacaaagaguggagacuugggccuugagacacccaggauucacggugauagcccuuuuuuuagcacaugccauaggaacauccauuacccagaaagggaucaucuucauuuugcugaugcuggugacaccaucaauggccaugcgaugcgugggaauaggcaacagagacuucguugaaggacugucaggagcaacauggguggaugugguacuggagcauggaagcugugucaccaccauggcaaagaauaaaccaacauuggacauugaacucuugaagacggaggucacgaacccugccgucuugcgcaaacugugcauugaagcuaaaauaucaaacaccaccaccgauucaagauguccaacacaaggagaagcuacacugguggaagaacaagacgcgaacuuugugugucgacgaacauucguggacagaggcugggguaaugguuguggacuauucgggaagggaagcuuacuaacgugugcuaaguuuaagugugugacaaaacuugaaggaaagauaguucaauaugaaaacuuaaaauauucggugauagucacuguccacacuggggaccagcaccagguaggaaaugagacuacagaacauggaacaauugcaaccauaacaccucaagcucccacgucggaaauacagcugacugacuacggagcccuuacauuggacugcucaccuagaacagggcuggacuuuaaugagauggugcuguugacaaugaaagaaaaaucauggcuuguccacaaacaaugguuucuagacuuaccauugccuuggaccucgggggcuucaacaucucaagagacuuggaacagacaagaucugcuggucacauuuaagacagcucaugcaaagaagcaggaaguagucguacuggggucacaagaaggagcaaugcacacugcguugacuggggcgacagaaauccagacgucaggaacgacgacaaucuucgcaggacaccugaaauguagacuaaaaauggauaaacugacuuuaaaaggggugucauaugugaugugcacaggcucauuuaagcuagagaaggaaguggcugagacccagcauggaacuguccuagugcagguuaaauaugaaggaacagaugcaccaugcaagauuccaauuucaacccaagaugagaaaggagugacccagaaugggagauugauaacagccaaucccauaguuacugacaaagaaaaaccagucaacauugaaacagaaccacccuuuggugagagcuacaucgugauaggggcgggugaaaaagcuuugaaacuaagcugguucaagaaaggaagcagcauagggaaaauguucgaagccaccgcccgaggagcacgaaggauggcuauccugggagacacagcaugggacuucgguuccauaggagggguguucacaucugugggaaaauugguacaccagguuuuuggaaccgcauaugggguccuguucagcgguguuucuuggaccaugaaaauaggaauagggauucugcugacauggcuaggauugaauucaaggagcacgucacucucgaugacgugcauugcaguuggcauggucacacuguaccuaggagucaugguucaagcggacucggggugugugaucaacuggaagggcagagaacucaaguguggaaguggcaucuuugucacuaaugaaguccacacuuggacagagcaauacaaauuucaggcugacuccccaaaaagacuaucagcagccauugggaaggcaugggaggaaggcguguguggaauucgaucagccacacgucuugagaacaucauguggaagcaaauaucaaaugaauugaaccacauucuacuugaaaaugacaugaaauucacagugguuguaggagacgccaauggaaucuugacccaaggaaaaaagaugauuaggccacaacccauggaacacaaauacucauggaaaagcuggggaaaagccaaaaucauaggagcagauacacagaauacuaccuucaucaucgauggcccagacacuccagaaugccccgaugaccagagagcauggaacauuugggaaguugaggacuauggguuuggaguuuucacgacaaacauauggcugaaauugcgugacuccuacacccaacugugugaccaccggcuaaugucagcugccaucaaggacagcaaggcaguccaugcugauaugggguacuggauagaaagugaaaagaacgagaccuggaagcuagcgagagccuccuucauagaagugaagacaugcaucuggccaagaucccacacucuauggagcaauggagucuuggaaagugaaaugauaaucccaaagauauauggaggaccaauaucucagcacaacuacagaccaggguauuucacacaaacagcagggccauggcaccuaggcaaguuggaacuagacuuuaauuugugugaaggcaccacaguuguuguggaugaacauuguggaaaucgagguccaucucuuagaacuacaacagucacaggaaagauaauccaugaauggugcugcagauccugcacgcuaccccccuuacgcuucagaggagaagacggauguugguauggcauggaaaucagaccaguuaaggagaaggaagagaaucuagucaggucaauggucucugcagggucaggagaaguggacaguuuuucauugggacuacuaugcguaucaauaaugauugaagaagugaugagauccagauggaguagaaagaugcugaugacuggaacacuggcuauuuucuuccuucuuauaaugggacaacugacauggaaugaucugaucagguuaugcaucaugguuggagccaaugucucagacagaauggggaugggaacaacguaccuagcuuuaauggccacuuuuaaaaugagaccgauguucgcuguugggcuauuauuucgcagacuaacauccagagaggugcuccuucucacaauuggauuaagccugguggcauccguggagcuaccaaauucuuuagaggagcuaggggacggacuugcgaugggcaucaugauguuaaaauuguugacugauuuucagucacaccaguuguggacuaccuuacugucucugacauucaucaaaacaacucuuucacuggauuaugcauggaagacaauggcuaugguauugucaaucguaucucucuuuccucuaugucuauccacgaccucucaaaaaacaacauggcuuccgguguuguuaggauccuuuggauguaaaccacuaaccauguuucuuauaacagaaaacaaaauuuggggaaggaaaaguuggccccucaaugaaggaauuauggcuguuggaauagucagcauuuuacuaaguucacuccucaaaaaugacgugccacuagccggcccacuaauagcuggaggcaugcugauagcauguuacgucauuuccggaagcucagccgauuuaucauuggagagagcggcugaggucuccugggaagaagaagcagaacacucuggugccucacacaacauacuaguggagguccaagaugauggaacuaugaaaauaaaagaugaagagagagaugacacgcucacuauacuccucaaagcaacuuuguuggcaguuucagggguguacccaaugucaauaccagcaacccuuuuugugugguauuuuuggcagaaaaagaaacagagaucaggagucuugugggacacacccagcccuccagaaguagaaagagcaguucuugaugaugguaucuauagaaucuugcaaagaggacuguuggguaggucccagguaggagugggaguuuuucaagacggcguguuccacacaauguggcaugucaccaggggggcuguccucauguaccaagggaagaggcuggaaccaaguugggccagugucaaaaaagacuugaucucauauggaggagguuggagguuucaaggaucauggaacacgggagaagaaguacaggugauagcuguugaaccagggaaaaacccaaagaauguacagacaacgccgggcaccuucaagaccccugaaggcgaaguuggagccauagcccuagauuucaaaccuggcacaucuggaucucccaucgugaacagagaggggaaaauaguaggucuuuauggaaauggaguggugacaacaaguggaaccuacgucagugccauugcccaagcuaaagcgucacaagaagggccucuaccagagauugaggacgagguguuuaagaaaagaaaccuaacaauaauggaccuacauccaggaucagggaaaacaagaagauaucuuccagccauaguccgugaggccauaaaaaggaaacugcgcacgcuaaucuuggcucccacaagaguugucgccucugaaauggcagaggcgcuuaaaggaaugccaauaagauaucagacaacagcaguaaagagugaacacacaggaaaggagauagucgaucucaugugccacgccacuuucaccaugcgucuccuaucuccagugagaguucccaauuacaacaugauuaucauggaugaagcacacuuuaccgauccagccagcauagcggccagaggguacaucucaacccgaguggguaugggugaagcagcugcgaucuuuaugacagccacucccccaggaucgguagaggccuuuccacagagcaaugcaguuauccaagaugaggaaagagacauuccugagagaucauggaacucaggcuacgacuggaucacugauuucccaggaaaaacagucugguuuguuccaagcaucaaaucaggaaaugacauugccaacugcuuaagaaaaaacgggaaacgggugauccaauugagcagaaaaaccuuugacacugaauaccagaaaacgaaaaacaaugauugggacuauguugucacaacagacauuuccgaaaugggagcaaauuuccgggccgauaggguaauagacccaaggcggugcuugaagccgguaauacuaaaagauggcccagagcgcgucauucuggccggaccaaugccagugaccgcggccagugcugcccagaggagaggaagaauuggaaggaaccaaaacaaggaaggugaccaguauauuuacaugggacagccuuuaaauaaugaugaggaccacgcucauuggacagaagcaaaaaugcuccuugacaauauaaauacgccagaagggauuaucccagcccucuuugagccagagagagaaaagagugcagcaauagacggggaguauagacugcggggagaagcaaggaaaacguucguggagcuaaugagaagaggggaucuaccaguuuggcuaucuuacaaaguugccucagaaggcuuccaguacuccgacagaagauggugcuuugacggggaaaggaacaaccagguguuggaggagaacauggacguggagaucuggacaaaagaaggagaaagaaagaaauugcgaccucgcugguuagaugccagaaccuacucugauccacuggcccugcgcgaguuuaaagaguucgcagcaggaagaagaagugucucaggugaccuaauauuagaaauagggaaacucccacagcauuugacgcuaagggcccagaaugcuuuggacaacuuggucauguugcacaauuccgaacaagggggaaaagccuauagacaugcuauggaagaacuaccagacaccauagaaacauugaugcuacuagccuugauagcugugcugacugguggaguuacguuguuuuuccuaucaggaaaaggucuagggaaaacauccauuggccuacuuuguguaauggccucaaguguacuguuauggauggccaguguggagccccauuggauagcggccuccaucauacuagaguuuuuucugauggugcugcuuauuccagagccagacagacagcguacuccacaggacaaucaacuagcauauguggugauagguuuguuauucaugauauugacaguggcagccaaugagaugggauuacuggaaaccacaaagaaagaccuggggauuggccauguagucgccgaaaaccaccaccaugccacaaugcuagacauagacuuacauccagcuucagccuggacccucuaugcaguagccacaacaauuaucacucccaugaugagacacacaauugaaaacacaacggcaaacauuucccugacagcuauugcaaaucaggcggcuauauuaaugggacuugacaagggauggccaauaucgaagauggacauaggagugccacuucucgccuuagggugcuauucccaggugaacccauugacacugacagcggcgguguuaauguuaguggcucauuaugccauaaucggaccuggacugcaagcaaaagcuaccagagaagcccaaaaaaggacugcggccggaauaaugaaaaauccaacuguagacgggauuguugcaauagauuuggauccugugguuuaugaugcaaaauuugaaaaacagcuaggccaaauaauguuacuaauacucugcacaucacagauucucuugaugcggacuacaugggccuuaugugaaucuaucacacuggcuacuggacccuugaccacucucugggagggaucuccuggaaaauucuggaacaccacgauagcaguguccauggcaaacaucuucaggggaaguuauuuagcaggggcaggucuggccuucucauuaaugaaaucuuuaggaggagguaggagagguacgggagcucaaggggaaacauugggagaaaaauggaaaagacaacuaaaccaacugagcaagucagaauuuaacacuuacaaaaggaguggaauuauggagguggacagauccgaagccaaggagggacugaaaagaggagaaacaaccaaacaugcagugucgagaggaacagccaaacuuaggugguuuguggagaggaaccuugugaaaccggaagggaaagugauagaccucgguuguggaagagguggcuggucauauuacugcgcugggcugaagaaggucacagaaguaaagggauacacaaaaggaggacccggucaugaggaaccuaucccaauggcgacuuauggauggaacauagugaagcuacacucuggaagggauguauucuuuacaccaccugagaaaugugacacccuuuugugugauauuggugaguccucuccgaauccaacuauagaagaaggaagaacguuacguguucuaaagaugguggaaccauggcucagaggaaaucaguuuugcauaaaaauccuaaauccuuauaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaaugcugcugaaucgguucacaauggcucacaggaagccaacguaugaaagagacguggacuugggcgcuggaacaagacauguggcaguggaaccagagauagccaaccuagacauuauuggccagaggauagagaacauaaaaaaugaacauaagucaacauggcauuaugaugaggacaauccauacaaaacaugggccuaucauggaucauaugaggucaagccaucagggucagccucauccauggugaauggcguggugagauugcucaccaagccaugggauguuauccccauggucacacaaauagcuaugacugauaccacacccuucggacaacagaggguuuucaaagagaaaguugacacacgcacaccaagaccaaaacgaggcacagcacaaauuauggaggugacagccaagugguuguggggauuccucucuagaaauaaaaaacccagaaucugcacaagagaggaguucacaagaaaaguuaggucaaacgcagcaauuggagcaguguuuguugaugaaaaccaauggaacucagcaaaagaagcaguggaagacgaaagguuuugggaccucgugcacagagagagggagcuucauaaacagggaaaaugugccacgugugucuacaauaugauggguaaaagagagaaaaaacuaggagaguuuggaaaggcaaaaggaagucgugcaauaugguacaugugguugggagcacgcuuucuagaauuugaagcccuuggcuucaugaaugaagaccacugguucaguagggagaauucacucaguggaguggaaggagaaggacuacauaaacuuggauacauacucagagacauaucaaagauuccagggggaaauauguaugcagacgacacagcuggaugggacacaagaauaacagaggaugaucuucagaaugaggcuaaaaucaccgacaucauggagccugaacaugcucuacuggcuacgucaaucuucaagcugaccuaucaaaauaaggugguaagggugcaaagaccagcaaaaaguggaaccgugauggacgucauauccagacgugaccagagaggaaguggacaggucggaacuuauggccuaaacacuuucaccaacauggagguccaacuaauaagacaaauggaaucugaaggaaucuuuucacccagcgaauuggaaaauucaaaucuagcugagagaguucucgacugguuggaaaaacauggcgucgaaagguugaaaagaauggcaaucagcggagaugacuguguggugaaaccaacugaugacagguucgcaacagcuuuaacagcccugaaugacaugggaaaggugagaaaagacauaccgcaaugggaaccuucaaaaggauggaaugacuggcagcaagugccuuucuguucacaccacuuccaccaacugauuaugaaggaugggagggagauaguggugccaugccgcaaccaagaugaacuugugggcagggccagaguaucacaaggcgccggguggagccugagagaaacugcuugccuaggcaagucauaugcacaaauguggcagcugauguacuuccacaggagagaccugagacuggcggcuaaugcuaucuguucagccguuccaguuaauugggucccaaccagccgcaccaccuggucgauccaugcccaccaucaauggaugacaacagaagacauguugucaguauggaauaggguuuggauagaggaaaacccauggauggaggacaaaacucauguauccagcugggaagauguuccauacuuaggaaaaagggaagaucaaugguguggaucucugauaggcuuaacagcaagagccaccugggccaccaacauacaaguggccauaaaccaagugagaaggcuuauugggaacgagaauuauuuagacuacaugacaucaaugaagagauucaagaaugagagugaucccgaaggagcccucugguaa

SEQ ID NO: 6300 - RNA, 9879 nt, Artificial Sequence
  derived and/or modified CDS sequence (wt) from DENV-1__KM403597__SS-prME
uccgugaccaugcuccucaugcugcugcccacagcccuggcauuccauuugaccacacgagggggagagccacacaugauaguuagcaagcaggaaagaggaaagucacucuuguuuaagaccucugcaggugucaacaugugcacccucauugcaauggauuugggagaguuaugugaggauacaaugaccuacaaaugcccccggaucacugaagcggaaccagaugauguugauugcuggugcaaugccacagacacaugggugaccuaugggacguguucucagacuggcgaacaccgacgggauagacguucugucgcauuggccccacacguggggcuuggucucgaaacaagaaccgaaacguggauguccucugaaggcgccuggaggcagauacaaagaguggagacuugggccuugagacacccaggauucacggugauagcccuuuuuuuagcacaugccauaggaacauccauuacccagaaagggaucaucuucauuuugcugaugcuggugacaccaucaauggccaugcgaugcgugggaauaggcaacagagacuucguugaaggacugucaggagcaacauggguggaugugguacuggagcauggaagcugugucaccaccauggcaaagaauaaaccaacauuggacauugaacucuugaagacggaggucacgaacccugccgucuugcgcaaacugugcauugaagccaaaauaucaaacaccaccaccgauucaagauguccaacacaaggagaagcuacacugguggaagaacaagacgcgaacuuugugugucgacgaacauucguggacagaggcugggguaaugguuguggacuauucgggaagggaagcuuacuaacgugugcuaaguuuaagugugugacaaaacuugaaggaaagauaguucaauaugaaaacuuaaaauauucggugauagucacuguccacacuggggaccagcaccagguaggaaaugagacuacagaacauggaacaauugcaaccauaacaccucaagcucccacgucggaaauacagcugacugacuacggagcccuuacauuggacugcucaccuagaacagggcuggacuuuaaugagauggugcuguugacaaugaaagaaaaaucauggcuuguccacaaacaaugguuucuagacuuaccauugccuuggaccucgggggcuucaacaucucaagagacuuggaacagacaagaucugcuggucacauuuaagacagcucaugcaaagaagcaggaaguagucguacuggggucacaagaaggagcaaugcacacugcguugacuggggcgacagaaauccagacgucaggaacgacgacaaucuucgcaggacaccugaaauguagacuaaaaauggauaaacugacuuuaaaaggggugucauaugugaugugcacaggcucauuuaagcuagagaaggaaguggcugagacccagcauggaacuguccuagugcagguuaaauaugaaggaacagaugcaccaugcaagauuccaauuucaacccaagaugagaaaggagugacccagaaugggagauugauaacagccaaucccauaguuacugacaaagaaaaaccagucaacauugaaacagaaccacccuuuggugagagcuacaucgugauaggggcgggugaaaaagcuuugaaacuaagcugguucaagaaaggaagcagcauagggaaaauguucgaagccaccgcccgaggagcacgaaggauggcuauccugggagacacagcaugggacuucgguuccauaggagggguguucacaucugugggaaaauugguacaccagguuuuuggaaccgcauaugggguccuguucagcgguguuucuuggaccaugaaaauaggaauagggauucugcugacauggcuaggauugaauucaaggagcacgucacucucgaugacgugcauugcaguuggcauggucacacuguaccuaggagucaugguucaagcggacucggggugugugaucaacuggaagggcagagaacucaaguguggaaguggcaucuuugucacuaaugaaguccacacuuggacagagcaauacaaauuucaggcugacuccccaaaaagacuaucagcagccauugggaaggcaugggaggaaggcguguguggaauucgaucagccacacgucuugagaacaucauguggaagcaaauaucaaaugaauugaaccacauucuacuugaaaaugacaugaaauucacagugguuguaggagacgccaauggaaucuugacccaaggaaaaaagaugauuaggccacaacccauggaacacaaauacucauggaaaagcuggggaaaagccaaaaucauaggagcagauacacagaauacuaccuucaucaucgauggcccagacacuccagaaugccccgaugaccagagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaacgagaccuggaagcuagcgagagccuccuucauagaagugaagacaugcaucuggccaagaucccacacucuauggagcaauggagucuuggaaagugaaaugauaaucccaaagauauauggaggaccaauaucucagcacaacuacagaccaggguauuucacacaaacagcagggccauggcaccuaggcaaguuggaacuagacuuuaauuugugugaaggcaccacaguuguuguggaugaacauuguggaaaucgagguccaucucuuagaacuacaacagucacaggaaagauaauccaugaauggugcugcagauccugcacgcuaccccccuuacgcuucagaggagaagacggauguugguauggcauggaaaucagaccaguuaaggagaaggaagagaaucuagucaggucaauggucucugcagggucaggagaaguggacaguuuuucauugggacuacuaugcguaucaauaaugauugaagaagugaugagauccagauggaguagaaagaugcugaugacuggaacacuggcuauuuucuuccuucuuauaaugggacaacugacauggaaugaucugaucagguuaugcaucaugguuggagccaaugucucagacagaaugggaaugggaacaacguaccuagcuuuaauggccacuuuuaaaaugagaccgauguucgcuguugggcuauuauuucgcagacuaacauccagagaggugcuccuucucacaauuggauuaagccugguggcauccguggagcuaccaaauucuuuagaggagcuaggggacggacuugcgaugggcaucaugauguuaaaauuguugacugauuuucagucacaccaguuguggacuaccuuacugucucugacauucaucaaaacaacucuuucacuggauuaugcauggaagacaauggcuaugguauugucaaucguaucucucuuuccucuaugucuauccacgaccucucaaaaaacaacauggcuuccgguguuguuaggauccuuuggauguaaaccacuaaccauguuucuuauaacagaaaacaaaauuuggggaaggaaaaguuggccccucaaugaaggaauuauggcuguuggaauagucagcauuuuacuaaguucacuccucaaaaaugacgugccacuagccggcccacuaauagcuggaggcaugcugauagcauguuacgucauuuccggaagcucagccgauuuaucauuggagagagcggcugaggucuccugggaagaagaagcagaacacucuggugccucacacaacauacuaguggagguccaagaugauggaacuaugaaaauaaaagaugaagagagagaugacacgcucacuauacuccucaaagcaacuuuguuggcaguuucagggguguacccaaugucaauaccagcaacccuuuuugugugguauuuuuggcagaaaaagaaacagagaucaggagucuugugggacacacccagcccuccagaaguagaaagagcaguucuugaugaugguaucuauagaaucuugcaaagaggacuguuggguaggucccagguaggagugggaguuuuucaagacggcguguuccacacaauguggcaugucaccaggggggcuguccucauguaccaagggaagaggcuggaaccaaguugggccagugucaaaaaagacuugaucucauauggaggagguuggagguuucaaggaucauggaacacgggagaagaaguacaggugauagcuguugaaccagggaaaaacccaaagaauguacagacaacgccgggcaccuucaagaccccugaaggcgaaguuggagccauagcccuagauuucaaaccuggcacaucuggaucucccaucgugaacagagaggggaaaauaguaggucuuuauggaaauggaguggugacaacaaguggaaccuacgucagugccauugcccaagcuaaagcgucacaagaagggccucuaccagagauugaggacgagguguuuaagaaaagaaaccuaacaauaauggaccuacauccaggaucagggaaaacaagaagauaucuuccagccauaguccgugaggccauaaaaaggaaacugcgcacgcuaaucuuggcucccacaagaguugucgccucugaaauggcagaggcgcuuaaaggaaugccaauaagauaucagacaacagcaguaaagagugaacacacaggaaaggagauagucgaucucauaugccacgccacuuucaccaugcgucuccuaucuccagugagaguucccaauuacaacaugauuaucauggaugaagcacacuuuaccgauccagccagcauagcggccagaggguacaucucaacccgaguggguaugggugaagcagcugcgaucuuuaugacagccacucccccaggaucgguagaggccuuuccacagagcaaugcaguuauccaagaugaggaaagagacauuccugagagaucauggaacucaggcuacgacuggaucacugauuucccaggaaaaacagucugguuuguuccaagcaucaaaucaggaaaugacauugccaacugcuuaagaaaaaacgggaaacgggugauccaauugagcagaaaaaccuuugacacugaauaccagaaaacgaaaaacaaugauugggacuauguugucacaacagacauuuccgaaaugggagcaaauuuccgggccgauaggguaauagacccaaggcggugcuugaagccgguaauacuaaaagauggcccagagcgcgucauucuggccggaccaaugccagugaccgcggccagugcugcccagaggagaggaagaauuggaaggaaccaaaacaaggaaggugaccaguauauuuacaugggacagccuuuaaauaaugaugaggaccacgcucauuggacagaagcaaaaaugcuccuugacaauauaaauacgccagaagggauuaucccagcccucuuugagccagagagagaaaagagugcagcaauagacggggaguauagacugcggggagaagcaaggaaaacguucguggagcuaaugagaagaggggaucuaccaguuuggcuaucuuacaaaguugccucagaaggcuuccaguacuccgacagaagauggugcuuugacggggaaaggaacaaccagguguuggaggagaacauggacguggagaucuggacaaaagaaggagaaagaaagaaauugcgaccucgcugguuagaugccagaaccuacucugauccacuggcccugcgcgaguuuaaagaguucgcagcaggaagaagaagugucucaggugaccuaauauuagaaauagggaaacucccacagcauuugacgcuaagggcccagaaugcuuuggacaacuuggucauguugcacaauuccgaacaagggggaaaagccuauagacaugcuauggaagaacuaccagacaccauagaaacauugaugcuacuagccuugauagcugugcugacugguggaguuacguuguuuuuccuaucaggaaaaggucuagggaaaacauccauuggccuacuuuguguaauggccucaaguguacuguuauggauggccaguguggagccccauuggauagcggccuccaucauacuagaguuuuuucugauggugcugcuuauuccagagccagacagacagcguacuccacaggacaaucaacuagcauauguggugauagguuuguuauucaugauauugacaguggcagccaaugagaugggauuacuggaaaccacaaagaaagaccuggggauuggccauguagucgccgaaaaccaccaccaugccacaaugcuagacauagacuuacauccagcuucagccuggacccucuaugcaguagccacaacaauuaucacucccaugaugagacacacaauugaaaacacaacggcaaacauuucccugacagcuauugcaaaucaggcggcuauauuaaugggacuugacaagggauggccaauaucgaagauggacauaggagugccacuucucgccuuagggugcuauucccaggugaacccauugacacugacagcggcgguguuaauguuaguggcucauuaugccauaaucggaccuggacugcaagcaaaagcuaccagagaagcccaaaaaaggacugcggccggaauaaugaaaaauccaacuguagacgggauuguugcaauagauuuggauccugugguuuaugaugcaaaauuugaaaaacagcuaggccaaauaauguuacuaauacucugcacaucacagauucucuugaugcggacuacaugggccuuaugugaaucuaucacacuggcuacuggacccuugaccacucucugggagggaucuccuggaaaauucuggaauaccacgauagcaguguccauggcaaacaucuucaggggaaguuauuuagcaggggcaggucuggccuucucauuaaugaaaucuuuaggaggagguaggagagguacgggagcucaaggggaaacauugggagaaaaauggaaaagacaacuaaaccaacugagcaagucagaauuuaacacuuacaaaaggaguggaauuauggagguggacagauccgaagccaaggagggacugaaaagaggagaaacaaccaaacaugcagugucgagaggaacagccaaacuuaggugguuuguggagaggaaccuugugaaaccggaagggaaagugauagaccucgguuguggaagagguggcuggucauauuacugcgcugggcugaagaaggucacagaaguaaagggauacacaaaaggaggacccggucaugaggaaccuaucccaauggcgacuuauggauggaacauagugaagcuacacucuggaagggauguauucuuuacaccaccugagaaaugugacacccuuuugugugauauuggugaguccucuccgaauccaacuauagaagaaggaagaacguuacguguucuaaagaugguggaaccauggcucagaggaaaucaguuuugcauaaaaauccuaaauccuuauaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaaugcugcugaaucgguucacaauggcucacaggaagccaacguaugaaagagacguggacuugggcgcuggaacaagacauguggcaguggaaccagagauagccaaccuagacauuauuggccagaggauagagaacauaaaaaaugaacauaagucaacauggcauuaugaugaggacaauccauacaaaacaugggccuaucauggaucauaugaggucaagccaucagggucagccucauccauggugaauggcguggugagauugcucaccaagccaugggauguuauccccauggucacacaaauagcuaugacugauaccacacccuucggacaacagaggguuuucaaagagaaaguugacacacgcacaccaagaccaaaacgaggcacagcacaaauuauggaggugacagccaagugguuguggggauuccucucuagaaauaaaaaacccagaaucugcacaagagaggaguucacaagaaaaguuaggucaaacgcagcaauuggagcaguguuuguugaugaaaaccaauggaacucagcaaaagaagcaguggaagacgaaagguuuugggaccucgugcacagagagagggagcuucauaaacagggaaaaugugccacgugugucuacaauaugauggguaaaagagagaaaaaacuaggagaguuuggaaaggcaaaaggaagucgugcaauaugguacaugugguugggagcacgcuuucuagaauuugaagcccuuggcuucaugaaugaagaccacugguucaguagggagaauucacucaguggaguggaaggagaaggacuacauaaacuuggauacauacucagagacauaucaaagauuccagggggaaauauguaugcagacgacacagcuggaugggacacaagaauaacagaggaugaucuucagaaugaggcuaaaaucaccgacaucauggagccugaacaugcucuacuggcuacgucaaucuucaagcugaccuaucaaaauaaggugguaagggugcaaagaccagcaaaaaguggaaccgugauggacgucauauccagacgugaccagagaggaaguggacaggucggaacuuauggccuaaacacuuucaccaacauggagguccaacuaauaagacaaauggaaucugaaggaaucuuuucacccagcgaauuggaaaauucaaaucuagcugagagaguucucgacugguuggaaaaacauggcgucgaaagguugaaaagaauggcaaucagcggagaugacuguguggugaaaccaacugaugacagguucgcaacagcuuuaacagcccugaaugacaugggaaaggugagaaaagacauaccgcaaugggaaccuucaaaaggauggaaugacuggcagcaagugccuuucuguucacaccacuuccaccaacugauuaugaaggaugggagggagauaguggugccaugccgcaaccaagaugaacuugugggcagggccagaguaucacaaggcgccggguggagccugagagaaacugcuugccuaggcaagucauaugcacaaauguggcagcugauguacuuccacaggagagaccugagacuggcggcuaaugcuaucuguucagccguuccaguuaauugggucccaaccagccgcaccaccuggucgauccaugcccaccaucaauggaugacaacagaagacauguugucaguauggaauaggguuuggauagaggaaaacccauggauggaggacaaaacucauguauccagcugggaagauguuccauacuuaggaaaaagggaagaucaaugguguggaucucugauaggcuuaacagcaagagccaccugggccaccaacauacaaguggccauaaaccaagugagaaggcuuauugggaacgagaauuauuuagacuacaugacaucaaugaagagauucaagaaugagagugaucccgaaggagcccucugguaa

SEQ ID NO: 6301 - RNA, 9879 nt, Artificial Sequence
  derived and/or modified CDS sequence (wt) from DENV-1__KM403610__SS-prME
uccgugaccaugcuccucaugcugcugcccacagcccuggcguuccauuugaccacacgagggggagagccacacaugauaguuagcaagcaggaaagaggaaagucacucuuguuuaagaccucugcaggugucaacaugugcacccucauugcaauggauuugggagaguuaugugaggauacaaugaccuacaaaugcccccggaucacugaagcggaaccagaugauguugauugcuggugcaaugccacagacacaugggugaccuaugggacguguucucagacuggcgaacaccgacgggauaaacguucugucgcauuggccccacacguggggcuuggucucgaaacaagaaccgaaacguggauguccucugaaggcgccuggaggcagauacaaaaaguggagacuugggccuugagacacccaggauucacggugauagcccuuuuuuuagcacaugccauaggaacauccauuacccagaaagggaucaucuucauuuugcugaugcuggugacaccaucaauggccaugcgaugcgugggaauaggcaacagagacuucguugaaggacugucaggagcaacauggguggaugugguauuggagcauggaagcugugucaccaccauggcaaagaauaaaccaacauuggacauugaacucuugaagacggaggucacgaacccugccgucuugcgcaaacugugcauugaagcuaaaauaucaaacaccaccaccgauucaagauguccaacacaaggagaagcuacacugguggaagaacaagacgcgaacuuugugugucgacgaacauucguggacagaggcugggguaaugguuguggacuauucgggaagggaagcuuacuaacgugugcuaaguuuaagugugugacaaaacuugaaggaaagauaguucaauaugaaaacuuaaaauauucggugauagucacuauccacacuggggaccagcaccagguaggaaaugagacuacagaacauggaacaauugcaaccauaacaccucaagcucccacgucggaaauacagcugacugacuacggagcccuuacacuggacugcucaccuagaacagggcuggacuuuaaugagauggugcuguugacaaugaaagaaaaaucauggcuuguccacaaacaaugguuucuagacuuaccauugccuuggaccucgggggcuucaacaucucaagagacuuggaacagacaagaucugcuggucacauuuaagacagcucaugcaaagaagcaggaaguagucguacuggggucacaagaaggagcaaugcacacugcguugacuggggcgacagaaauccagacgucaggaacgacaacaaucuucgcaggacaccugaaauguagacuaaaaauggauaaacugacuuuaaaaggggugucauaugugaugugcacaggcucauuuaagcuagagaaggaaguggcugagacccagcauggaacuguccuagugcagguuaaauaugaaggaacagaugcaccaugcaagauuccaauuucaacccaagaugagaaaggagugacccagaaugggagauugauaacagccaaucccauaguuacugacaaagaaaaaccagucaacauugaaacagaaccacccuuuggugagagcuacaucgugauaggggcgggugaaaaagcuuugaaacuaagcugguucaagaaaggaagcagcauagggaaaauguucgaagccaccgcccgaggagcacgaaggauggcuauccugggagacacagcaugggacuucgguuccauaggagggguguucacaucugugggaaaauugguacaccagguuuuuggaaccgcauaugggguccuguucagugguguuucuuggaccaugaaaauaggaauagggauucugcugacauggcuaggauugaauucaaggagcacgucacucucgaugacgugcauugcaguuggcauggucacacuguaccuaggagucaugguucaagcggacucggggugugugaucaacuggaagggcagagaacucaaguguggaaguggcaucuuugucacuaaugaaguccacacuuggacagagcaauacaaauuucaggcugacuccccaaaaagacuaucagcagccauugggaaggcaugggaggaaggcguguguggaauucgaucagccacacgucuugagaacaucauguggaagcaaauaucaagugaauugaaccacauucuacuugaaaaugacaugaaauucacagugguuguaggagacgccaauggaaucuugacccaaggaaaaaagaugauuaggccacaacccauggaacacaaauacucauggaaaagcuggggaaaagccaaaaucauaggagcagauacacagaauacuaccuucaucaucgauggcccagacacuccagaaugccccgaugaccagagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaacgagaccuggaagcuagcgagagccuccuucauagaagugaagacaugcaucuggccaagaucccacacucuauggagcaauggagucuuggaaagugaaaugauaaucccaaagauauauggaggaccaauaucucagcacaacuacagaccaggguauuucacacaaacagcagggccauggcaccuaggcaaguuggaacuagacuuuaauuugugugaaggcaccacaguuguuguggaugaacauuguggaaaucgagguccaucucuuagaacuacaacagucacaggaaagauaauccaugaauggugcugcagauccugcacgcuaccccccuuacgcuucagaggagaagacggauguugguauggcauggaaaucagaccaguuaaggagaaggaagagaaucuagucaggucaauggucucugcagggucaggagaaguggacaguuuuucauugggacuacuaugcguaucaauaaugauugaagaagugaugagauccagauggaguaaaaagaugcugaugacuggaacacuggcuguuuucuuccuucuuauaaugggacaacugacauggaaugaucugaucagguuaugcaucaugguuggagccaaugucucagacagaauggggaugggaacaacguaccuagcuuuaauggccacuuuuaaaaugagaccgauguucgcuguugggcuauuauuucgcagacuaacauccagagaggugcuccuucucacaauuggacuaagccugguggcauccguggagcuaccaaauucuuuagaggagcuaggggacggacuugcgaugggcaucaugauguuaaaauuguugacugauuuucagucacaccaguuguggacuaccuuacugucucugacauucaucaaaacaacucuuucacuggauuaugcauggaagacaauggcuaugguauugucaaucguaucucucuuuccucuaugucuauccacgaccucucaaaaaacaacauggcuuccgguguuguuaggauccuuuggauguaaaccacuaaccauguuucuuauaacagaaaacaaaauuuggggaaggaaaaguuggccccucaaugaaggaauuauggcuguuggaauagucagcauuuuacuaaguucacuccucaaaaaugacgugccacuagccggcccacuaauagcuggaggcaugcugauagcauguuacgucauuuccggaagcucagccgauuuaucauuggagagagcggcugaggucuccugggaagaagaagcagaacacucuggugccucacacaacauacuaguggagguccaagaugauggaacuaugaaaauaaaagaugaagagagagaugacacgcucacuauacuccucaaagcaacuuuguuggcaguuucagggguguacccaaugucaauaccagcaacccuuuuugugugguauuuuuggcagaaaaagaaacagagaucaggagucuugugggacacacccagcccuccagaaguagaaagagcaguucuugaugaugguaucuauagaaucuugcaaagaggacuguuggguaggucccagguaggagugggaguuuuucaagacggcguguuccacacaauguggcaugucaccaggggggcuguccucauguaccaagggaagaggcuggaaccaaguugggccagugucaaaaaagacuugaucucauauggaggagguuggagguuucaaggaucauggaacacgggagaagaaguacaggugauagcuguugaaccagggaaaaacccaaagaauguacagacaacgccgggcaccuucaagaccccugaaggcgaaguuggagccauagcccuagauuucaaaccuggcacaucuggaucucccaucgugaacagagaggggaaaauaguaggucuuuauggaaauggaguggugacaacaaguggaaccuacgucagugccauugcccaagcuaaagcgucacaagaagggccucuaccagagauugaggacgagguguuuaagaaaagaaaccuaacaauaauggaccuacauccaggaucaggaaaaacaagaagauaucuuccagccauaguccgugaggccauaaaaaggaaacugcgcacgcuaaucuuagcucccacaagaguugucgccucugaaauggcagaggcgcuuaaaggaaugccaauaagauaucagacaacagcaguaaagagugaacacacaggaaaggagauagucgaucucaugugccacgccacuuucaccaugcgucuccuaucuccagugagaguucccaauuacaacaugauuaucauggaugaagcacacuuuaccgauccagccagcauagcggccagaggguacaucucaacccgaguggguaugggugaagcagcugcgaucuuuaugacagccacucccccaggaucgguagaggccuuuccacagagcaaugcaguuauccaagaugaggaaagagacauuccugagagaucauggaacucaggcuacgacuggaucacugacuucccaggaaaaacagucugguuuguuccaagcaucaaaucaggaaaugacauugccaacugcuuaagaaaaaacgggaaacgggugauccaauugagcagaaaaaccuuugacacugaauaccagaaaacgaaaaacaaugauugggacuauguugucacaacagacauuuccgaaaugggagcaaauuuccgggccgauaggguaauagacccaaggcggugcuugaagccgguaauacuaaaagauggcccagagcgcgucauucuggccggaccaaugccagugaccgcggccagugcugcccagaggagaggaagaauuggaaggaaccaaaacaaggaaggugaccaguauauuuacaugggacagccuuuaaauaaugaugaggaccacgcucauuggacagaagcaaaaaugcuccuugacaauauaaauacgccagaagggauuaucccagcccucuuugagccagagagagaaaagagugcagcaauagacggggaguauagacugcggggagaagcaaggaaaacguucguggagcuaaugagaagaggggaucuaccaguuuggcuaucuuacaaaguugccucagaaggcuuccaguacuccgacagaagauggugcuuugacggggaaaggaacaaccagguguuggaggagaacauggacguggagaucuggacaaaagaaggagaaagaaagaaauugcgaccucgcugguuagaugccagaaccuacucugauccacuggcccugcgcgaguuuaaagaguucgcagcaggaagaagaagugucucaggugaccuaauauuagaaauagggaaacucccacagcauuugacgcuaagggcccagaaugcuuuggacaacuuggucauguugcacaauuccgaacaagggggaaaagccuauagacaugcuauggaagaacuaccagacaccauagaaacauugaugcuacuagccuugauagcugugcugacugguggaguuacguuguuuuuccuaucaggaaaaggucuagggaaaacauccauuggccuacuuuguguaauggccucaaguguacuguuauggauggccaguguggagccccauuggauagcggccuccaucauacuagaguuuuuucugauggugcugcuuauuccagagccagacagacagcguacuccacaggacaaucaacuagcauauguggugauagguuuguuauucaugauauugacaguggcagccaaugagaugggauuacuggaaaccacaaagaaagaccuggggauuggccauguagucgccgaaaaccaccaccaugccacaaugcuagacauagacuuacauccagcuucagccuggacccucuaugcaguagccacaacaauuaucacucccaugaugagacacacaauugaaaacacaacggcaaacauuucccugacagcuauugcaaaucaggcggcuauauuaaugggacuugacaagggauggccaauaucgaagauggacauaggagugccacuucucgccuuagggugcuauucccaggugaacccauugacacugacagcggcgguguuaauguuaguggcucauuaugccauaaucggaccuggacugcaagcaaaagcuaccagagaagcccaaaaaaggacugcggccggaauaaugaaaaauccaacuguagacgggauuguugcaauagauuuggauccugugguuuaugaugcaaaauuugaaaaacagcuaggccaaauaauguuacuaauacucugcacaucacagauucucuugaugcggacuacaugggccuuaugugaaucuaucacacuggcuacuggacccuugaccacucucugggagggaucuccuggaaaauucuggaauaccacgauagcaguguccauggcaaacaucuucaggggaaguuauuuagcaggggcaggucuggccuucucauuaaugaaaucuuuaggaggagguaggagagguacgggagcucaaggggaaacauugggagaaaaauggaaaagacaacuaaaccaacugagcaagucagaauuuaacacuuacaaaaggaguggaauuauggagguggacagauccgaagccaaggagggacugaaaagaggagaaacaaccaaacaugcagugucgagaggaacagccaaacuuaggugguuuguggagaggaaccuugugaaaccagaagggaaagugauagaccucgguuguggaagagguggcuggucauauuacugcgcugggcugaagaaggucacagaaguaaagggauacacaaaaggaggacccggucaugaggaaccuaucccaauggcgacuuauggauggaacauagugaagcuacacucuggaagggauguauucuuuacaccaccugagaaaugugacacccuuuugugugauauuggugaguccucuccgaauccaacuauagaagaaggaagaacguuacguguucuaaagaugguggaaccauggcucagaggaaaucaguuuugcauaaaaauccuaaauccuuauaugccaagugugguagaaacucuggagcaaaugcaaagaaaacauggagggaugcuagugcgaaacccacucucaagaaauuccacccaugaaauguacugggucucauguggaacaggaaacauugugucggcagugaacaugacauccagaaugcugcugaaucgguucacaauggcucacaggaagccaacguaugaaagagacguggacuugggcgcuggaacaagacauguggcaguggaaccagagauagccaaccuagacauuauuggccagaggauagagaacauaaaaaaugaacauaagucaacauggcauuaugaugaggacaauccauacaaaacaugggccuaucauggaucauaugaggucaagccaucagggucagccucauccauggugaauggcguggugagauugcucaccaagccaugggauguuauccccauggucacacaaauagcuaugacugauaccacacccuucggacaacagaggguuuucaaagagaaaguugacacacgcacaccaagaccaaaacgaggcacagcacaaauuauggaggugacagccaagugguuguggggauuccucucuagaaauaaaaaacccagaaucugcacaagagaggaguucacaagaaaaguuaggucaaacgcagcaauuggagcaguguuuguugaugaaaaccaauggaacucagcaaaagaagcaguggaagacgaaagguuuugggaccucgugcacagagagagggagcuucauaaacagggaaaaugugccacgugugucuacaauaugauggguaaaagagagaaaaaacuaggagaguuuggaaaggcaaaaggaagucgugcaauaugguacaugugguugggagcacgcuuucuagaauuugaagcccuuggcuucaugaaugaagaccacugguucaguagggagaauucacucaguggaguggaaggagaaggacuacauaaacuuggauacauacucagagacauaucaaagauuccagggggaaauauguaugcagacgacacagcuggaugggacacaagaauaacagaggaugaucuucagaaugaggcuaaaaucaccgacaucauggagccugaacaugcucuacuggcuacgucaaucuucaagcugaccuaucaaaauaaggugguaagggugcaaagaccagcaaaaaguggaaccgugauggacgucauauccagacgugaccagagaggaaguggacaggucggaacuuauggccuaaacacuuucaccaacauggagguccaacuaauaagacaaauggaaucugaaggaaucuuuuuacccagcgaauuggaaaauucaaaucuagcugagagaguucucgacugguuggaaaaacauggcgucgaaagguugaaaagaauggcaaucagcggagaugacuguguggugaaaccaacugaugacagguucgcaacagcuuuaacagcccugaaugacaugggaaaggugagaaaagacauaccgcaaugggaaccuucaaaaggauggaaugacuggcagcaagugccuuucuguucacaccacuuccaccaacugauaaugaaggaugggagggagauaguggugccaugccgcaaccaagaugaacuugugggcagggccagaguaucacaaggcgccggguggagcuugagagaaacugcuugccuaggcaagucauaugcacaaauguggcagcugauguacuuccacaggagagaccugagacuggcggcuaaugcuaucuguucagccguuccaguuaauugggucccaaccagccgcaccaccuggucgauccaugcccaccaucaauggaugacaacagaagacauguugucaguauggaauaggguuuggauagaggaaaacccauggauggaggacaaaacucauguauccagcugggaagauguuccauacuuaggaaaaagggaagaucaaugguguggaucucugauaggcuuaacagcaagagccaccugggccaccaacauacaaguggccauaaaccaagugagaaggcuuauugggaacgagaauuauuuagacuacaugacaucaaugaagagauucaagaaugagagugaucccgaaggagcccucugguaa

SEQ ID NO: 6302 - RNA, 9879 nt, Artificial Sequence
  derived and/or modified CDS sequence (wt) from DENV-1__KM403596__SS-prME
uccgugaccaugcuccucaugcugcugcccacagcccuggcguuccauuugaccacacgagggggagagccacacaugauaguuagcaagcaggaaagaggaaagucacucuuguuuaagaccucugcaggugucaacaugugcacccucauugcaauggauuugggagaguuaugugaggauacaaugaccuacaaaugcccccggaucacugaagcggaaccagaugauguugauugcuggugcaaugccacagacacaugggugaccuaugggacguguucucagacuggcgaacaccgacgggauagacguucugucgcauuggccccacacguggggcuuggucucgaaacaagaaccgaaacguggauguccucugaaggcgccuggaggcagauacaaagaguggagacuugggccuugagacacccaggauucacggugauagcccuuuuuuuagcacaugccauaggaacauccauuacccagaaagggaucaucuucauuuugcugaugcuggugacaccaucaauggccaugcgaugcgugggaauaggcaacagagacuucguugaaggacugucaggagcaacauggguggaugugguacuggagcauggaagcugugucaccaccauggcaaagaauaaaccaacauuggacauugaacucuugaagacggaggucacgaacccugccgucuugcgcaaacugugcauugaagcuaaaauaucaaacaccaccaccgauucaagauguccaacacaaggagaagcuacacugguggaagaacaagacgcgaacuuugugugucgacgaacauucguggacagaggcugggguaaugguuguggacuauucgggaagggaagcuuacuaacgugugcuaaguuuaagugugugacaaaacuugaaggaaagauaguucaauaugaaaacuuaaaauauucggugauagucacuguccacacuggggaccagcaccagguaggaaaugagacuacagaacauggaacaauugcaaccauaacaccucaagcucccacgucggaaauacagcugacugacuacggagcccuuucauuggacugcucaccuagaacagggcuggacuuuaaugagauggugcuguugacaaugaaagaaaaaucauggcuuguccacaaacaaugguuucuagacuuaccauugccuuggaccucgggggcuucaacaucucaagagacuuggaacagacaagaucugcuggucacauuuaagacagcucaugcaaagaagcaggaaguagucguacuggggucacaagaaggagcaaugcacacugcguugacuggggcgacagaaauccagacgucaggaacgacgacaaucuucgcaggacaccugaaauguagacuaaaaauggauaaacugacuuuaaaaggggugucauaugugaugugcacaggcucauuuaagcuagagaaggaaguggcugagacccagcauggaacuguccuagugcagguuaaauaugaaggaacagaugcaccaugcaagauuccaauuucaacccaagaugagaaaggagugacccagaaugggagauugauaacagccaaucccauaguuacugacaaagaaaaaccagucaacauugaaauagaaccacccuuuggugagagcuacaucgugauaggggcgggugaaaaagcuuugaaacuaagcugguucaagaaaggaagcagcauagggaaaauguucgaagccaccgcccgaggagcacgaaggauggcuauccugggagacacagcaugggacuucgguuccauaggagggguguucacaucugugggaaaauugguacaccagguuuuuggaaccgcauaugggguccuguucagcgguguuucuuggaccaugaaaauaggaauagggauucugcugacauggcuaggauugaauucaaggagcacgucacucucgaugacgugcauugcaguuggcauggucacacuguaccuaggagucaugguucaagcggacucggggugugugaucaacuggaagggcagagaacucaaguguggaaguggcaucuuugucacuaaugaaguccacacuuggacagagcaauacaaauuucaggcugacuccccaaaaagacuaucagcagccauugggaaggcaugggaggaaggcguguguggaauucgaucagccacacgucuugagaacaucauguggaagcaaauaucaaaugaauugaaccacauucuacuugaaaaugacaugaaauucacagugguuguaggagacgccaauggaaucuugacccaaggaaaaaagaugauuaggccacaacccauggaacacaaauacucauggaaaagcuggggaaaagccaaaaucauaggagcagauacacagaauacuaccuucaucaucgauggcccagacacuccagaaugccccgaugaccagagagcauggaacauuugggaaguugaggacuauggguuuggaguuuucacgacaaacauauggcugaaauugcgugacuccuacacccaaaugugugaucaccggcuaaugucagcugccaucaaggacagcaaggcaguccaugcugacaugggguacuggauagaaagugaaaagaacgagaccuggaagcuagcgagagccuccuucauagaagugaagacaugcaucuggccaagaucccacacucuauggagcaauggagucuuggaaagugaaaugauaaucccaaagauauauggaggaccaauaucucagcacaacuacagaccaggguauuucacacaaacagcagggccauggcaccuaggcaaguuggaacuagacuuuaauuugugugaaggcaccacaguuguuguggaugaacauuguggaaaucgagguccaucucuuagaacuacaacagucacaggaaagauaauccaugaauggugcugcagauccugcacgcuaccccccuuacgcuucagaggagaagacggauguugguauggcauggaaaucagaccaguuaaggagaaggaagagaaucuagucaggucaauggucucugcagggucaggagaaguggacaguuuuucauugggacuacuaugcguaucaauaaugauugaagaagugaugagauccagauggaguagaaagaugcugaugacuggaacacuggcuauuuucuuccuucuuauaaugggacaacugacauggaaugaucugaucagguuaugcaucaugguuggagccaaugucucagacagaauggggaugggaacaacguaccuagcuuuaauggccacuuuuaaaaugagaccgauguucgcuguugggcuauuauuucgcagacuaacauccagagaggugcuccuucucacaauuggacuaagccugguggcauccguggagcuaccaaauucuuuagaggagcuaggggacggacuugcgaugggcaucaugauguuaaaauuguugacugauuuucagucacaccaguuguggacuaccuuacugucucugacauucaucaaaacaacucuuucacuggauuaugcauggaagacaauggcuaugguauugucaaucguaucucucuuuccucuaugucuauccacgaccucucaaaaaacaacauggcuuccgguguuguuaggauccuuuggauguaaaccacuaaccauguuucuuauaacagaaaacaaaauuuggggaaggaaaaguuggccccucaaugaaggaauuauggcuguuggaauagucagcauuuuacuaaguucacuccucaaaaaugacgugccacuagccggcccacuaauagcuggaggcaugcugauagcauguuacgucauuuccggaagcucagccgauuuaucauuggagagagcggcugaggucuccugggaagaagaagcagaacacucuggugccucacacaacauacuaguggagguccaagaugauggaacuaugaaaauaaaagaugaagagagagaugacacgcucacuauacuccucaaagcaacuuuguuggcaguuucagggguguacccaaugucaauaccagcaacccuuuuugugugguauuuuuggcagaaaaagaaacagagaucaggagucuugugggacacacccagcccuccagaaguagaaagagcaguucuugaugaugguaucuauagaaucuugcaaagaggacuguuggguaggucccagguaggagugggaguuuuucaagacggcguguuccacacaauguggcaugucaccaggggggcuguccucauguaccaagggaagaggcuggaaccaaguugggccagugucaaaaaagacuugaucucauauggaggagguuggagguuucaaggaucauggaacacgggagaagaaguacaggugauagcuguugaaccagggaaaaacccaaagaauguacagacaacgccgggcaccuucaagaccccugaaggcgaaguuggagccauagcccuagauuucaaaccuggcacaucuggaucucccaucgugaacagagaggggaaaauaguaggucuuuauggaaauggaguggugacaacaaguggaaccuacgucagugccauugcccaagcuaaagcgucacaagaagggccucuaccagagauugaggacgagguguuuaagaaaagaaaccuaacaauaauggaccuacauccaggaucaggaaaaacaagaagauaucuuccagccauaguccgugaggccauaaaaaggaaacugcgcacgcuaaucuuggcucccacaagaguugucgccucugaaauggcagaggcgcuuaaaggaaugccaauaagauaucagacaacagcaguaaagagugaacacacaggaaaggagauagucgaucucaugugccacgccacuuucaccaugcgucuccuaucuccagugagaguucccaauuacaacaugauuaucauggaugaagcacacuuuaccgauccagccagcauagcggccagaggguacaucucaacccgaguggguaugggugaagcagcugcgaucuuuaugacagccacucccccaggaucgguagaggccuuuccacagagcaaugcaguuauccaagaugaggaaagagacauuccugagagaucauggaacucaggcuacgacuggaucacugauuucccaggaaaaacagucugguuuguuccaagcaucaaaucaggaaaugacauugccaacugcuuaagaaaaaacgggaaacgggugauccaauugagcagaaaaaccuuugacacugaauaccagaaaacgaaaaacaaugauugggacuauguugucacaacagacauuuccgaaaugggagcaaauuuccgggccgauaggguaauagacccaaggcggugcuugaagccgguaauacuaaaagauggcccagagcgcgucauucuggccggaccaaugccagugaccgcggccagugcugcccagaggagaggaagaauuggaaggaaccaaaacaaggaaggugaccaguauauuuacaugggacagccuuuaaauaaugaugaggaccacgcucauuggacagaagcaaaaaugcuccuugacaauauaaauacgccagaagggauuaucccagcccucuuugagccagagagagaaaagagugcagcaauagacggggaguauagacugcggggagaagcaaggaaaacguucguggagcuaaugagaagaggggaucuaccaguuuggcuaucuuacaaaguugccucagaaggcuuccaguacuccgacagaagauggugcuuugacggggaaaggaacaaccagguguuggaggagaacauggacguggagaucuggacaaaagaaggagaaagaaagaaauugcgaccucgcugguuagaugccagaaccuacucugauccacuggcccugcgcgaguuuaaagaguucgcagcaggaagaagaagugucucaggugaccuaauauuagaaauagggaaacucccacagcauuugacgcuaagggcccagaaugcuuuggacaacuuggucauguugcacaauuccgaacaagggggaaaagccuauagacaugcuauggaagaacuaccagacaccauagaaacauugaugcuacuagccuugauagcugugcugacugguggaguuacguuguuuuuccuaucaggaaaaggucuagggaaaacauccauuggccuacuuuguguaauggccucaaguguacuguuauggauggccaguguggagccccauuggauagcggccuccaucauacuagaguuuuuucugauggugcugcuuauuccagagccagacagacagcguacuccacaggacaaucaacuagcauauguggugauagguuuguuauucaugauauugacaguggcagccaaugagaugggauuacuggaaaccacaaagaaagaccuggggauuggccauguagucgccgaaaaccaccaccaugccacaaugcuagacauagacuuacauccagcuucagccuggacccucuaugcaguagccacaacaauuaucacucccaugaugagacacacaauugaaaacacaacggcaaacauuucccugacagcuauugcaaaucaggcggcuauauuaaugggacuugacaagggauggccaauaucgaagauggacauaggagugccacuucucgccuuagggugcuauucccaggugaacccauugacacugacagcggcgguguuaauguuaguggcucauuaugccauaaucggaccuggacugcaagcaaaagcuaccagagaagcccaaaaaaggacugcggccggaauaaugaaaaauccaacuguagacgggauuguugcaauagauuuggauccugugguuuaugaugcaaaauuugaaaaacagcuaggccaaauaauguuacuaauacucugcacaucacagauucucuugaugcggacuacaugggccuuaugugaaucuaucacacuggcuacuggacccuugaccacucucugggagggaucuccuggaaaauucuggaauaccacgauagcaguguccauggcaaacaucuucaggggaaguuauuuagcaggggcaggucuggccuucucauuaaugaaaucuuuaggaggagguaggagagguacgggagcucaaggggaaacauugggagaaaaauggaaaagacaacuaaaccaacugagcaagucagaauuuaacacuuacaaaaggaguggaauuauggagguggacagauccgaagccaaggagggacugaaaagaggagaaacaaccaaacaugcagugucgagaggaacagccaaacuuaggugguuuguggagaggaaccuugugaaaccggaagggaaagugauagaccucgguuguggaagagguggcuggucauauuacugcgcugggcugaagaaggucacagaaguaaagggauacacaaaaggaggacccggucaugaggaaccuaucccaauggcgacuuauggauggaacauagugaagcuacacucuggaagggauguauucuuuacaccaccugagaaaugugacacccuuuugugugauauuggugaguccucuccgaauccaacuauagaagaaggaagaacguuacguguucuaaagaugguggaaccauggcucagaggaaaucaguuuugcauaaaaauccuaaauccuuauaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaaugcugcugaaucgguucacaauggcucacaggaagccaacguaugaaagagacguggacuugggcgcuggaacaagacauguggcaguggaaccagagacagccaaccuagacauuauuggccagaggauagagaacauaaaaaaugaacauaagucaacauggcauuaugaugaggacaauccauacaaaacaugggccuaucauggaucauaugaggucaagccaucagggucagccucauccauggugaauggcguggugagauugcucaccaagccaugggauguuauccccauggucacacaaauagcuaugacugauaccacacccuucggacaacagaggguuuucaaagagaaaguugacacacgcacaccaagaccaaaacgaggcacagcacaaauuauggaggugacagccaagugguuguggggauuccucucuagaaauaaaaaacccagaaucugcacaagagaggaguucacaagaaaaguuaggucaaacgcagcaauuggagcaguguuuguugaugaaaaccaauggaacucagcaaaagaagcaguggaagacgaaagguuuugggaccucgugcacagagagagggagcuucauaaacagggaaaaugugccacgugugucuacaauaugauggguaaaagagagaaaaaacuaggagaguuuggaaaggcaaaaggaagucgugcaauaugguacaugugguugggagcacgcuuucuagaauuugaagcccuuggcuucaugaaugaagaccacugguucaguagggagaauucacucaguggaguggaaggagaaggacuacauaaacuuggauacauacucagagacauaucaaagauuccagggggaaauauguaugcagacgacacagcuggaugggacacaagaauaacagaggaugaucuucagaaugaggcuaaaaucaccgacaucauggagccugaacaugcucuacuggcuacgucaaucuucaagcugaccuaucaaaauaaggugguaagggugcaaagaccagcaaaaaguggaaccgugauggacgucauauccagacgugaccagagaggaaguggacaggucggaacuuauggccuaaacacuuucaccaacauggagguccaacuaauaagacaaauggaaucugaaggaaucuuuucacccagcgaauuggaaaauucaaaucuagcugagagaguucucgacugguuggaaaaacauggcgucgaaagguugaaaagaauggcaaucagcggagaugacuguguggugaaaccaacugaugacagguucgcaacagcuuuaacagcccugaaugacaugggaaaggugagaaaagacauaccgcaaugggaaccuucaaaaggauggaaugacuggcagcaagugccuuucuguucacaccacuuccaccaacugauuaugaaggaugggagggagauaguggugccaugccgcaaccaagaugaacuugugggcagggccagaguaucacaaggcgccggguggagccugagagaaacugcuugccuaggcaagucauaugcacaaauguggcagcugauguacuuccacaggagagaccugagacuggcggcuaaugcuaucuguucagccguuccaguuaauugggucccaaccagccgcaccaccuggucgauccaugcccaccaucaauggaugacaacagaagacauguugucaguauggaauaggguuuggauagaggaaaacccauggauggaggacaaaacucauguauccagcugggaagauguuccauacuuaggaaaaagggaagaucaaugguguggaucucugauaggcuuaacagcaagagccaccugggccaccaacauacaaguggccauaaaccaagugagaaggcuuauugggaacgagaauuauuuagacuacaugacaucaaugaagagauucaagaaugagagugaucccgaaggagcccucugguaa

SEQ ID NO: 6303 - RNA, 9879 nt, Artificial Sequence
  derived and/or modified CDS sequence (wt) from DENV-1__KM403616__SS-prME
uccgugaccaugcuccucaugcugcugcccacagcccuggcguuccauuugaccacacgagggggagagccacacaugauaguuagcaagcaggaaagaggaaagucacucuuguuuaagaccucugcaggugucaacaugugcacccucauugcaauggauuugggagaguuaugugaggauacaaugaccuacaaaugcccccggaucacugaagcggaaccagaugauguugauugcuggugcaaugccacagacacaugggugaccuaugggacguguucucagacuggcgaacaccgacgggauaaacguucugucgcauuggccccacacguggggcuuggucucgaaacaagaaccgaaacguggauguccucugaaggcgccuggaggcagauacaaaaaguggagacuugggccuugagacacccaggauucacggugauagcccuuuuuuuagcacaugccauaggaacauccauuacccagaaagggaucaucuucauuuugcugaugcuggugacaccaucaauggccaugcgaugcgugggaauaggcaacagagacuucguugaaggacugucaggagcaacauggguggaugugguacuggagcauggaagcugugucaccaccauggcaaagaauaaaccaacauuggacauugaacucuugaagacggaggucacgaacccugccgucuugcgcaaacugugcauugaagcuaaaauaucaaacaccaccaccgauucaagauguccaacacaaggagaagcuacacugguggaagaacaagacgcgaacuuugugugucgacgaacauucguggacagaggcugggguaaugguuguggacuauucgggaagggaagcuuacuaacgugugcuaaguuuaagugugugacaaaacuugaaggaaagauaguucaauaugaaaacuuaaaauauucggugguagucacuguccacacuggggaccagcaccagguaggaaaugagacuacagaacauggaacaauugcaaccauaacaccucaagcucccacgucggaaauacagcugacugacuacggagcccuuacauuggacugcucaccuagaacagggcuggacuuuaaugagauggugcuguugacaaugaaagaaaaaucauggcuuguccacaaacaaugguuucuagacuuaccauugccuuggaccucgggggcuucaacaucucaagagacuuggaacagacaagaucugcuggucacauuuaagacagcucaugcaaagaagcaggaaguagucguacuggggucacaagaaggagcaaugcacacugcguugacuggggcgacagaaauccagacgucaggaacgacgacaaucuucgcaggacaccugaaauguagacuaaaaauggauaaacugacuuuaaaaggggugucauaugugaugugcacaggcucauuuaagcuagagaaggaaguggcugagacccagcauggaacuguccuagugcagguuaaauaugaaggaacagaugcaccaugcaagauuccaauuucaacccaagaugagaaaggagugacccagaaugggagauugauaacagccaaucccauaguuacugacaaagaaaaaccagucaacauugaaacagaaccacccuuuggugagagcuacaucgugauaggggcgggugaaaaagcuuugaaacuaagcugguucaagaaaggaagcagcauagggaaaauguucgaagccaccgcccgaggagcacgaaggauggcuauccugggagacacagcaugggacuucgguuccauaggagggguguucacaucugugggaaaauugguacaccagguuuuuggaaccgcauaugggguccuguucagcgguguuucuuggaccaugaaaauaggaauagggauucugcugacauggcuaggauugaauucaaggagcacgucacucucgaugacgugcauugcaguuggcauggucacacuguaccuaggagucaugguucaagcggacucggggugugugaucaacuggaagggcagagaacucaaguguggaaguggcaucuuugucacuaaugaaguccacacuuggacagagcaauacaaauuucaggcugacuccccaaaaagacuaucagcagccauugggaaggcaugggaggaaggcguguguggaauucgaucagccacacgucuugagaacaucauguggaagcaaauaucaaaugaauugaaccacauucuacuugaaaaugacaugaaauucacagugguuguaggagacgccaauggaaucuugacccaaggaaaaaagaugauuaggccacaacccauggaacacaaauacucauggaaaagcuggggaaaagccaaaaucauaggagcagauacacagaauacuaccuucaucaucgauggcccagacacuccagaaugccccgaugaccagagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaacgagaccuggaagcuagcgagagccuccuucauagaagugaagacaugcaucuggccaagaucccacacucuauggagcaauggagucuuggaaagugaaaugauaaucccaaagauauauggaggaccaauaucucagcacaacuacagaccaggguauuucacacaaacagcagggccauggcaccuaggcaaguuggaacuagacuuuaauuugugugaaggcaccacaguuguuguggaugaacauuguggaaaucgagguccaucucuuagaacuacaacagucacaggaaagauaauccaugaauggugcugcagauccugcacgcuaccccccuuacgcuucagaggagaagacggauguugguauggcauggaaaucagaccaguuaaggagaaggaagagaaucuagucaggucaauggucucugcagggucaggagaaguggacaguuuuucauugggacuacuaugcguaucaauaaugauugaagaagugaugagauccagauggaguagaaagaugcugaugacuggaacacuggcugcuuucuuccuucuuauaaugggacaacugacauggaaugaucugaucagguuaugcaucaugguuggagccaaugucucagacagaauggggaugggaacaacguaccuagcuuuaauggccacuuuuaaaaugagaccgauguucgcuguugggcuauuauuucgcagacuaacauccagagaggugcuccuucucacaauuggacuaagccugguggcauccguggagcuaccaaauucuuuagaggagcuaggggacggacuugcgaugggcaucaugauguuaaaauuguugacugauuuucagucacaccaguuguggacuaccuuacugucucugacauucaucaaaacaacucuuucacuggauuaugcauggaagacaauggcuaugguauugucaaucguaucucucuuuccucuaugucuauccacgaccucucaaaaaacaacauggcuuccgguguuguuaggauccuuuggauguaaaccacuaaccauguuucuuauaacagaaaacaaaauuuggggaaggaaaaguuggccccucaaugaaggaauuauggcuguuggaauagucagcauuuuacuaaguucacuccucaaaaaugacgugccacuagccggcccacuaauagcuggaggcaugcugauagcauguuacgucauuuccggaagcucagccgauuuaucauuggagagagcggcugaggucuccugggaagaagaagcagaacacucuggugccucacacaacauacuaguggagguccaagaugauggaacuaugaaaauaaaagaugaagagagagaugacacgcucacuauacuccucaaagcaacuuuguuggcaguuucagggguguacccaaugucaauaccagcaacccuuuuugugugguauuuuuggcagaaaaagaaacagagaucaggagucuugugggacacacccagcccuccagaaguagaaagagcaguucuugaugaugguaucuauagaaucuugcaaagaggacuguuggguaggucccagguaggagugggaguuuuucaagacggcguguuccacacaauguggcaugucaccaggggggcuguccucauguaccaagggaagaggcuggaaccaaguugggccagugucaaaaaagacuugaucucauauggaggagguuggagguuucaaggaucauggaacacgggagaagaaguacaggugauagcuguugaaccagggaaaaacccaaagaauguacagacaacgccgggcaccuucaagaccccugaaggcgaaguuggagccauagcccuagauuucaaaccuggcacaucuggaucucccaucgugaacagagaggggaaaauaguaggucuuuauggaaauggaguggugacaacaaguggaaccuacgucagugccauugcccaagcuaaagcgucacaagaagggccucuaccagagauugaggacgagguguuuaagaaaagaaaccuaacaauaauggaccuacauccaggaucaggaaaaacaagaagauaucuuccagccauaguccgugaggccauaaaaaggaaacugcgcacgcuaaucuuggcucccacaagaguugucgccucugaaauggcagaggcgcuuaaaggaaugccaauaagauaucagacaacagcaguaaagagugaacacacaggaaaggagauagucgaucucaugugccacgccacuuucaccaugcgucuccuaucuccagugagaguucccaauuacaacaugauuaucauggaugaagcacacuuuaccgauccagccagcauagcggccagaggguacaucucaacccgaguggguaugggugaagcagcugcgaucuuuaugacagccacucccccaggaucgguagaggccuuuccacagagcaaugcaguuauccaagaugaggaaagagacauuccugagagaucauggaacucaggcuacgacuggaucacugacuucccaggaaaaacagucugguuuguuccaagcaucaaaucaggaaaugacauugccaacugcuuaagaaaaaacgggaaacgggugauccaauugagcagaaaaaccuuugacacugaauaccagaaaacgaaaaacaaugauugggacuauguugucacaacagacauuuccgaaaugggagcaaauuuccgggccgauaggguaauagacccaaggcggugcuugaagccgguaauacuaaaagauggcccagagcgcgucauucuggccggaccaaugccagugaccgcggccagugcugcccagaggagaggaagaauuggaaggaaccaaaacaaggaaggugaccaguauauuuacaugggacagccuuuaaauaaugaugaggaccacgcucauuggacagaagcaaaaaugcuccuugacaauauaaauacgccagaagggauuaucccagcccucuuugagccagagagagaaaagagugcagcaauagacggggaguauagacugcggggagaagcaaggaaaacguucguggagcuaaugagaagaggggaucuaccaguuuggcuaucuuacaaaguugccucagaaggcuuccaguacuccgacagaagauggugcuuugacggggaaaggaacaaccagguguuggaggagaacauggacguggagaucuggacaaaagaaggagaaagaaagaaauugcgaccucgcugguuagaugccagaaccuacucugauccacuggcccugcgcgaguuuaaagaguucgcagcaggaagaagaagugucucaggugaccuaauauuagaaauagggaaacucccacagcauuugacgcuaagggcccagaaugcuuuggacaacuuggucauguugcacaauuccgaacaagggggaaaagccuauagacaugcuauggaagaacuaccagacaccauagaaacauugaugcuacuagccuugauagcugugcugacugguggaguuacguuguuuuuccuaucaggaaaaggucuagggaaaacauccauuggccuacuuuguguaauggccucaaguguacuguuauggauggccaguguggagccccauuggauagcggccuccaucauacuagaguuuuuucugauggugcugcuuauuccagagccagacagacagcguacuccacaggacaaucaacuagcauauguggugauagguuuguuauucaugauauugacaguggcagccaaugagaugggauuacuggaaaccacaaagaaagaccuggggauuggccauguagucgccgaaaaccaccaccaugccacaaugcuagacauagacuuacauccagcuucagccuggacccucuaugcaguagccacaacaauuaucacucccaugaugagacacacaauugaaaacacaacggcaaacauuucccugacagcuauugcaaaucaggcggcuauauuaaugggacuugacaagggauggccaauaucgaagauggacauaggagugccacuucucgccuuagggugcuauucccaggugaacccauugacacugacagcggcgguguuaauguuaguggcucauuaugccauaaucggaccuggacugcaagcaaaagcuaccagagaagcccaaaaaaggacugcggccggaauaaugaaaaauccaacuguagacgggauuguugcaauagauuuggauccugugguuuaugaugcaaaauuugaaaaacagcuaggccaaauaauguuacuaauacucugcacaucacagauucucuugaugcggacuacaugggccuuaugugaaucuaucacacuggcuacuggacccuugaccacucucugggagggaucuccuggaaaauucuggaauaccacgauagcaguguccauggcaaacaucuucaggggaaguuauuuagcaggggcaggucuggccuucucauuaaugaaaucuuuaggaggagguaggagagguacgggagcucaaggggaaacauugggagaaaaauggaaaagacaacuaaaccaacugagcaagucagaauuuaacacuuacaaaaggaguggaauuauggagguggacagauccgaagccaaggagggacugaaaagaggagaaacaaccaaacaugcagugucgagaggaacagccaaacuuaggugguuuguggagaggaaccuugugaaaccggaagggaaagugauagaccucgguuguggaagagguggcuggucauauuacugcgcugggcugaagaaggucacagaaguaaagggauacacaaaaggaggacccggucaugaggaaccuaucccaauggcgacuuauggauggaacauagugaagcuacacucuggaagggauguauucuuuacaccaccugagaaaugugacacccuuuugugugauauuggugaguccucuccgaauccaacuauagaagaaggaagaacguuacguguucuaaagaugguggaaccauggcucagaggaaaucaguuuugcauaaaaauccuaaauccuuauaugccaagugugguagaaacucuggagcaaaugcaaagaaaacauggagggaugcuagugcgaaacccacucucaagaaauuccacccaugaaauguacugggucucauguggaacaggaaacauugugucggcagugaacaugacauccagaaugcugcugaaucgguucacaauggcucacaggaagccaacguaugaaagagacguggacuugggcgcuggaacaagacauguggcaguggaaccagagauagccaaccuagacauuauuggccagaggauagagaacauaaaaaaugaacauaagucaacauggcauuaugaugaggacaauccauacaaaacaugggccuaucauggaucauaugaggucaagccaucagggucagccucauccauggugaauggcguggugagauugcucaccaagccaugggauguuauccccauggucacacaaauagcuaugacugauaccacacccuucggacaacagaggguuuucaaagagaaaguugacacacgcacaccaagaccaaaacgaggcacagcacaaauuauggaggugacagccaagugguuguggggauuccucucuagaaauaaaaaacccagaaucugcacaagagaggaguucacaagaaaaguuaggucaaacgcagcaauuggagcaguguuuguugaugaaaaccaauggaacucagcaaaagaagcaguggaagacgaaagguuuugggaccucgugcacagagagagggagcuucauaaacagggaaaaugugccacgugugucuacaauaugauggguaaaagagagaaaaaacuaggagaguuuggaaaggcaaaaggaagucgugcaauaugguacaugugguugggagcacgcuuucuagaauuugaagcccuuggcuucaugaaugaagaccacugguucaguagggagaauucacucaguggaguggaaggagaaggacuacauaaacuuggauacauacucagagacauaucaaagauuccagggggaaauauguaugcagacgacacagcuggaugggacacaagaauaacagaggaugaucuucagaaugaggcuaaaaucaccgacaucauggagccugaacaugcucuacuggcuacgucaaucuucaagcugaccuaucaaaauaaggugguaagggugcaaagaccagcaaaaaguggaaccgugauggacgucauauccagacgugaccagagaggaaguggacaggucggaacuuauggccuaaacacuuucaccaacauggagguccaacuaauaagacaaauggaaucugaaggaaucuuuucacccagcgaauuggaaaauucaaaucuagcugagagaguucucgacugguuggaaaaacauggcgucgaaagguugaaaagaauggcaaucagcggagaugacuguguggugaaaccaacugaugacagguucgcaacagcuuuaacagcccugaaugacaugggaaaggugagaaaagacauaccgcaaugggaaccuucaaaaggauggaaugacuggcagcaagugccuuucuguucacaccacuuccaccaacugauuaugaaggaugggagggagauaguggugccaugccgcaaccaagaugaacuugugggcagggccagaguaucacaaggcgccggguggagccugagagaaacugcuugccuaggcaagucauaugcacaaauguggcagcugauguacuuccacaggagagaccugagacuggcggcuaaugcuaucuguucagccguuccaguuaauugggucccaaccagccgcaccaccuggucgauccaugcccaccaucaauggaugacaacagaagacauguugucaguauggaauaggguuuggauagaggaaaacccauggauggaggacaaaacucauguauccagcugggaagauguuccauacuuaggaaaaagggaagaucaaugguguggaucucugauaggcuuaacagcaagagccaccugggccaccaacauacaaguggccauaaaccaagugagaaggcuuauugggaacgagaauuauuuagacuacaugacaucaaugaagagauuuaagaaugagagugaucccgaaggagcccucugguaa

SEQ ID NO: 6304 - RNA, 9879 nt, Artificial Sequence
  derived and/or modified CDS sequence (wt) from DENV-1__KM403617__SS-prME
uccgugaccaugcuccucaugcugcugcccacagcccuggcguuccauuugaccacacgagggggagagccacacaugauaguuagcaagcaggaaagaggaaagucacucuuguuuaagaccucugcaggugucaacaugugcacccucauugcaauggauuugggagaguuaugugaggacacaaugaccuacaaaugcccccggaucacugaagcggaaccagaugauguugauugcuggugcaaugccacagacacaugggugaccuaugggacguguucucagacuggcgaacaccgacgggauaaacguucugucgcauuggccccacacguggggcuuggucucgaaacaagaaccgaaacguggauguccucugaaggcgccuggaggcagauacaaaaaguggagacuugggccuugagacacccaggauucacggugauagcccuuuuuuuagcacaugccauaggaacauccauuacccagaaagggaucaucuucauuuugcugaugcuggugacaccaucaauggccaugcgaugcgugggaauaggcaacagagacuucguugaaggacugucaggagcaacauggguggaugugguacuggagcauggaagcugugucaccaccauggcaaagaauaaaccaacauuggacauugaacucuugaagacggaggucacgaacccugccgucuugcgcaaacugugcauugaagcuaaaauaucaaacaccaccaccgauucaagauguccaacacaaggagaagcuacacugguggaagaacaagacgcgaacuuugugugucgacgaacauucguggacagaggcugggguaaugguuguggacuauucgggaagggaagcuuacuaacgugugcuaaguuuaagugugugacaaaacuugaaggaaagauaguucaauaugaaaacuuaaaauauucggugguagucacuguccacacuggggaccagcaccagguaggaaaugagacuacagaacauggaacaauugcaaccauaacaccucaagcucccacgucggaaauacagcugacugacuacggagcccuuacauuggacugcucaccuagaacagggcuggacuuuaaugagauggugcuguugacaaugaaagaaaaaucauggcuuguccacaaacaaugguuucuagacuuaccauugccuuggaccucgggggcuucaacaucucaagagacuuggaacagacaagaucugcuggucacauuuaagacagcucaugcaaagaagcaggaaguagucguacuggggucacaagaaggagcaaugcacacugcguugacuggggcgacagaaauccagacgucaggaacgacgacaaucuucgcaggacaccugaaauguagacuaaaaauggauaaacugacuuuaaaaggggugucauaugugaugugcacaggcucauuuaagcuagagaaggaaguggcugagacccagcauggaacuguccuagugcagguuaaauaugaaggaacagaugcaccaugcaagauuccaauuucaacccaagaugagaaaggagugacccagaaugggagauugauaacagccaaucccauaguuacugacaaagaaaaaccagucaacauugaaacagaaccacccuuuggugagagcuacaucgugauaggggcgggugaaaaagcuuugaaacuaagcugguucaagaaaggaagcagcauagggaaaauguucgaagccaccgcccgaggagcacgaaggauggcuauccugggagacacagcaugggacuucgguuccauaggagggguguucacaucugugggaaaauugguacaccagguuuuuggaaccgcauaugggguccuguucagcgguguuucuuggaccaugaaaauaggaauagggauucugcugacauggcuaggauugaauucaaggagcacgucacucucgaugacgugcauugcaguuggcauggucacacuguaccuaggagucaugguucaagcggacucggggugugugaucaacuggaagggcagagaacucaaguguggaaguggcaucuuugucacuaaugaaguccacacuuggacagagcaauacaaauuucaggcugacuccccaaaaagacuaucagcagccauugggaaggcaugggaggaaggcguguguggaauucgaucagccacacgucuugagaacaucauguggaagcaaauaucaaaugaauugaaccacauucuacuugaaaaugacaugaaauucacagugguuguaggagacgccaauggaaucuugacccaaggaaaaaagaugauuaggccacaacccauggaacacaaauacucauggaaaagcuggggaaaagccaaaaucauaggagcagauacacagaauacuaccuucaucaucgauggcccagacacuccagaaugccccgaugaccagagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaacgagaccuggaagcuagcgagagccuccuucauagaagugaagacaugcaucuggccaagaucccacacucuauggagcaauggagucuuggaaagugaaaugauaaucccaaagauauauggaggaccaauaucucagcacaacuacagaccaggguauuucacacaaacagcagggccauggcaccuaggcaaguuggaacuagacuuuaauuugugugaaggcaccacaguuguuguggaugaacauuguggaaaucgagguccaucucuuagaacuacaacagucacaggaaagauaauccaugaauggugcugcagauccugcacgcuaccccccuuacgcuucagaggagaagacggauguugguauggcauggaaaucagaccaguuaaggagaaggaagagaaucuagucaggucaauggucucugcagggucaggagaaguggacaguuuuucauugggacuacuaugcguaucaauaaugauugaagaagugaugagauccagauggaguagaaagaugcugaugacuggaacacuggcuguuuucuuccuucuuauaaugggacaacugacauggaaugaucugaucagguuaugcaucaugguuggagccaaugucucagacagaauggggaugggaacaacguaccuagcuuuaauggccacuuuuaaaaugagaccgauguucgcuguugggcuauuauuucgcagacuaacauccagagaggugcuccuucucacaauuggacuaagccugguggcauccguggagcuaccaaauucuuuagaggagcuaggggacggacuugcgaugggcaucaugauguuaaaauuguugacugauuuucagucacaccaguuguggacuaccuuacugucucugacauucaucaaaacaacucuuucacuggauuaugcauggaagacaauggcuaugguauugucaaucguaucucucuuuccucuaugucuauccacgaccucucaaaaaacaacauggcuuccgguguuguuaggauccuuuggauguaaaccacuaaccauguuucuuauaacagaaaacaaaauuuggggaaggaaaaguuggccccucaaugaaggaauuauggcuguuggaauagucagcauuuuacuaaguucacuccucaaaaaugacgugccacuagccggcccacuaauagcuggaggcaugcugauagcauguuacgucauuuccggaagcucagccgauuuaucauuggagagagcggcugaggucuccugggaagaagaagcagaacacucuggugccucacacaacauacuaguggagguccaagaugauggaacuaugaaaauaaaagaugaagagagagaugacacgcucacuauacuccucaaagcaacuuuguuggcaguuucagggguguacccaaugucaauaccagcaacccuuuuugugugguauuuuuggcagaaaaagaaacagagaucaggagucuugugggacacacccagcccuccagaaguagaaagagcaguucuugaugaugguaucuauagaaucuugcaaagaggacuguuggguaggucccagguaggagugggaguuuuucaagacggcguguuccacacaauguggcaugucaccaggggggcuguccucauguaccaagggaagaggcuggaaccaaguugggccagugucaaaaaagacuugaucucauauggaggagguuggagguuucaaggaucauggaacacgggagaagaaguacaggugauagcuguugaaccagggaaaaacccaaagaauguacagacaacgccgggcaccuucaagaccccugaaggcgaaguuggagccauagcccuagauuucaaaccuggcacaucuggaucucccaucgugaacagagaggggaaaauaguaggucuuuauggaaauggaguggugacaacaaguggaaccuacgucagugccauugcccaagcuaaagcgucacaagaagggccucuaccagagauugaggacgagguguuuaagaaaagaaaccuaacaauaauggaccuacauccaggaucaggaaaaacaagaagauaucuuccagccauaguccgugaggccauaaaaaggaaacugcgcacgcuaaucuuggcucccacaagaguugucgccucugaaauggcagaggcgcuuaaaggaaugccaauaagauaucagacaacagcaguaaagagugaacacacaggaaaggagauagucgaucucaugugccacgccacuuucaccaugcgucuccuaucuccagugagaguucccaauuacaacaugauuaucauggaugaagcacacuuuaccgauccagccagcauagcggccagaggguacaucucaacccgaguggguaugggugaagcagcugcgaucuuuaugacagccacucccccaggaucgguagaggccuuuccacagagcaaugcaguuauccaagaugaggaaagagacauuccugagagaucauggaacucaggcuacgacuggaucacugacuucccaggaaaaacagucugguuuguuccaagcaucaaaucaggaaaugacauugccaacugcuuaagaaaaaacgggaaacgggugauccaauugagcagaaaaaccuuugacacugaauaccagaaaacgaaaaacaaugauugggacuauguugucacaacagacauuuccgaaaugggagcaaauuuccgggccgauaggguaauagacccaaggcggugcuugaagccgguaauacuaaaagauggcccagagcgcgucauucuggccggaccaaugccagugaccgcggccagugcugcccagaggagaggaagaauuggaaggaaccaaaacaaggaaggugaccaguauauuuacaugggacagccuuuaaauaaugaugaggaccacgcucauuggacagaagcaaaaaugcuccuugacaauauaaauacgccagaagggauuaucccagcccucuuugagccagagagagaaaagagugcagcaauagacggggaguauagacugcggggagaagcaaggaaaacguucguggagcuaaugagaagaggggaucuaccaguuuggcuaucuuacaaaguugccucagaaggcuuccaguacuccgacagaagauggugcuuugacggggaaaggaacaaccagguguuggaggagaacauggacguggagaucuggacaaaagaaggagaaagaaagaaauugcgaccucgcugguuagaugccagaaccuacucugauccacuggcccugcgcgaguuuaaagaguucgcagcaggaagaagaagugucucaggugaccuaauauuagaaauagggaaacucccacagcauuugacgcuaagggcccagaaugcuuuggacaacuuggucauguugcacaauuccgaacaagggggaaaagccuauagacaugcuauggaagaacuaccagacaccauagaaacauugaugcuacuagccuugauagcugugcugacugguggaguuacguuguuuuuccuaucaggaaaaggucuagggaaaacauccauuggccuacuuuguguaauggccucaaguguacuguuauggauggccaguguggagccccauuggauagcggccuccaucauacuagaguuuuuucugauggugcugcuuauuccagagccagacagacagcguacuccacaggacaaucaacuagcauauguggugauagguuuguuauucaugauauugacaguggcagccaaugagaugggauuacuggaaaccacaaagaaagaccuggggauuggccauguagucgccgaaaaccaccaccaugccacaaugcuagacauagacuuacauccagcuucagccuggacccucuaugcaguagccacaacaauuaucacucccaugaugagacacacaauugaaaacacaacggcaaacauuucccugacagcuauugcaaaucaggcggcuauauuaaugggacuugacaagggauggccaauaucgaagauggacauaggagugccacuucucgccuuagggugcuauucccaggugaacccauugacacugacagcggcgguguuaauguuaguggcucauuaugccauaaucggaccuggacugcaagcaaaagcuaccagagaagcccaaaaaaggacugcggccggaauaaugaaaaauccaacuguagacgggauuguugcaauagauuuggauccugugguuuaugaugcaaaauuugaaaaacagcuaggccaaauaauguuacuaauacucugcacaucacagauucucuugaugcggacuacaugggccuuaugugaaucuaucacacuggcuacuggacccuugaccacucucugggagggaucuccuggaaaauucuggaauaccacgauagcaguguccauggcaaacaucuucaggggaaguuauuuagcaggggcaggucuggccuucucauuaaugaaaucuuuaggaggagguaggagagguacgggagcucaaggggaaacauugggagaaaaauggaaaagacaacuaaaccaacugagcaagucagaauuuaacacuuacaaaaggaguggaauuauggagguggacagauccgaagccaaggagggacugaaaagaggagaaacaaccaaacaugcagugucgagaggaacagccaaacuuaggugguuuguggagaggaaccuugugaaaccggaagggaaagugauagaccucgguuguggaagagguggcuggucauauuacugcgcugggcugaagaaggucacagaaguaaagggauacacaaaaggaggacccggucaugaggaaccuaucccaauggcgacuuauggauggaacauagugaagcuacacucuggaagggauguauucuuuacaccaccugagaaaugugacacccuuuugugugauauuggugaguccucuccgaauccaacuauagaagaaggaagaacguuacguguucuaaagaugguggaaccauggcucagaggaaaucaguuuugcauaaaaauccuaaauccuuauaugccaagugugguagaaacucuggagcaaaugcaaagaaaacauggagggaugcuagugcgaaacccacucucaagaaauuccacccaugaaauguacugggucucauguggaacaggaaacauugugucggcagugaacaugacauccagaaugcugcugaaucgguucacaauggcucacaggaagccaacguaugaaagagacguggacuugggcgcuggaacaagacauguggcaguggaaccagagauagccaaccuagacauuauuggccagaggauagagaacauaaaaaaugaacauaagucaacauggcauuaugaugaggacaauccauacaaaacaugggccuaucauggaucauaugaggucaagccaucagggucagccucauccauggugaauggcguggugagauugcucaccaagccaugggauguuauccccauggucacacaaauagcuaugacugauaccacacccuucggacaacagaggguuuucaaagagaaaguugacacacgcacaccaagaccaaaacgaggcacagcacaaauuauggaggugacagccaagugguuguggggauuccucucuagaaauaaaaaacccagaaucugcacaagagaggaguucacaagaaaaguuaggucaaacgcagcaauuggagcaguguuuguugaugaaaaccaauggaacucagcaaaagaagcaguggaagacgaaagguuuugggaccucgugcacagagagagggagcuucauaaacagggaaaaugugccacgugugucuacaauaugauggguaaaagagagaaaaaacuaggagaguuuggaaaggcaaaaggaagucgugcaauaugguacaugugguugggagcacgcuuucuagaauuugaagcccuuggcuucaugaaugaagaccacugguucaguagggagaauucacucaguggaguggaaggagaaggacuacauaaacuuggauacauacucagagacauaucaaagauuccagggggaaauauguaugcagacgacacagcuggaugggacacaagaauaacagaggaugaucuucagaaugaggcuaaaaucaccgacaucauggagccugaacaugcucuacuggcuacgucaaucuucaagcugaccuaucaaaauaaggugguaagggugcaaagaccagcaaaaaguggaaccgugauggacgucauauccagacgugaccagagaggaaguggacaggucggaacuuauggccuaaacacuuucaccaacauggagguccaacuaauaagacaaauggaaucugaaggaaucuuuucacccagcgaauuggaaaauucaaaucuagcugagagaguucucgacugguuggaaaaacauggcgucgaaagguugaaaagaauggcaaucagcggagaugacuguguggugaaaccaacugaugacagguucgcaacagcuuuaacagcccugaaugacaugggaaaggugagaaaagacauaccgcaaugggaaccuucaaaaggauggaaugacuggcagcaagugccuuucuguucacaccacuuccaccaacugauuaugaaggaugggagggagauaguggugccaugccgcaaccaagaugaacuugugggcagggccagaguaucacaaggcgccggguggagccugagagaaacugcuugccuaggcaagucauaugcacaaauguggcagcugauguacuuccacaggagagaccugagacuggcggcuaaugcuaucuguucagccguuccaguuaauugggucccaaccagccgcaccaccuggucgauccaugcccaccaucaauggaugacaacagaagacauguugucaguauggaauaggguuuggauagaggaaaacccauggauggaggacaaaacucauguauccagcugggaagauguuccauacuuaggaaaaagggaagaucaaugguguggaucucugauaggcuuaacagcaagagccaccugggccaccaacauacaaguggccauaaaccaagugagaaggcuuauugggaacgagaauuauuuagacuacaugacaucaaugaagagauuuaagaaugagagugaucccgaaggagcccucugguaa

SEQ ID NO: 6305 - RNA, 9879 nt, Artificial Sequence
  derived and/or modified CDS sequence (wt) from DENV-1__KM403635__SS-prME
uccgugaccaugcuccucaugcugcugcccacagcccuggcguuccauuugaccacacgagggggagagccacacaugauaguuagcaagcaggaaagaggaaagucacucuuguuuaagaccucugcaggugucaacaugugcacccucauugcaauggauuugggagaguuaugugaggauacaaugaccuacaaaugcccccggaucacugaagcggaaccagaugauguugauugcuggugcaaugccacagacacaugggugaccuaugggacguguucucagacuggcgaacaccgacgggauaaacguucugucgcauuggccccacacguggggcuuggucucgaaacaagaaccgaaacguggauguccucugaaggcgccuggaggcagauacaaaaaguggagacuugggccuugagacacccaggauucacggugauagcccuuuuuuuagcacaugccauaggaacauccauuacccagaaagggaucaucuucauuuugcugaugcuggugacaccaucaauggccaugcgaugcgugggaauaggcaacagagacuucguugaaggacugucaggagcaacauggguggaugugguacuggagcauggaagcugugucaccaccauggcaaagaauaaaccaacauuggacauugaacucuugaagacggaggucacgaacccugccgucuugcgcaaacugugcauugaagcuaaaauaucaaacaccaccaccgauucaagauguccaacacaaggagaagcuacacugguggaagaacaagacgcgaacuuugugugucgacgaacauucguggacagaggcugggguaaugguuguggacuauucgggaagggaagcuuacuaacgugugcuaaguuuaagugugugacaaaacuugaaggaaagauaguucaauaugaaaacuuaaaauauucggugauagucacuguccacacuggggaccagcaccagguaggaaaugagacuacagaacauggaacaauugcaaccauaacaccucaagcucccacgucggaaauacagcugacugacuacggagcccuuacauuggacugcucaccuagaacagggcuggacuuuaaugagauggugcuguugacaaugaaagaaaaaucauggcuuguccacaaacaaugguuucuagacuuaccauuaccuuggaccucgggggcuucagcaucucaagagacuuggaacagacaagaucugcuggucacauuuaagacagcucaugcaaagaagcaggaaguagucguacuggggucacaagaaggagcaaugcacacugcguugacuggggcgacagaaauccagacgucaggaacgacgacaaucuucgcaggacaccugaaauguagacuaaaaauggauaaacugacuuuaaaaggggugucauaugugaugugcacaggcucauuuaagcuagagaaggaaguggcugagacccagcauggaacuguccuagugcagguuaaauaugaaggaacagaugcaccaugcaagauuccaauuucaacccaagaugagaaaggagugacccagaaugggagauugauaacagccaaucccauaguuacugacaaagaaaaaccagucaacauugaaacagaaccacccuuuggugagagcuacaucgugauaggggcgggugaaaaagcuuugaaacuaagcugguucaagaaaggaagcagcauagggaaaauguucgaagccaccgcccgaggagcacgaaggauggcuauccugggagacacagcaugggacuucgguuccauaggagggguguucacaucugugggaaaauugguacaccagguuuuuggaaccgcauaugggguccuguucagcgguguuucuuggaccaugaaaauaggaauagggauucugcugacauggcuaggauugaauucaaggagcacgucacucucgaugacgugcauugcaguuggcauggucacacuguaccuaggagucaugguucaagcggacucggggugugugaucaacuggaagggcagagaacucaaguguggaaguggcaucuuugucacuaaugaaguccacacuuggacagagcaauacaaauuucaggcugacuccccaaaaagacuaucagcagccauugggaaggcaugggaggaaggcguguguggaauucgaucagccacacgucuugagaacaucauguggaagcaaauaucaaaugaauugaaccacauucuacuugaaaaugacaugaaauucacagugguuguaggagacgccaauggaaucuugacccaaggaaaaaagaugauuaggccacaacccauggaacacaaauacucauggaaaagcuggggaaaagccaaaaucauaggagcagauacacagaauacuaccuucaucaucgauggcccagacacuccagaaugccccgaugaccagagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaacgagaccuggaagcuagcgagagccuccuucauagaagugaagacaugcaucuggccaagaucccacacucuauggagcaauggagucuuggaaagugaaaugauaaucccaaagauauauggaggaccaauaucucagcacaacuacagaccaggguauuucacacaaacagcagggccauggcaccuaggcaaguuggaacuagacuuuaauuugugugaaggcaccacaguuguuguggaugaacauuguggaaaucgagguccaucucuuagaacuacaacagucacaggaaagauaauccaugaauggugcugcagauccugcacgcuaccccccuuacgcuucagaggagaagacggauguugguauggcauggaaaucagaccagucaaggagaaggaagagaaucuagucaggucaauggucucugcagggucaggagaaguggacaguuuuucauugggacuacuaugcguaucaauaaugauugaagaagugaugagauccagauggaguagaaagaugcugaugacuggaacacuggcuguuuucuuccuucuuauaaugggacaacugacauggaaugaucugaucagguuaugcaucaugguuggagccaaugucucagacagaauggggaugggaacaacguaccuagcuuuaauggccacuuuuaaaaugagaccgauguucgcuguugggcuauuauuucgcagacuaacauccagagaggugcuccuucucacaauuggacuaagccugguggcauccguggagcuaccaaauucuuuagaggagcuaggggacggacuugcgaugggcaucaugauguuaaaauuguugacugauuuucagucacaccaguuguggacuaccuuacugucucugacauucaucaaaacaacucuuucacuggauuaugcauggaagacaauggcuaugguauugucaaucguaucucucuuuccucuaugucuauccacgaccucucaaaaaacaacauggcuuccgguguuguuaggauccuuuggauguaaaccacuaaccauguuucuuauaacagaaaacaaaauuuggggaaggaaaaguuggccccucaaugaaggaauuauggcuguuggaauagucagcauuuuacuaaguucacuccucaaaaaugacgugccacuagccggcccacuaauagcuggaggcaugcugauagcauguuacgucauuuccggaagcucagccgauuuaucauuggagagagcggcugaggucuccugggaagaagaagcagaacacucuggugccucacacaacauacuaguggagguccaagaugauggaaccaugaaaauaaaagaugaagagagagaugacacgcucacuauacuccucaaagcaacuuuguuggcaguuucagggguguacccaaugucaauaccagcaacccuuuuugugugguauuuuuggcagaaaaagaaacagagaucaggagucuugugggacacacccagcccuccagaaguagaaagagcaguucuugaugaugguaucuauagaaucuugcaaagaggacuguuggguaggucccagguaggagugggaguuuuucaagacggcguguuccacacaauguggcaugucaccaggggggcuguccucauguaccaagggaagaggcuggaaccaaguugggccagugucaaaaaagacuugaucucauauggaggagguuggagguuucaaggaucauggaacacgggagaagaaguacaggugauagcuguugaaccagggaaaaacccaaagaauguacagacaacgccgggcaccuucaagaccccugaaggcgaaguuggagccauagcccuagauuucaaaccuggcacaucuggaucucccaucgugaacagagaggggaaaauaguaggucuuuauggaaauggaguggugacaacaaguggaaccuacgucagugccauugcccaagcuaaagcgucacaagaagggccucuaccagagauugaggacgagguguuuaagaaaagaaaccuaacaauaauggaccuacauccaggaucaggaaaaacaagaagauaucuuccagccauaguccgugaggccauaaaaaggaaacugcgcacgcuaaucuuggcucccacaagaguugucgccucugaaauggcagaggcgcuuaaaggaaugccaauaagauaucagacaacagcaguaaagagugaacacacaggaaaggagauagucgaucucaugugccacgccacuuucaccaugcgucuccuaucuccagugagaguucccaauuacaacaugauuaucauggaugaagcacacuuuaccgauccagccagcauagcggccagaggguacaucucaacccgaguggguaugggugaagcagcugcgaucuucaugacagccacucccccaggaucgguagaggccuuuccacagagcaaugcaguuauccaagaugaggaaagagacauuccugagagaucauggaacucaggcuacgacuggaucacugacuucccaggaaaaacagucugguuuguuccaagcaucaaaucaggaaaugacauugccaacugcuuaagaaaaaacgggaaacgggugauccaauugagcagaaaaaccuuugacacugaauaccagaaaacgaaaaacaaugauugggacuauguugucacaacagacauuuccgaaaugggagcaaauuuccgggccgauaggguaauagacccaaggcggugcuugaagccgguaauacuaaaagauggcccagagcgcgucauucuggccggaccaaugccagugaccgcggccagugcugcccagaggagaggaagaauuggaaggaaccaaaacaaggaaggugaccaguauauuuacaugggacagccuuuaaauaaugaugaggaccacgcucauuggacagaagcaaaaaugcuccuugacaauauaaauacgccagaagggauuaucccagcccucuuugagccagagagagaaaagagugcagcaauagacggggaguauagacugcggggagaagcaaggaaaacguucguggagcuaaugagaagaggggaucuaccaguuuggcuaucuuacaaaguugccucagaaggcuuccaguacuccgacagaagauggugcuuugacggggaaaggaacaaccagguguuggaggagaacauggacguggagaucuggacaaaagaaggagaaagaaagaaauugcgaccucgcugguuagaugccagaaccuacucugauccacuggcccugcgcgaguuuaaagaguucgcagcaggaagaagaagugucucaggugaccuaauauuagaaauagggaaacucccacagcauuugacgcuaagggcccagaaugcuuuggacaacuuggucauguugcacaauuccgaacaagggggaaaagccuauagacaugcuauggaagaacuaccagacaccauagaaacauugaugcuacuagccuugauagcugugcugacugguggaguuacguuguuuuuccuaucaggaaaaggucuagggaaaacauccauuggccuacuuuguguaauggccucaaguguacuguuauggauggccaguguggagccccauuggauagcggccuccaucauacuagaguuuuuucugauggugcugcuuauuccagagccagacagacagcguacuccacaagacaaucaacuagcauauguggugauagguuuguuauucaugauauugacaguggcagccaaugagaugggauuacuggaaaccacaaagaaagaccuggggauuggccauguagucgccgaaaaccaccaccaugccacaaugcuagacauagacuuacauccagcuucagccuggacccucuaugcaguagccacaacaauuaucacucccaugaugagacacacaauugaaaacacaacggcaaacauuucccugacagcuauugcaaaucaggcggcuauauuaaugggacuugacaagggauggccaauaucgaagauggacauaggagugccacuucucgccuuagggugcuauucccaggugaacccauugacacugacagcggcgguguuaauguuaguggcucauuaugccauaauuggaccuggacugcaagcaaaagcuaccagagaagcccaaaaaaggacugcggccggaauaaugaaaaauccaacuguagacgggauuguugcaauagauuuggauccugugguuuaugaugcaaaauuugaaaaacagcuaggccaaauaauguuacuaauacucugcacaucacagauucucuugaugcggacuacaugggccuuaugugaaucuaucacacuggcuacuggacccuugaccacucucugggagggaucuccuggaaaauucuggaauaccacgauagcaguguccauggcaaacaucuucaggggaaguuauuuagcaggggcaggucuggccuucucauuaaugaaaucuuuaggaggagguaggagagguacgggagcucaaggggaaacauugggagaaaaauggaaaagacaacuaaaccaacugagcaagucagaauuuaacacuuacaaaaggaguggaauuauggagguggacagauccgaagccaaggagggacugaaaagaggagaaacaaccaaacaugcagugucgagaggaacagccaaacuuaggugguuuguggagaggaaccuugugaaaccggaagggaaagugauagaccucgguuguggaagagguggcuggucauauuacugcgcugggcugaagaaggucacagaaguaaagggauacacaaaaggaggacccggucaugaggaaccuaucccaauggcgacuuauggauggaacauagugaagcuacacucuggaagggauguauucuuuacaccaccugagaaaugugacacccuuuugugugauauuggugaguccucuccgaauccaacuauagaagaaggaagaacguuacguguucuaaagaugguggaaccauggcucagaggaaaucaguuuugcauaaaaauccuaaauccuuauaugccaagugugguagaaacucuggagcaaaugcaaagaaaacauggagggaugcuagugcgaaacccacucucaagaaauuccacccaugaaauguacugggucucauguggaacaggaaacauugugucggcagugaacaugacauccagaaugcugcugaaucgguucacaauggcucacaggaagccaacguaugaaagagacguggacuugggcgcuggaacaagacauguagcaguggaaccagagauagccaaccuagacauuauuggccagaggauagagaacauaaaaaaugaacauaagucaacauggcauuaugaugaggacaauccauacaaaacaugggccuaucauggaucauaugaggucaagccaucagggucagccucauccauggugaauggcguggugagauugcucaccaagccaugggauguuauccccauggucacacaaauagcuaugacugauaccacacccuucggacaacagaggguuuucaaagagaaaguugacacacgcacaccaagaccaaaacgaggcacagcacaaauuauggaggugacagccaagugguuguggggauuccucucuagaaauaaaaaacccagaaucugcacaagagaggaguucacaagaaaaguuaggucaaacgcagcaauuggagcaguguuuguugaugaaaaccaauggaacucagcaaaagaagcaguggaagacgaaagguuuugggaccucgugcacagagagagggagcuucauaaacagggaaaaugugccacgugugucuacaauaugauggguaaaagagagaaaaaacuaggagaguuuggaaaggcaaaaggaagucgugcaauaugguacaugugguugggagcacgcuuucuagaauuugaagcccuuggcuucaugaaugaagaccacugguucaguagggagaauucacucaguggaguggaaggagaaggacuacauaaacuuggauacauacucagagacauaucaaagauuccagggggaaauauguaugcagacgacacagcuggaugggacacaagaauaacagaggaugaucuucagaaugaggcuaaaaucaccgacaucauggagccugaacaugcucuacuggcuacgucaaucuucaagcugaccuaucaaaauaaggugguaagggugcaaagaccagcaaaaaguggaaccgugauggacgucauauccagacgugaccagagaggaaguggacaggucggaacuuauggccuaaacacuuucaccaacauggagguccaacuaauaagacaaauggaaucugaaggaaucuuuucacccagcgaauuggaaaauucaaaucuagcugagagaguucucgacugguuggaaaaacauggcgucgaaagguugaaaagaauggcaaucagcggagaugacuguguggugaaaccaacugaugacagguucgcaacagcuuuaacagcccugaaugacaugggaaaggugagaaaagacauaccgcaaugggaaccuucaaaaggauggaaugacuggcagcaagugccuuucuguucacaccacuuccaccaacugauuaugaaggaugggagggagauaguggugccaugccgcaaccaagaugaacuugugggcagggccagaguaucacaaggcgccggguggagccugagagaaacugcuugccuaggcaagucauaugcacaaauguggcagcugauguacuuccacaggagagaccugagacuggcggcuaaugcuaucuguucagccguuccaguuaauugggucccaaccagccgcaccaccuggucgauccaugcccaccaucaauggaugacaacagaagacauguugucaguauggaauaggguuuggauagaggaaaacccauggauggaggacaaaacucauguauccagcugggaagauguuccauacuuaggaaaaagggaagaucaaugguguggaucucugauaggcuuaacagcaagagccaccugggccaccaacauacaaguggccauaaaccaagugagaaggcuuguugggaacgagaauuauuuagacuacaugacaucaaugaagagauucaagaaugagagugaucccgaaggagcccucugguaa

SEQ ID NO: 6306 - RNA, 9879 nt, Artificial Sequence
  derived and/or modified CDS sequence (wt) from DENV-1__KM403621__SS-prME
uccgugaccaugcuccucaugcugcugcccacagcccuggcguuccauuugaccacacgagggggagagccacacaugauaguuagcaagcaggaaagaggaaagucacucuuguuuaagaccucugcaggugucaacaugugcacccucauugcaauggauuugggagaguuaugugaggauacaaugaccuacaaaugcccccggaucacugaagcggaaccagaugauguugauugcuggugcaaugccacagacacaugggugaccuaugggacguguucucagacuggcgaacaccgacgggauaaacguucugucgcauuggccccacacguggggcuuggucucgaaacaagaaccgaaacguggauguccucugaaggcgccuggaggcagauacaaaaaguggagacuugggccuugagacacccaggauucacggugauagcccuuuuuuuagcacaugccauaggaacauccauuacccagaaagggaucaucuucauuuugcugaugcuggugacaccaucaauggccaugcgaugcgugggaauaggcaacagagacuucguugaaggacugucaggagcaacauggguggaugugguacuggagcauggaagcugugucaccaccauggcaaagaauaaaccaacauuggacauugaacucuugaagacggaggucacgaacccugccgucuugcgcaaacugugcauugaagcuaaaauaucaaacaccaccaccgauucaagauguccaacacaaggagaagcuacacugguggaagaacaagacgcgaacuuugugugucgacgaacauucguggacagaggcugggguaaugguuguggacuauucgggaagggaagcuuacuaacgugugcuaaguuuaagugugugacaaaacuugaaggaaagauaguucaauaugaaaacuuaaaauauucggugauagucacuguccacacuggggaucagcaccagguaggaaaugagacuacagaacauggaacaauugcaaccauaacaccucaagcucccacgucggaaauacagcugacugacuacggagcccuuacauuggacugcucaccuagaacagggcuggacuuuaaugagauggugcuguugacaaugaaagaaaaaucauggcuuguccacaaacaaugguuucuagacuuaccauugccuuggaccucgggggcuucaacaucucaagagacuuggaacagacaagaucugcuggucacauuuaagacagcucaugcaaagaagcaggaaguagucguacuggggucacaagaaggagcaaugcacacugcguugacuggggcgacagaaauccagacgucaggaacgacgacaaucuucgcaggacaccugaaauguagacuaaaaauggauaaacugacuuuaaaaggggugucauaugugaugugcacaggcucauuuaagcuagagaaggaaguggcugagacccagcauggaacuguccuagugcagguuaaauaugaaggaacagaugcaccaugcaagauuccaauuucaacccaagaugagaaaggagugacccagaaugggagauugauaacagccaaucccauaguuacugacaaagaaaaaccagucaacauugaaacagaaccacccuuuggugagagcuacaucgugauaggggcgggugaaaaagcuuugaaacuaagcugguucaagaaaggaagcagcauagggaaaauguucgaagccaccgcccgaggagcgcgaaggauggcuauccugggagacacagcaugggacuucgguuccauaggagggguguucacaucugugggaaaauugguacaccagguuuuuggaaccgcauaugggguccuguucagcgguguuucuuggaccaugaaaauaggaauagggauucugcugacauggcuaggauugaauucaaggagcacgucacucucgaugacgugcauugcaguuggcauggucacacuguaccuaggagucaugguucaagcggacucggggugugugaucaacuggaagggcagagaacucaaguguggaaguggcaucuuugucacuaaugaaguccacacuuggacagagcaauacaaauuucaggcugacuccccaaaaagacuaucagcagccauugggaaggcaugggaggaaggcguguguggaauucgaucagccacacgucuugagaacaucauguggaagcaaauaucaaaugaauugaaccacauucuacuugaaaaugacaugaaauucacagugguuguaggagacgccaauggaaucuugacccaaggaaaaaagaugauuaggccacaacccauggaacacaaauacucauggaaaagcuggggaaaagccaaaaucauaggagcagauacacagaauacuaccuucaucaucgauggcccagacacuccagaaugccccgaugaccagagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaacgagaccuggaagcuagcgagagccuccuucauagaagugaagacaugcaucuggccaagaucccacacucuauggagcaauggagucuuggaaagugaaaugauaaucccaaagauauauggaggaccaauaucucagcacaacuacagaccaggguauuucacacaaacagcagggccauggcaccuaggcaaguuggaacuagacuuuaauuugugugaaggcaccacaguuguuguggaugaacauuguggaaaucgagguccaucucuuagaacuacaacagucacaggaaagauaauccaugaauggugcugcagauccugcacgcuaccccccuuacgcuucagaggagaagacggauguugguauggcauggaaaucagaccaguuaaggagaaggaagagaaucuagucaggucaauggucucugcagggucaggagaaguggacaguuuuucauugggacuacuaugcguaucaauaaugauugaagaagugaugagauccagauggaguagaaagaugcugaugacuggaacacuggcuguuuucuuccuucuuauaaugggacaacugacauggaaugaucugaucagguuaugcaucaugguuggagccaaugucucagacagaauggggaugggaacaacguaccuagcuuuaauggccacuuuuaaaaugagaccgauguucgcuguugggcuauuauuucgcagacuaacauccagagaggugcuccuucucacaauuggacuaagccugguggcauccguggagcuaccaaauucuuuagaggagcuaggggacggacuugcgaugggcaucaugauguuaaaauuguugacugacuuucagucacaccaguuguggacuaccuuacugucucugacauucaucaaaacaacucuuucacuggauuaugcauggaagacaauggcuaugguauugucaaucguaucucucuuuccucuaugucuauccacgaccucucaaaaaacaacauggcuuccgguguuguuaggauccuuuggauguaaaccacuaaccauguuucuuauaacagaaaacaaaauuuggggaaggaaaaguuggccccucaaugaaggaauuauggcuguuggaauagucagcauuuuacuaaguucacuccucaaaaaugacgugccacuagccggcccacuaauagcuggaggcaugcugauagcauguuacgucauuuccggaagcucagccgauuuaucauuggagagagcggcugaggucuccugggaagaagaagcagaacacucuggugccucacacaacauacuaguggagguccaagaugauggaacuaugaaaauaaaagaugaagagagagaugacacgcucacuauacuccucaaagcaacuuuguuggcaguuucagggguguacccaaugucaauaccagcaacccuuuuugugugguauuuuuggcagaaaaagaaacagagaucaggagucuugugggacacacccagcccuccagaaguagaaagagcaguucuugaugaugguaucuauagaaucuugcaaagaggacuguuggguaggucccagguaggagugggaguuuuucaagacggcguguuccacacaauguggcaugucaccaggggggcuguccucauguaccaagggaagaggcuggaaccaaguugggccagugucaaaaaagacuugaucucauauggaggagguuggagguuucaaggaucauggaacacgggagaagaaguacaggugauagcuguugaaccagggaaaaacccaaagaauguacagacaacgccgggcacuuucaagaccccugaaggcgaaguuggagccauagcccuagauuucaaaccuggcacaucuggaucucccaucgugaacagagaggggaaaauaguaggucuuuauggaaauggaguggugacaacaaguggaaccuacgucagugccauugcccaagcuaaagcgucacaagaagggccucuaccagagauugaggacgagguguuuaagaaaagaaaccuaacaauaauggaccuacauccaggaucaggaaaaacaagaagauaucuuccagccauaguccgugaggccauaaaaaggaaacugcgcacgcuaaucuuggcucccacaagaguugucgccucugaaauggcagaggcgcuuaaaggaaugccaauaagauaucagacaacagcaguaaagagugaacacacaggaaaggagauagucgaucucaugugccacgccacuuucaccaugcgucuccuaucuccagugagaguucccaauuacaacaugauuaucauggaugaagcacacuuuaccgauccagccagcauagcggccagaggguacaucucaacccgaguggguaugggugaagcagcugcgaucuuuaugacagccacucccccaggaucgguagaguccuuuccacagagcaaugcaguuauccaagaugaggaaagagacauuccugagagaucauggaacucaggcuacgacuggaucacugacuucccaggaaaaacagucugguuuguuccaagcaucaaaucaggaaaugacauugccaacugcuuaagaaaaaacgggaaacgggugauccaauugagcagaaaaaccuuugacacugaauaccagaaaacgaaaaacaaugauugggacuauguugucacaacagacauuuccgaaaugggagcaaauuuccgggccgauaggguaauagacccaaggcggugcuugaagccgguaauacuaaaagauggcccagagcgcgucauucuggccggaccaaugccagugaccgcggccagugcugcccagaggagaggaagaauuggaaggaaccaaaacaaggaaggugaccaguauauuuacaugggacagccuuuaaauaaugaugaggaccacgcucauuggacagaagcaaaaaugcuccuugacaauauaaauacgccagaagggauuaucccagcccucuuugagccagagagagaaaagagugcagcaauagacggggaguauagacugcggggagaagcaaggaaaacguucguggagcuaaugagaagaggggaucuaccaguuuggcuaucuuacaaaguugccucagaaggcuuccaguacuccgacagaagauggugcuuugacggggaaaggaacaaccagguguuggaggagaacauggacguggagaucuggacaaaagaaggagaaagaaagaaauugcgaccucgcugguuagaugccagaaccuacucugauccacuggcccugcgcgaguuuaaagaguucgcagcaggaagaagaagugucucaggugaccuaauauuagaaauagggaaacucccacagcauuugacgcuaagggcccagaaugcuuuggacaacuuggucauguugcacaauuccgaacaagggggaaaagccuauagacaugcuauggaagaacuaccagacaccauagaaacauugaugcuacuagccuugauagcugugcugacugguggaguuacguuguuuuuccuaucaggaaaaggucuagggaaaacauccauuggccuacuuuguguaauggccucaaguguacuguuauggauggccaguguggagccccauuggauagcggccuccaucauacuagaguuuuuucugauggugcugcuuauuccagagccagacagacagcguacuccacaggacaaucaacuagcauauguggugauagguuuguuauucaugauauugacaguggcagccaaugagaugggauuacuggaaaccacaaagaaagaccuggggauuggccauguagucgccgaaaaccaccaccaugccacaaugcuagacauagacuuacauccagcuucagccuggacccucuaugcaguagccacaacaauuaucacucccaugaugagacacacaauugaaaacacaacggcaaacauuucccugacagcuauugcaaaucaggcggcuauauuaaugggacuugacaagggauggccaauaucgaagauggacauaggagugccacuucucgccuuagggugcuauucccaggugaacccauugacacugacagcggcgguguuaauguuaguggcucauuaugccauaaucggaccuggacugcaagcaaaagcuaccagagaagcccaaaaaaggacugcggccggaauaaugaaaaauccaacuguagacgggauuguugcaauagauuuggauccugugguuuaugaugcaaaauuugaaaaacagcuaggccaaauaauguuacuaauacucugcacaucacagauucucuugaugcggacuacaugggccuuaugugaaucuaucacacuggcuacuggacccuugaccacucucugggagggaucuccuggaaaauucuggaauaccacgauagcaguguccauggcaaacaucuucaggggaaguuauuuagcaggggcaggucuggccuucucauuaaugaaaucuuuaggaggagguaggagagguacgggagcucaaggggaaacauugggagaaaaauggaaaagacaacuaaaccaacugagcaagucagaauuuaacacuuacaaaaggaguggaauuauggagguggacagauccgaagccaaggagggacugaaaagaggagaaacaaccaaacaugcagugucgagaggaacagccaaacuuaggugguuuguggagaggaaccuugugaaaccggaagggaaagugauagaccucgguuguggaagagguggcuggucauauuacugcgcugggcugaagaaggucacagaaguaaagggauacacaaaaggaggacccggucaugaggaaccuaucccaauggcgacuuauggauggaacauagugaagcuacacucuggaagggauguauucuuuacaccaccugagaaaugugacacccuuuugugugauauuggugaguccucuccgaauccaacuauagaagaaggaagaacguuacguguucuaaagaugguggaaccauggcucagaggaaaucaguuuugcauaaaaauccuaaauccuuauaugccaagugugguagaaacucuggagcaaaugcaaagaaaacauggagggaugcuagugcgaaacccacucucaagaaauuccacccaugaaauguacugggucucauguggaacaggaaacauugugucggcagugaacaugacauccagaaugcugcugaaucgguucacaauggcucacaggaagccaacguaugaaagagacguggacuugggcgcuggaacaagacauguggcaguggaaccagagauagccaaccuagacauuauuggccagaggauagagaacauaaaaaaugaacauaagucaacauggcauuaugaugaggacaauccauacaaaacaugggccuaucauggaucauaugaggucaagccaucagggucagccucauccauggugaauggcguggugagauugcucaccaagccaugggauguuauccccauggucacacaaauagcuaugacugauaccacacccuucggacaacagaggguuuucaaagagaaaguugacacacgcacaccaagaccaaaacgaggcacagcacaaauuauggaggugacagccaagugguuguggggauuccucucuagaaauaaaaaacccagaaucugcacaagagaggaguucacaagaaaaguuaggucaaacgcagcaauuggagcaguguuuguugaugaaaaccaauggaacucagcaaaagaagcaguggaagacgaaagguuuugggaccucgugcacagagagagggagcuucauaaacagggaaaaugugccacgugugucuacaauaugauggguaaaagagagaaaaaacuaggagaguuuggaaaggcaaaaggaagucgugcaauaugguacaugugguugggagcacgcuuucuagaauuugaagcccuuggcuucaugaaugaagaccacugguucaguagggagaauucacucaguggaguggaaggagaaggacuacauaaacuuggauacauacucagagacauaucaaagauuccagggggaaauauguaugcagacgacacagcuggaugggacacaagaauaacagaggaugaucuucagaaugaggcuaaaaucaccgacaucauggagccugaacaugcucuacuggcuacgucaaucuucaagcugaccuaucaaaauaaggugguaagggugcaaagaccagcaaaaaguggaaccgugauggacgucauauccagacgugaccagagaggaaguggacaggucggaacuuauggccuaaacacuuucaccaacauggagguccaacuaauaagacaaauggaaucugaaggaaucuuuucacccagcgaauuggaaaauucaaaucuagcugagagaguucucgacugguuggaaaaacauggcgucgaaagguugaaaagaauggcaaucagcggagaugacuguguggugaaaccaacugaugacagguucgcaacagcuuuaacagcccugaaugacaugggaaaggugagaaaagacauaccgcaaugggaaccuucaaaaggauggaaugacuggcagcaagugccuuucuguucacaccacuuccaccaacugauuaugaaggaugggagggagauaguggugccaugccgcaaccaagaugaacuugugggcagggccagaguaucacaaggcgccggguggagccugagagaaacugcuugccuaggcaagucauaugcacaaauguggcagcugauguacuuccacaggagagaccugagacuggcggcuaaugcuaucuguucagccguuccaguuaauugggucccaaccagccgcaccaccuggucgauccaugcccaccaucaauggaugacaacagaagacauguugucaguauggaauaggguuuggauagaggaaaacccauggauggaggacaaaacucauguauccagcugggaagauguuccauacuuaggaaaaagggaagaucaaugguguggaucucugauaggcuuaacagcaagagccaccugggccaccaacauacaaguggccauaaaccaagugagaaggcuuauugggaacgagaauuauuuagacuacaugacaucaaugaagagauucaagaaugagagugaucccgaaggagcccucugguaa

SEQ ID NO: 6307 - RNA, 9879 nt, Artificial Sequence
  derived and/or modified CDS sequence (wt) from DENV-1__KM403623__SS-prME
uccgugaccaugcuccucaugcugcugcccacagcccuggcguuccauuugaccacacgagggggagagccacacaugauaguuagcaagcaggaaagaggaaagucacucuuguuuaagaccucugcaggugucaacaugugcacccucauugcaauggauuugggagaguuaugugaggauacaaugaccuacaaaugcccccggaucacugaagcggaaccagaugauguugauugcuggugcaaugccacagacacaugggugaccuaugggacguguucucagacuggcgaacaccgacgggauaaacguucugucgcauuggccccacacguggggcuuggucucgaaacaagaaccgaaacguggauguccucugaaggcgccuggaggcagauacaaaaaguggagacuugggccuugagacacccaggauucacggugauagccuuuuuuuuagcacaugccauaggaacauccauuacccagaaagggaucaucuucauuuugcugaugcuggugacaccaucaauggccaugcgaugcgugggaauaggcaacagagacuucguugaaggacugucaggagcaacauggguggaugugguacuggagcauggaagcugugucaccaccauggcaaagaauaaaccaacauuggacauugaacucuugaagacggaggucacgaacccugccgucuugcgcaaacugugcauugaagcuaaaauaucaaacaccaccaccgauucaagauguccaacacaaggagaagcuacacugguggaagaacaagacgcgaacuuugugugucgacgaacauucguggacagaggcugggguaaugguuguggacuauucgggaagggaagcuuacuaacgugugcuaaguuuaagugugugacaaaacuugaaggaaagauaguucaauaugaaaacuuaaaauauucggugauagucacuguccacacuggggaucagcaccagguaggaaaugagacuacagaacauggaacaauugcaaccauaacaccucaagcucccacgucggaaauacagcugacugacuacggagcccuuacauuggacugcucaccuagaacagggcuggacuuuaaugagauggugcuguugacaaugaaagaaaaaucauggcuuguccacaaacaaugguuucuagacuuaccauugccuuggaccucgggggcuucaacaucucaagagacuuggaacagacaagaucugcuggucacauuuaagacagcucaugcaaagaagcaggaaguggucguacuggggucacaagaaggagcaaugcacacugcguugacuggggcgacagaaauccagacgucaggaacgacgacaaucuucgcaggacaccugaaauguagacuaaaaauggauaaacugacuuuaaaaggggugucauaugugaugugcacaggcucauuuaagcuagagaaggaaguggcugagacccagcauggaacuguccuagugcagguuaaauaugaaggaacagaugcaccaugcaagauuccaauuucaacccaagaugagaaaggagugacccagaaugggagauugauaacagccaaucccauaguuacugacaaagaaaaaccagucaacauugaaacagaaccacccuuuggugagagcuacaucgugauaggggcgggugaaaaagcuuugaaacuaagcugguucaagaaaggaagcagcauagggaaaauguucgaagccaccgcccgaggagcgcgaaggauggcuauccugggagacacagcaugggacuucgguuccauaggagggguguucacaucugugggaaaauugguacaccagguuuuuggaaccgcauaugggguccuguucagcgguguuuccuggaccaugaaaauaggaauagggauucugcugacauggcuaggauugaauucaaggagcacgucacucucgaugacgugcauugcaguuggcauggucacacuguaccuaggagucaugguucaagcggacucggggugugugaucaacuggaagggcagagaacucaaguguggaaguggcaucuuugucacuaaugaaguccacacuuggacagagcaauacaaauuucaggcugacuccccaaaaagacuaucagcagccauugggaaggcaugggaggaaggcguguguggaauucgaucagccacacgucuugagaacaucauguggaagcaaauaucaaaugaauugaaccacauucuacuugaaaaugacaugaaauucacagugguuguaggagacgccaauggaaucuugacccaaggaaaaaagaugauuaggccacaacccauggaacacaaauacucauggaaaagcuggggaaaagccaaaaucauaggagcagauacacagaauacuaccuucaucaucgauggcccagacacuccagaaugccccgaugaccagagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaacgagaccuggaagcuagcgagagccuccuucauagaagugaagacaugcaucuggccaagaucccacacucuauggagcaauggagucuuggaaagugaaaugauaaucccaaagauauauggaggaccaauaucucagcacaacuacagaccaggguauuucacacaaacagcagggccauggcaccuaggcaaguuggaacuagacuuuaauuugugugaaggcaccacaguuguuguggaugaacauuguggaaaucgagguccaucucuuagaacuacaacagucacaggaaagauaauccaugaauggugcugcagauccugcacgcuaccccccuuacgcuucagaggagaagacggauguugguauggcauggaaaucagaccaguuaaggagaaggaagagaaucuagucaggucaauggucucugcagggucaggagaaguggacaguuuuucauugggacuacuaugcguaucaauaaugauugaagaagugaugagauccagauggaguagaaagaugcugaugacuggaacacuggcuguuuucuuccuucuuauaaugggacaacugacauggaaugaucugaucagguuaugcaucaugguuggagccaaugucucagacagaauggggaugggaacaacguaccuagcuuuaauggccacuuuuaaaaugagaccgauguucgcuguugggcuauuauuucgcagacuaacauccagagaggugcuccuucucacaauuggacuaagccugguggcauccguggagcuaccaaauucuuuagaggagcuaggggacggacuugcgaugggcaucaugauguuaaaauuguugacugacuuucagucacaccaguuguggacuaccuuacugucucugacauucaucaaaacaacucuuucacuggauuaugcauggaagacaauggcuaugguauugucaaucguaucucucuuuccucuaugucuauccacgaccucucaaaaaacaacauggcuuccgguguuguuaggauccuuuggauguaaaccacuaaccauguuucuuauaacagaaaacaaaauuuggggaaggaaaaguuggccccucaaugaaggaauuauggcuguuggaauagucagcauuuuacuaaguucacuccucaaaaaugacgugccacuagccggcccacuaauagcuggaggcaugcugauagcauguuacgucauuuccggaagcucagccgauuuaucauuggagagagcggcugaggucuccugggaagaagaagcagaacacucuggugccucacacaacauacuaguggagguccaagaugauggaacuaugaaaauaaaagaugaagagagagaugacacgcucacuauacuccucaaagcaacuuuguuggcaguuucagggguguacccaaugucaauaccagcaacccuuuuugugugguauuuuuggcagaaaaagaaacagagaucaggagucuugugggacacacccagcccuccagaaguagaaagagcaguucuugaugaugguaucuauagaaucuugcaaagaggacuguuggguaggucccagguaggagugggaguuuuucaagacggcguguuccacacaauguggcaugucaccaggggggcuguccucauguaccaagggaagaggcuggaaccaaguugggccagugucaaaaaagacuugaucucauauggaggagguuggagguuucaaggaucauggaacacgggagaagaaguacaggugauagcuguugaaccagggaaaaacccaaagaauguacagacaacgccgggcacuuucaagaccccugaaggcgaaguuggagccauagcccuggauuucaaaccuggcacaucuggaucucccaucgugaacagagaggggaaaauaguaggucuuuauggaaauggaguggugacaacaaguggaaccuacgucagugccauugcccaagcuaaagcgucacaagaagggccucuaccagagauugaggacgagguguuuaagaaaagaaaccuaacaauaauggaccuacauccaggaucaggaaaaacaagaagauaucuuccagccauaguccgugaggccauaaaaaggaaacugcgcacgcuaaucuuggcucccacaagaguugucgccucugaaauggcagaggcgcuuaaaggaaugccaauaagauaucagacaacagcaguaaagagugaacacacaggaaaggagauagucgaucucaugugccacgccacuuucaccaugcgucuccuaucuccagugagaguucccaauuacaacaugauuaucauggaugaagcacacuuuaccgauccagccagcauagcggccagaggguacaucucaacccgaguggguaugggugaagcagcugcgaucuuuaugacagccacucccccaggaucgguagaguccuuuccacagagcaaugcaguuauccaagaugaggaaagagacauuccugagagaucauggaacucaggcuacgacuggaucacugacuucccaggaaaaacagucugguuuguuccaagcaucaaaucaggaaaugacauugccaacugcuuaagaaaaaacgggaaacgggugauccaauugagcagaaaaaccuuugacacugaauaccagaaaacgaaaaacaaugauugggacuauguugucacaacagacauuuccgaaaugggagcaaauuuccgggccgauaggguaauagacccaaggcggugcuugaagccgguaauacuaaaagauggcccagagcgcgucauucuggccggaccaaugccagugaccgcggccagugcugcccagaggagaggaagaauuggaaggaaccaaaacaaggaaggugaccaguauauuuacaugggacagccuuuaaauaaugaugaggaccacgcucauuggacagaagcaaaaaugcuccuugacaauauaaauacgccagaagggauuaucccagcccucuuugagccagagagagaaaagagugcagcaauagacggggaguauagacugcggggagaagcaaggaaaacguucguggagcuaaugagaagaggggaucuaccaguuuggcuaucuuacaaaguugccucagaaggcuuccaguacuccgacagaagauggugcuuugacggggaaaggaacaaccagguguuggaggagaacauggacguggagaucuggacaaaagaaggagaaagaaagaaauugcgaccucgcugguuagaugccagaaccuacucugauccacuggcccugcgcgaguuuaaagaguucgcagcaggaagaagaagugucucaggugaccuaauauuagaaauagggaaacucccacagcauuugacgcuaagggcccagaaugcuuuggacaacuuggucauguugcacaauuccgaacaagggggaaaagccuauagacaugcuauggaagaacuaccagacaccauagaaacauugaugcuacuagccuugauagcugugcugacugguggaguuacguuguuuuuccuaucaggaaaaggucuagggaaaacauccauuggccuacuuuguguaauggccucaaguguacuguuauggauggccaguguggagccccauuggauagcggccuccaucauacuagaguuuuuucugauggugcugcuuauuccagagccagacagacagcguacuccacaggacaaucaacuagcauauguggugauagguuuguuauucaugauauugacaguggcagccaaugagaugggauuacuggaaaccacaaagaaagaccuggggauuggccauguagucgccgaaaaccaccaccaugccacaaugcuagacauagacuuacauccagcuucagccuggacccucuaugcaguagccacaacaauuaucacucccaugaugagacacacaauugaaaacacaacggcaaacauuucccugacagcuauugcaaaucaggcggcuauauuaaugggacuugacaagggauggccaauaucgaagauggacauaggagugccacuucucgccuuagggugcuauucccaggugaacccauugacacugacagcggcgguguuaauguuaguggcucauuaugccauaaucggaccuggacugcaagcaaaagcuaccagagaagcccaaaaaaggacugcggccggaauaaugaaaaauccaacuguagacgggauuguugcaauagauuuggauccugugguuuaugaugcaaaauuugaaaaacagcuaggccaaauaauguuacuaauacucugcacaucacagauucucuugaugcggacuacaugggccuuaugugaaucuaucacacuggcuacuggacccuugaccacucucugggagggaucuccuggaaaauucuggaauaccacgauagcaguguccauggcaaacaucuucaggggaaguuauuuagcaggggcaggucuggccuucucauuaaugaaaucuuuaggaggagguaggagagguacgggagcucaaggggaaacauugggagaaaaauggaaaagacaacuaaaccaacugagcaagucagaauuuaacacuuacaaaaggaguggaauuauggagguggacagauccgaagccaaggagggacugaaaagaggagaaacaaccaaacaugcagugucgagaggaacagccaaacuuaggugguuuguggagaggaaccuugugaaaccggaagggaaagugauagaccucgguuguggaagagguggcuggucauauuacugcgcugggcugaagaaggucacagaaguaaagggauacacaaaaggaggacccggucaugaagaaccuaucccaauggcgacuuauggauggaacauagugaagcuacacucuggaagggauguauucuuuacaccaccugagaaaugugacacccuuuugugugauauuggugaguccucuccgaauccaacuauagaagaaggaagaacguuacguguucuaaagaugguggaaccauggcucagaggaaaucaguuuugcauaaaaauccuaaauccuuauaugccaagugugguagaaacucuggagcaaaugcaaagaaaacauggagggaugcuagugcgaaacccacucucaagaaauuccacccaugaaauguacugggucucauguggaacaggaaacauugugucggcagugaacaugacauccagaaugcugcugaaucgguucacaauggcucacaggaagccaacguaugaaagagacguggacuugggcgcuggaacaagacauguggcaguggaaccagagauagccaaccuagacauuauuggccagaggauagagaacauaaaaaaugaacauaagucaacauggcauuaugaugaggacaauccauacaaaacaugggccuaucauggaucauaugaggucaagccaucagggucagccucauccauggugaauggcguggugagauugcucaccaagccaugggauguuauccccauggucacacaaauagcuaugacugauaccacacccuucggacaacagaggguuuucaaagagaaaguugacacacgcacaccaagaccaaaacgaggcacagcacaaauuauggaggugacagccaagugguuguggggauuccucucuagaaauaaaaaacccagaaucugcacaagagaggaguucacaagaaaaguuaggucaaacgcagcaauuggagcaguguuuguugaugaaaaccaauggaacucagcaaaagaagcaguggaagacgaaagguuuugggaccucgugcacagagagagggagcuucauaaacagggaaaaugugccacgugugucuacaauaugauggguaaaagagagaaaaaacuaggagaguuuggaaaggcaaaaggaagucgugcaauaugguacaugugguugggagcacgcuuucuagaauuugaagcccuuggcuucaugaaugaagaccacugguucaguagggagaauucacucaguggaguggaaggagaaggacuacauaaacuuggauacauacucagagacauaucaaagauuccagggggaaauauguaugcagacgacacagcuggaugggacacaagaauaacagaggaugaucuucagaaugaggcuaaaaucaccgacaucauggagccugaacaugcucuacuggcuacgucaaucuucaagcugaccuaucaaaauaaggugguaagggugcaaagaccagcaaaaaguggaaccgugauggacgucauauccagacgugaccagagaggaaguggacaggucggaacuuauggccuaaacacuuucaccaacauggagguccaacuaauaagacaaauggaaucugaaggaaucuuuucacccagcgaauuggaaaauucaaaucuagcugagagaguucucgacugguuggaaaaacauggcgucgaaagguugaaaagaauggcaaucagcggagaugacuguguggugaaaccaacugaugacagguucgcaacagcuuuaacagcccugaaugacaugggaaaggugagaaaagacauaccgcaaugggaaccuucaaaaggauggaaugacuggcagcaagugccuuucuguucacaccacuuccaccaacugauuaugaaggaugggagggagauaguggugccaugccgcaaccaagaugaacuugugggcagggccagaguaucacaaggcgccggguggagccugagagaaacugcuugccuaggcaagucauaugcacaaauguggcagcugauguacuuccacaggagagaccugagacuggcggcuaaugcuaucuguucagccguuccaguuaauugggucccaaccagccgcaccaccuggucgauccaugcccaccaucaauggaugacaacagaagacauguugucaguauggaauaggguuuggauagaggaaaacccauggauggaggacaaaacucauguauccagcugggaagauguuccauacuuaggaaaaagggaagaucaaugguguggaucucugauaggcuuaacagcaagagccaccugggccaccaacauacaaguggccauaaaccaagugagaaggcuuauugggaacgagaauuauuuagacuacaugacaucaaugaagagauucaagaaugagagugaucccgaaggagcccucugguaa

SEQ ID NO: 6308 - RNA, 9879 nt, Artificial Sequence
  derived and/or modified CDS sequence (wt) from DENV-1__KM403575__SS-prME
uccgugaccaugcuccucaugcugcugcccacagcccuggcguuccauuugaccacacgagggggagagccacacaugauaguuagcaagcaggaaagaggaaagucacucuuguuuaagaccucugcaggugucaacaugugcacccucauugcaauggauuugggagaguuaugugaggauacaaugaccuacaaaugcccccggaucacugaagcggaaccagaugauguugauugcuggugcaaugccacagacacaugggugaccuaugggacguguucucagacuggcgaacaccgacgggauaaacguucugucgcauuggccccacacguggggcuuggucucgaaacaagaaccgaaacguggauguccucugaaggcgccuggaggcagauacaaaaaguggagacuugggccuugagacacccaggauucacggugauagcccuuuuuuuagcacaugccauaggaacauccauuacccagaaagggaucaucuucauuuugcugaugcuggugacaccaucaauggccaugcgaugcgugggaauaggcaacagagacuucguugaaggacugucaggagcaacauggguggaugugguacuggagcauggaagcugugucaccaccauggcaaagaauaaaccaacauuggacauugaacucuugaagacggaggucacgaacccugccgucuugcgcaaacugugcauugaagcuaaaauaucaaacaccaccaccgauucaagauguccaacacaaggagaagcuacacugguggaagaacaagacgcgaacuuugugugucgacgaacauucguggacagaggcugggguaaugguuguggacuauucgggaagggaagcuuacuaacgugugcuaaguuuaagugugugacaaaacuugaaggaaagauaguucaauaugaaaacuuaaaauauucggugauagucacuguccacacuggggaccagcaccagguaggaaaugagacuacagaacauggaacaauugcaaccauaacaccucaagcucccacgucggaaauacagcugacugacuacggagcccuuacauuggacugcucaccuagaacagggcuggacuuuaaugagauggugcuguugacaaugaaagaaaaaucauggcuuguccacaaacaaugguuucuagacuuaccauugccuuggaccucgggggcuucaacaucucaagagacuuggaacagacaagaucugcuggucacauuuaagacagcucaugcaaagaagcaggaaguagucguacuggggucacaagaaggagcaaugcacacugcguugacuggggcgacagaaauccagacgucaggaacgacgacaaucuucgcaggacaccugaaauguagacuaaaaauggauaaacugacuuuaaaaggggugucauaugugaugugcacaggcucauuuaagcuagagaaggaaguggcugagacccagcauggaacuguccuagugcagguuaaauaugaaggaacagaugcaccaugcaagauuccaauuucaacccaagaugagaaaggagugacccagaaugggagauugauaacagccaaucccauaguuacugacaaagaaaaaccagucaacauugaaacagaaccacccuuuggugagagcuacaucgugauaggggcgggugaaaaagcuuugaaacuaagcugguucaagaaaggaagcagcauagggaaaauguucgaagccaccgcccgaggagcacgaaggauggcuauccugggagacacagcaugggacuucgguuccauaggagggguguucacaucugugggaaaauugguacaccagguuuuuggaaccgcauaugggguccuguucagcgguguuucuuggaccaugaaaauaggaauagggauucugcugacauggcuaggauugaauucaaggagcacgucacucucgaugacgugcauugcaguuggcauggucacacuguaccuaggagucaugguucaagcggacucggggugugugaucaacuggaagggcagagaacucaaguguggaaguggcaucuuugucacuaaugaaguccacacuuggacagagcaauacaaauuucaggcugacuccccaaaaagacuaucagcagccauugggaaggcaugggaggaaggcguguguggaauucgaucagccacacgucuugagaacaucauguggaagcaaauaucaaaugaauugaaccacauucuacuugaaaaugacaugaaauucacagugguuguaggagacgccaauggaaucuugacccaaggaaaaaagaugauuaggccacaacccauggaacacaaauacucauggaaaagcuggggaaaagccaaaaucauaggagcagauacacagaauacuaccuucaucaucgauggcccagacacuccagaaugccccgaugaccagagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaacgagaccuggaagcuagcgagagccuccuucauagaagugaagacaugcaucuggccaagaucccacacucuauggagcaauggagucuuggaaagugaaaugauaaucccaaagauauauggaggaccaauaucucagcacaacuacagaccaggguauuucacacaaacagcagggccauggcaccuaggcaaguuggaacuagacuuuaauuugugugaaggcaccacaguuguuguggaugaacauuguggaaaucgagguccaucucuuagaacuacaacagucacaggaaagauaauccaugaauggugcugcagauccugcacgcuaccccccuuacgcuucagaggagaagacggauguugguauggcauggaaaucagaccaguuaaggagaaggaagagaaucuagucaggucaauggucucugcagggucaggagaaguggacaguuuuucauugggacuacuaugcguaucaauaaugauugaagaagugaugagauccagauggaguagaaagaugcugaugacuggaacacuggcuguuuucuuccuucuuauaaugggacaacugacauggaaugaucugaucagguuaugcaucaugguuggagccaaugucucagacagaauggggaugggaacaacguaccuagcuuuaauggccacuuuuaaaaugagaccgauguucgcuguugggcuauuauuucgcagacuaacauccagagaggugcuccuucucacaauuggacuaagccugguggcauccguggagcuaccaaauucuuuagaggagcuaggggacggacuugcgaugggcaucaugauguuaaaauuguugacugauuuucagucacaccaguuguggacuaccuuacugucucugacauucaucaaaacaacucuuucacuggauuaugcauggaagacaauggcuaugguauugucaaucguaucucucuuuccucuaugucuauccacgaccucucaaaaaacaacauggcuuccgguguuguuaggauccuuuggauguaaaccacuaaccauguuucuuauaacagaaaacaaaauuuggggaaggaaaaguuggccccucaaugaaggaauuauggcuguuggaauagucagcauuuuacuaaguucacuccucaaaaaugacgugccacuagccggcccacuaauagcuggaggcaugcugauagcauguuacgucauuuccggaagcucagccgauuuaucauuggagagagcggcugaggucuccugggaagaagaagcagaacacucuggugccucacacaacauacuaguggagguccaagaugauggaacuaugaaaauaaaagaugaagagagagaugacacgcucacuauacuccucaaagcaacuuuguuggcaguuucagggguguacccaaugucaauaccagcaacccuuuuugugugguauuuuuggcagaaaaagaaacagagaucaggagucuugugggacacacccagcccuccagaaguagaaagagcaguucuugaugaugguaucuauagaaucuugcaaagaggacuguuggguaggucccagguaggagugggaguuuuucaagacggcguguuccacacaauguggcaugucaccaggggggcuguccucauguaccaagggaagaggcuggaaccaaguugggccagugucaaaaaagacuugaucucauauggaggagguuggagguuucaaggaucauggaacacgggagaagaaguacaggugauagcuguugaaccagggaaaaacccaaagaauguacagacaacgccgggcaccuucaagaccccugaaggcgaaguuggagccauagcccuagauuucaaaccuggcacaucuggaucucccaucgugaacagagaggggaaaauaguaggucuuuauggaaauggaguggugacaacaaguggaaccuacgucagugccauugcccaagcuaaagcgucacaagaagggccucuaccagagauugaggacgagguguuuaagaaaagaaaccuaacaauaauggaccuacauccaggaucaggaaaaacaagaagauaucuuccagccauaguccgugaggccauaaaaaggaaacugcgcacgcuaaucuuggcucccacaagaguugucgccucugaaauggcagaggcgcuuaaaggaaugccaauaagauaucagacaacagcaguaaagagugaacacacaggaaaggagauagucgaucucaugugccacgccacuuucaccaugcgucuccuaucuccagugagaguucccaauuacaacaugauuaucauggaugaagcacacuuuaccgauccagccagcauagcggccagaggguacaucucaacccgaguggguaugggugaagcagcugcgaucuuuaugacagccacucccccaggaucgguagaggccuuuccacagagcaaugcaguuauccaagaugaggaaagagacauuccugagagaucauggaacucaggcuacgacuggaucacugacuucccaggaaaaacagucugguuuguuccaagcaucaaaucaggaaaugacauugccaacugcuuaagaaaaaacgggaaacgggugauccaauugagcagaaaaaccuuugacacugaauaccagaaaacgaaaaacaaugauugggacuauguugucacaacagacauuuccgaaaugggagcaaauuuccgggccgauaggguaauagacccaaggcggugcuugaagccgguaauacuaaaagauggcccagagcgcgucauucuggccggaccaaugccagugaccgcggccagugcugcccagaggagaggaagaauuggaaggaaccaaaacaaggaaggugaccaguauauuuacaugggacagccuuuaaauaaugaugaggaccacgcucauuggacagaagcaaaaaugcuccuugacaauauaaauacgccagaagggauuaucccagcccucuuugagccagagagagaaaagagugcagcaauagacggggaguauagacugcggggagaagcaaggaaaacguucguggagcuaaugagaagaggggaucuaccaguuuggcuaucuuacaaaguugccucagaaggcuuccaguacuccgacagaagauggugcuuugacggggaaaggaacaaccagguguuggaggagaacauggacguggagaucuggacaaaagaaggagaaagaaagaaauugcgaccucgcugguuagaugccagaaccuacucugauccacuggcccugcgcgaguuuaaagaguucgcagcaggaagaagaagugucucaggugaccuaauauuagaaauagggaaacucccacagcauuugacgcuaagggcccagaaugcuuuggacaacuuggucauguugcacaauuccgaacaagggggaaaagccuauagacaugcuauggaagaacuaccagacaccauagaaacauugaugcuacuagccuugauagcugugcugacugguggaguuacguuguuuuuccuaucaggaaaaggucuagggaaaacauccauuggccuacuuuguguaauggccucaaguguacuguuauggauggccaguguggagccccauuggauagcggccuccaucauacuagaguuuuuucugauggugcugcuuauuccagagccagacagacagcguacuccacaggacaaucaacuagcauauguggugauagguuuguuauucaugauauugacaguggcagccaaugagaugggauuacuggaaaccacaaagaaagaccuggggauuggccauguagucgccgaaaaccaccaccaugccacaaugcuagacauagacuuacauccagcuucagccuggacccucuaugcaguagccacaacaauuaucacucccaugaugagacacacaauugaaaacacaacggcaaacauuucccugacagcuauugcaaaucaggcggcuauauuaaugggacuugacaagggauggccaauaucgaagauggacauaggagugccacuucucgccuuagggugcuauucccaggugaacccauugacacugacagcggcgguguuaauguuaguggcucauuaugccauaaucggaccuggacugcaagcaaaagcuaccagagaagcccaaaaaaggacugcggccggaauaaugaaaaauccaacuguagacgggauuguugcaauagauuuggauccugugguuuaugaugcaaaauuugaaaaacagcuaggccaaauaauguuacuaauacucugcacaucacagauucucuugaugcggacuacaugggccuuaugugaaucuaucacacuggcuacuggacccuugaccacucucugggagggaucuccuggaaaauucuggaauaccacgauagcaguguccauggcaaacaucuucaggggaaguuauuuagcaggggcaggucuggccuucucauuaaugaaaucuuuaggaggagguaggagagguacgggagcucaaggggaaacauugggagaaaaauggaaaagacaacuaaaccaacugagcaagucagaauuuaacacuuacaaaaggaguggaauuauggagguggacagauccgaagccaaggagggacugaaaagaggagaaacaaccaaacaugcagugucgagaggaacagccaaacuuaggugguuuguggagaggaaccuugugaaaccggaagggaaagugauagaccucgguuguggaagagguggcuggucauauuacugcgcugggcugaagaaggucacagaaguaaagggauacacaaaaggaggacccggucaugaggaaccuaucccaauggcgacuuauggauggaacauagugaagcuacacucuggaagggauguauucuuuacaccaccugagaaaugugacacccuuuugugugauauuggugaguccucuccgaauccaacuauagaagaaggaagaacguuacguguucuaaagaugguggaaccauggcucagaggaaaucaguuuugcauaaaaauccuaaauccuuauaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaaugcugcugaaucgguucacaauggcucacaggaagccaacguaugaaagagacguggacuugggcgcuggaacaagacauguggcaguggaaccagagauagccaaccuagacauuauuggccagaggauagagaacauaaaaaaugaacauaagucaacauggcauuaugaugaggacaauccauacaaaacaugggccuaucauggaucauaugaggucaagccaucagggucagccucauccauggugaauggcguggugagauugcucaccaagccaugggauguuauccccauggucacacaaauagcuaugacugauaccacacccuucggacaacagaggguuuucaaagagaaaguugacacacgcacaccaagaccaaaacgaggcacagcacaaauuauggaggugacagccaagugguuguggggauuccucucuagaaauaaaaaacccagaaucugcacaagagaggaguucacaagaaaaguuaggucaaacgcagcaauuggagcaguguuuguugaugaaaaccaauggaacucagcaaaagaagcaguggaagacgaaagguuuugggaccucgugcacagagagagggagcuucauaaacagggaaaaugugccacgugugucuacaauaugauggguaaaagagagaaaaaacuaggagaguuuggaaaggcaaaaggaagucgugcaauaugguacaugugguugggagcacgcuuucuagaauuugaagcccuuggcuucaugaaugaagaccacugguucaguagggagaauucacucaguggaguggaaggagaaggacuacauaaacuuggauacauacucagagacauaucaaagauuccagggggaaauauguaugcagacgacacagcuggaugggacacaagaauaacagaggaugaucuucagaaugaggcuaaaaucaccgacaucauggagccugaacaugcucuacuggcuacgucaaucuucaagcugaccuaucaaaauaaggugguaagggugcaaagaccagcaaaaaguggaaccgugauggacgucauauccagacgugaccagagaggaaguggacaggucggaacuuauggccuaaacacuuucaccaacauggagguccaacuaauaagacaaauggaaucugaaggaaucuuuucacccagcgaauuggaaaauucaaaucuagcugagagaguucucgacugguuggaaaaacauggcgucgaaagguugaaaagaauggcaaucagcggagaugacuguguggugaaaccaacugaugacagguucgcaacagcuuuaacagcccugaaugacaugggaaaggugagaaaagacauaccgcaaugggaaccuucaaaaggauggaaugacuggcagcaagugccuuucuguucacaccacuuccaccaacugauuaugaaggaugggagggagauaguggugccaugccgcaaccaagaugaacuugugggcagggccagaguaucacaaggcgccggguggagccugagagaaacugcuugccuaggcaagucauaugcacaaauguggcagcugauguacuuccacaggagagaccugagacuggcggcuaaugcuaucuguucagccguuccaguuaauugggucccaaccagccgcaccaccuggucgauccaugcccaccaucaauggaugacaacagaagacauguugucaguauggaauaggguuuggauagaggaaaacccauggauggaggacaaaacucauguauccagcugggaagauguuccauacuuaggaaaaagggaagaucaaugguguggaucucugauaggcuuaacagcaagagccaccugggccaccaacauacaaguggccauaaaccaagugagaaggcuuauugggaacgagaauuauuuagacuacaugacaucaaugaagagauucaagaaugagagugaucccgaaggagcccucugguaa

SEQ ID NO: 6309 - RNA, 9879 nt, Artificial Sequence
  derived and/or modified CDS sequence (wt) from DENV-1__KM403586__SS-prME
uccgugaccaugcuccucaugcugcugcccacagcccuggcguuccauuugaccacacgagggggagagccacacaugauaguuagcaagcaggaaagaggaaagucacucuuguuuaagaccucugcaggugucaacaugugcacccucauugcaauggauuugggagaguuaugugaggauacaaugaccuacaaaugcccccggaucacugaagcggaaccagaugauguugauugcuggugcaaugccacagacacaugggugaccuaugggacguguucucagacuggcgaacaccgacgggauaaacguucugucgcauuggccccacacguggggcuuggucucgaaacaagaaccgaaacguggauguccucugaaggcgccuggaggcagauacaaaaaguggagacuugggccuugagacacccaggauucacggugauagccuuuuuucuagcacaugccauaggaacauccauuacccagaaagggaucaucuucauuuugcugaugcuggugacaccaucaauggccaugcgaugcgugggaauaggcaacagagacuucguugaaggacugucaggagcaacauggguggaugugguacuggagcauggaagcugugucaccaccauggcaaagaauaaaccaacauuggacauugaacucuugaagacggaggucacgaacccugccgucuugcgcaaacugugcauugaagcuaaaauaucaaacaccaccaccgauucaagauguccaacacaaggagaagcuacacugguggaagaacaagacgcgaacuuugugugucgacgaacauucguggacagaggcugggguaaugguuguggacuauucgggaagggaagcuuacuaacgugugcuaaguuuaagugugugacaaaacuugaaggaaagauaguucaauaugaaaacuuaaaauauucggugauagucacuguccacacuggggaccagcaccagguaggaaaugagacuacagaacauggaacaauugcaaccauaacaccucaagcucccacgucggaaguacagcugacugacuacggagcccuuacauuggacugcucaccuagaacagggcuggacuuuaaugagauggugcuguugacaaugaaagaaaaaucauggcuuguccacaaacaaugguuucuagacuuaccauugccuuggaccucgggggcuucaacaucucaagagacuuggaacagacaagaucugcuggucacauuuaagacagcucaugcaaagaagcaggaaguagucguacuggggucacaagaaggagcaaugcacacugcguugacuggggcgacagaaauccagacgucaggaacgacgacaaucuucgcaggacaccugaaauguagacuaaaaauggauaaacugacuuuaaaaggggugucauaugugaugugcacaggcucauuuaagcuagagaaggaaguggcugagacccagcauggaacuguccuagugcagguuaaauaugaaggaacagaugcaccaugcaagauuccaauuucaacccaagaugagaaaggagugacccagaaugggagauugauaacagccaaucccauagucacugacaaagaaaaaccagucaacauugaaacagaaccacccuuuggugagagcuacaucgugauaggggcgggugaaaaagcuuugaaacuaagcugguucaagaaaggaagcagcauagggaaaauguucgaagccacugcccgaggagcacgaaggauggcuauccugggagacacagcaugggacuucgguuccauaggagggguguucacaucugugggaaaauugguacaccagguuuuuggaaccgcauaugggguccuguucagcgguguuucuuggaccaugaaaauaggaauagggauucugcugacauggcuaggauugaauucaaggagcacgucacucucgaugacgugcauugcaguuggcauggucacacuguaccuaggagucaugguucaagcggacucggggugugugaucaacuggaagggcagagaacucaaguguggaaguggcaucuuugucacuaaugaaguccacacuuggacagagcaauacaaauuucaggcugacuccccaaaaagacuaucagcagccauugggaaggcaugggaggaaggcguguguggaauucgaucagccacacgucuugagaacaucauguggaagcaaauaucaaaugaauugaaccacauucuacuugaaaaugacaugaaauucacagugguuguaggagacgccuauggaaucuugacccaaggaaaaaagaugauuaggccacaacccauggaacacaaauacucauggaaaagcuggggaaaagccaaaaucauaggagcagauacacagaauacuaccuucaucaucgauggcccagacacuccagaaugccccgaugaccagagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagagagugaaaagaacgagaccuggaagcuagcgagagccuccuucauagaagugaagacaugcaucuggccaagaucccacacucuauggagcaauggagucuuggaaagugaaaugauaaucccaaagauauauggaggaccaauaucucagcacaacuacagaccaggguauuucacacaaacagcagggccauggcaccuaggcaaguuggaacuagacuuuaauuugugugaaggcaccacaguuguuguggaugaacauuguggaaaucgagguccaucucuuagaacuacaacagucacaggaaagauaauccaugaauggugcugcagauccugcacgcuaccccccuuacgcuucagaggagaagacggauguugguauggcauggaaaucagaccaguuaaggagaaggaagagaaucuagucaggucaauggucucugcagggucaggagaaguggacaguuuuucauugggacuacuaugcguaucaauaaugauugaagaagugaugagauccagauggaguagaaagaugcugaugacuggaacacuggcuguuuucuuccuucuuauaaugggacaacugacauggaaugaucugaucagguuaugcaucaugguuggagccaaugucucagacagaauggggaugggaacaacguaccuagcuuuaauggccacuuuuaaaaugagaccgauguucgcuguugggcuauuauuucgcagacuaacauccagagaggugcuccuucucacaauuggacuaagccugguggcauccguggagcuaccaaauucuuuagaggagcuaggggacggacuugcgaugggcaucaugauguuaaaauuguugacugauuuucagucacaccaguuguggacuaccuuacugucucugacauucaucaaaacaacucuuucacuggauuaugcauggaagacaauggcuaugguauugucaaucguaucucucuuuccucuaugucuauccacgaccucucaaaaaacaacauggcuuccgguguuguuaggauccuuuggauguaaaccacuaaccauguuucuuauaacagaaaacaaaauuuggggaaggaaaaguuggccccucaaugaaggaauuauggcuguuggaauagucagcauuuuacuaaguucacuccucaaaaaugacgugccacuagccggcccacuaauagcuggaggcaugcugauagcauguuacgucauauccggaagcucagccgauuuaucauuggagagagcggcugaggucuccugggaagaagaagcagaacacucuggugccucacacaacauacuaguggagguccaagaugauggaacuaugaaaauaaaagaugaagagagagaugacacgcucacuauacuccucaaagcaacuuuguuggcaguuucagggguguacccaaugucaauaccagcaacccuuuuugugugguauuuuuggcagaaaaagaaacagagaucaggagucuugugggacacacccagcccuccugaaguagaaagagcaguucuugaugaugguaucuauagaaucuugcaaagaggacuguuggguaggucccagguaggagugggaguuuuucaagacggcguguuccacacaauguggcaugucaccaggggggcuguccucauguaccaagggaagaggcuggaaccaaguugggccagugucaaaaaagacuugaucucauauggaggagguuggagguuucaaggaucauggaacacgggagaagaaguacaggugauagcuguugaaccagggaaaaacccaaagaauguacagacaacgccgggcaccuucaagaccccugaaggcgaaguuggagccauagcccuagauuucaaaccuggcacaucuggaucucccaucgugaacagagagggaaaaauaguaggucuuuauggaaauggaguggugacaacaaguggaaccuacgucagugccauugcccaagcuaaagcgucacaagaagggccucuaccagagauugaggacgagguguuuaagaaaagaaaccuaacaauaauggaccuacauccaggaucaggaaaaacaagaagauaucuuccagccauaguccgugaggccauaaaaaggaaacugcgcacgcuaaucuuggcucccacaagaguugucgccucugaaauggcagaggcgcuuaaaggaaugccaauaagauaucagacaacagcaguaaagagugaacacacaggaaaggagauagucgaucucaugugccacgccacuuucaccaugcgucuccuaucuccagugagaguucccaauuacaacaugauuaucauggaugaagcacacuuuaccgauccagccagcauagcggccagaggguacaucucaacccgaguggguaugggugaagcagcugcgaucuuuaugacagccacucccccaggaucgguagaggccuuuccacagagcaaugcaguuauccaagaugaggaaagagacauuccugagagaucauggaacucaggcuacgacuggaucacugauuucccaggaaaaacagucugguuuguuccaagcaucaaaucaggaaaugacauugccaacugcuuaagaaaaaacgggaaacgggugauccaauugagcagaaaaaccuuugacacugaauaccagaaaacgaaaaacaaugauugggacuauguugucacaacugacauuuccgaaaugggagcaaauuuccgggccgacaggguaauagacccaaggcggugcuugaagccgguaauacuaaaagauggcccagagcgcgucauucuagcuggaccaaugccagugaccgcggccagugcugcccagaggagaggaagaauuggaaggaaccaaaacaaggaaggugaccaguauauuuacaugggacagccuuuaaacaaugaugaggaccacgcucauuggacagaagcaaaaaugcuccuugacaauauaaauacgccagaagggauuaucccagcccucuuugagccagagagagaaaagagugcagcaauagacggggaguauagacugcggggagaagcaaggaaaacguucguggagcuaaugagaagaggggaucuaccaguuuggcuaucuuacaaaguugccucagaaggcuuccaguacuccgacagaagauggugcuuugacggggaaaggaacaaccagguguuggaggagaacauggacguggagaucuggacaaaagaaggagaaagaaagaaauugcgaccucgcugguuagaugccagaaccuacucugauccacuggcccugcgcgaguuuaaagaguucgcagcaggaagaagaagugucucaggugaccuaauauuagaaauagggaaacucccacagcauuugacgcuaagggcccagaaugcuuuggacaacuuggucauguugcacaauuccgaacaagggggaaaagccuauagacaugcuauggaagaacuaccagacaccauagaaacauugaugcuacuagccuugauagcugugcugacugguggaguuacguuguuuuuccuaucaggaaaaggucuagggaaaacauccauuggccuacuuuguguaauggccucaaguguacuguuauggauggccaguguggagccccauuggauagcagccuccaucauacuagaguuuuuucugauggugcugcucauuccagagccagacagacagcguacuccacaggacaaucaacuagcauauguggugauagguuuguuauucaugauauugacaguggcagccaaugagaugggauuacuggaaaccacaaagaaagaccuggggauuggccauguagucgccgaaaaccaccaccaugccacaaugcuagacauagacuuacauccagcuucagccuggacccucuaugcaguagccacaacaauuaucacucccaugaugagacacacaauugaaaacacaacggcaaacauuucccugacagcuauugcaaaucaggcggcuauauuaaugggacuugacaagggauggccaauaucgaagauggacauaggagugccacuucucgccuuagggugcuauucccaggugaacccauugacacugacagcggcgguguuaauguuaguggcucauuaugccauaaucggaccuggacugcaagcaaaagcuaccagagaagcccaaaaaaggacugcggccggaauaaugaaaaauccaacuguagacgggauuguugcaauagauuuggauccugugguuuaugaugcaaaauuugaaaaacagcuaggccaaauaauguuacuaauacucugcacaucacagauucucuugaugcggacuacaugggccuuaugugaaucuaucacacuggcuacuggacccuugaccacucucugggagggaucuccuggaagauucuggaauaccacgauagcaguguccauggcaaacaucuucaggggaaguuauuuagcaggggcaggucuggccuucucauuaaugaaaucuuuaggaggagguaggagaggcacgggagcucaaggggaaacauugggagaaaaauggaaaagacaacuaaaccaacugagcaagucagaauuuaacacuuacaaaaggaguggaauuauggagguggacagaucugaagccaaggagggaaugaaaagaggagaaacaaccaaacaugcagugucgagaggaacagccaaacuuaggugguuuguggagaggaaccuugugaaaccggaagggaaagugauagaccucgguuguggaagagguggcuggucauauuacugcgcugggcugaagaaggucacagaagugaagggauacacaaaaggaggacccggucaugaggaaccuaucccaauggcgacuuauggauggaacauagugaagcuacacucuggaagggauguauucuuuacaccaccugagaaaugugacacccuuuugugugauauuggugaguccucuccgaauccaacuauagaagaaggaagaacguuacguguucuaaagaugguggaaccauggcucagaggaaaucaguuuugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaaugcugcugaaucgguucacaauggcucacaggaagccaacguaugaaagagacguggacuugggcgcuggaacaagacauguggcaguggaaccagagauagccaaccuagacauuauuggccagaggauagagaacauaaaaaaugaacauaagucaacauggcauuaugaugaggacaauccauacaaaacaugggccuaucauggaucauaugaggucaagccaucagggucagccucauccauggugaauggcguggugagauugcucaccaagccaugggauguuauccccauggucacacaaauagcuaugacugauaccacacccuucggacaacagaggguuuucaaagagaaaguugacacacgcacaccaagaccaaaacgaggcacagcacaaauuauggaggugacagccaagugguuguggggauuccucucuagaaauaaaaaacccagaauuugcacaagagaggaguucacaagaaaaguuaggucaaacgcagcaauuggagcaguguuuguugaugaaaaccaauggaacucagcaaaagaagcaguggaagacgaaagguuuugggaccucgugcacagagagagggagcuucauaaacagggaaaaugugccacgugugucuacaauaugauggguaaaagagagaaaaaacuaggagaguuuggaaaggcaaaaggaagucgugcaauaugguacaugugguugggagcacgcuuucuagaauuugaagcccuugguuucaugaaugaagaccacugguucaguagggagaauucacucaguggaguggaaggagaaggacuacauaaacuuggauacauacuuagagacauaucaaagauuccagggggaaauauguaugcagacgacacagcuggaugggacacaagaauaacagaggaugaucuucagaaugaggcuaaaaucaccgacaucauggagccugaacaugcucuacuggcuacgucaaucuucaaacugaccuaucaaaauaaggugguaagggugcaaagaccagcaaaaaguggaaccgugauggacgucauauccagacgugaccagagaggaaguggacaggucggaacuuauggccuaaacacuuucaccaacauggagguccaacuaauaagacaaauggaaucugaaggaaucuuuucacccagcgaauuggaaaauucaaaucuagcugagagaguucucgacugguuggaaaaacauggcgucgaaagguugaaaagaauggcaaucagcggagaugacuguguggugaaaccaacugaugacagguucgcaacagcuuuaacagcccugaaugacaugggaaaggugagaaaagacauaccgcaaugggaaccuucaaaaggauggaaugacuggcagcaagugccuuucuguucacaccacuuccaccaacugauuaugaaggaugggagggagauaguggugccaugccgcaaccaagaugaacuugugggcagggccagaguaucacaaggcgccggguggagccugagagaaacugcuugccuaggcaagucauaugcacaaauguggcagcugauguacuuccacaggagagaccugagacuggcggcuaaugcuaucuguucagccguuccaguuaauugggucccaaccagccgcaccaccuggucgauccaugcccaccaucaauggaugacaacagaagacauguugucaguauggaauaggguuuggauagaggaaaacccauggauggaggacaaaacucauguauccagcugggaagauguuccauacuuaggaaaaagggaagaucaaugguguggaucucugauaggcuuaacagcaagagccaccugggccaccaacauacaaguggccauaaaccaagugagaaggcuuauugggaaugagaauuauuuagacuacaugacaucaaugaagagauucaagaaugagagugaucccgaaggagcccucugguaa

SEQ ID NO: 6310 - RNA, 9879 nt, Artificial Sequence
  derived and/or modified CDS sequence (wt) from DENV-1__KM403602__SS-prME
uccgugaccaugcuccucaugcugcugcccacagcccuggcguuccauuugaccacacgagggggagagccacacaugauaguuagcaagcaggaaagaggaaagucacucuuguuuaagaccucugcaggugucaacaugugcacccucauugcaauggauuugggagaguuaugugaggauacaaugaccuacaaaugcccccggaucacugaagcggaaccagaugauguugauugcuggugcaaugccacagacacaugggugaccuaugggacguguucucagacuggcgaacaccgacgggauaaacguucugucgcauuggccccacacguggggcuuggucucgaaacaagaaccgaaacguggauguccucugaaggcgccuggaggcagauacaaaaaguggagacuugggccuugagacacccaggauucacggugauagcccuuuuuuuagcacaugccauaggaacauccauuacccagaaagggaucaucuucauuuugcugaugcuggugacaccaucaauggccaugcgaugcgugggaauaggcaacagagacuucguugaaggacugucaggagcaacauggguggaugugguauuggagcauggaagcugugucaccaccauggcaaagaauaaaccaacauuggacauugaacucuugaagacggaggucacgaacccugccgucuugcgcaaacugugcauugaagcuaaaauaucaaacaccaccaccgauucaagauguccaacacaaggagaagcuacacugguggaagaacaagacgcgaacuuugugugucgacgaacauucguggacagaggcugggguaaugguuguggacuauucgggaagggaagcuuacuaacgugugcuaaguuuaagugugugacaaaacuugaaggaaagauaguucaauaugaaaacuuaaaauauucggugauagucacuguccacacuggggaccagcaccagguaggaaaugagacuacagaacauggaacaauugcaaccauaacaccucaagcucccacgucggaaauacagcugacugacuacggagccauuacauuggacugcucaccuagaacagggcuggacuuuaaugagauggugcuguugacaaugaaagaaaaaucauggcuuguccacaaacaaugguuucuagacuuaccauugccuuggaccucgggggcuucaacaucucaagagacuuggaacagacaagaucugcuggucacauuuaagacagcucaugcaaagaagcaggaaguagucguacuggggucacaagaaggagcaaugcacacugcguugacuggggcgacagaaauccagacgucaggaacgacgacaaucuucgcaggacaccugaaauguagacuaaaaauggauaaacugacuuuaaaaggggugucauaugugaugugcacaggcucauuuaagcuagagaaggaaguggcugagacccagcauggaacuguccuagugcagguuaaauaugaaggaacagaugcaccaugcaagauuccaauuucaacccaagaugagaaaggagugacccagaaugggagauugauaacagccaaucccauaguuacugacaaagaaaaaccagucaacauugaaacagaaccacccuuuggugagagcuacaucgugauaggggcgggugaaaaagcuuugaaacuaagcugguucaagaaaggaagcagcauagggaaaauguucgaagccaccgcccgaggagcacgaaggauggcuauccugggagacacagcaugggacuucgguuccauaggagggguguucacaucugugggaaaauugguacaccagguuuuuggaaccgcauaugggguccuguucagcgguguuucuuggaccaugaaaauaggaauagggauucugcugacauggcuaggauugaauucaaggagcacgucacucucgaugacgugcauugcaguuggcauggucacacuguaccuaggagucaugguucaagcggacucggggugugugaucaacuggaagggcagagaacucaaguguggaaguggcaucuuugucacuaaugaaguccacacuuggacagagcaauacaaauuucaggcugacuccccaaaaagacuaucagcagccauugggaaggcaugggaggaaggcguguguggaauucgaucagccacacgucuugagaacaucauguggaagcaaauaucaagugaauugaaccacauucuacuugaaaaugacaugaaauucacagugguuguaggagacgccaauggaaucuugacccaaggaaaaaagaugauuaggccacaacccauggaacacaaauacucauggaaaagcuggggaaaagccaaaaucauaggagcagauacacagaauacuaccuucaucaucgauggcccagacacuccagaaugccccgaugaccagagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaacgagaccuggaagcuagcgagagccuccuucauagaagugaagacaugcaucuggccaagaucccacacucuauggagcaauggagucuuggaaagugaaaugauaaucccaaagauauauggaggaccaauaucucagcacaacuacagaccaggguauuucacacaaacagcagggccauggcaccuaggcaaguuggaacuagacuuuaauuugugugaaggcaccacaguuguuguggaugaacauuguggaaaucgagguccaucucuuagaacuacaacagucacaggaaagauaauccaugaauggugcugcagauccugcacgcuaccccccuuacgcuucagaggagaagacggauguugguauggcauggaaaucagaccaguuaaggagaaggaagagaaucuagucaggucaauggucucugcagggucaggagaaguggacaguuuuucauugggacuacuaugcguaucaauaaugauugaagaagugaugagauccagauggaguaaaaagaugcugaugacuggaacacuggcuguuuucuuccuucuuauaaugggacaacugacauggaaugaucugaucagguuaugcaucaugguuggagccaaugucucagacagaauggggaugggaacaacguaccuagcuuuaauggccacuuuuaaaaugagaccgauguucgcuguugggcuauuauuucgcagacuaacauccagagaggugcuccuucucacaauuggacuaagccugguggcauccguggagcuaccaaauucuuuagaggagcuaggggacggacuugcgaugggcaucaugauguuaaaauuguugacugauuuucagucacaccaguuguggacuaccuuacugucucugacauucaucaaaacaacucuuucacuggauuaugcauggaagacaauggcuaugguauugucaaucguaucucucuuuccucuaugucuauccacgaccucucaaaaaacaacauggcuuccgguguuguuaggauccuuuggauguaaaccacuaaccauguuucuuauaacagaaaacaaaauuuggggaaggaaaaguuggccccucaaugaaggaauuauggcuguuggaauagucagcauuuuacuaaguucacuccucaaaaaugacgugccacuagccggcccacuaauagcuggaggcaugcugauagcauguuacgucauuuccggaagcucagccgauuuaucauuggagagagcggcugaggucuccugggaagaagaagcagaacacucuggugccucacacaacauacuaguggagguccaagaugauggaacuaugaaaauaaaagaugaagagagagaugacacgcucacuauacuccucaaagcaacuuuguuggcaguuucagggguguacccaaugucaauaccagcaacccuuuuugugugguauuuuuggcagaaaaagaaacagagaucaggagucuugugggacacacccagcccuccagaaguagaaagagcaguucuugaugaugguaucuauagaaucuugcaaagaggacuguuggguaggucccagguaggagugggaguuuuucaagacggcguguuccacacaauguggcaugucaccaggggggcuguccucauguaccaagggaagaggcuggaaccaaguugggccagugucaaaaaagacuugaucucauauggaggagguuggagguuucaaggaucauggaacacgggagaagaaguacaggugauagcuguugaaccagggaaaaacccaaagaauguacagacaacgccgggcaccuucaagaccccugaaggcgaaguuggagccauagcccuagauuucaaaccuggcacaucuggaucucccaucgugaacagagaggggaaaauaguaggucuuuauggaaauggaguggugacaacaaguggaaccuacgucagugccauugcccaagcuaaagcgucacaagaagggccucuaccagagauugaggacgagguguuuaagaaaagaaaccuaacaauaauggaccuacauccaggaucaggaaaaacaagaagauaucuuccagccauaguccgugaggccauaaaaaggaaacugcgcacgcuaaucuuggcucccacaagaguugucgccucugaaauggcagaggcgcuuaaaggaaugccaauaagauaucagacaacagcaguaaagagugaacacacaggaaaggagauagucgaucucaugugccacgccacuuucaccaugcgucuccuaucuccagugagaguucccaauuacaacaugauuaucauggaugaagcacacuuuaccgauccagccagcauagcggccagaggguacaucucaacccgaguggguaugggugaagcagcugcgaucuuuaugacagccacucccccaggaucgguagaggccuuuccacagagcaaugcaguuauccaagaugaggaaagagacauuccugagagaucauggaacucaggcuacgacuggaucacugacuucccaggaaaaacagucugguuuguuccaagcaucaaaucaggaaaugacauugccaacugcuuaagaaaaaacgggaaacgggugauccaauugagcagaaaaaccuuugacacugaauaccagaaaacgaaaaacaaugauugggacuauguugucacaacagacauuuccgaaaugggagcaaauuuccgggccgauaggguaauagacccaaggcggugcuugaagccgguaauacuaaaagauggcccagagcgcgucauucuggccggaccaaugccagugaccgcggccagugcugcccagaggagaggaagaauuggaaggaaccaaaacaaggaaggugaccaguauauuuacaugggacagccuuuaaauaaugaugaggaccacgcucauuggacagaagcaaaaaugcuccuugacaauauaaauacgccagaagggauuaucccagcccucuuugagccagagagagaaaagagugcagcaauagacggggaguauagacugcggggagaagcaaggaaaacguucguggagcuaaugagaagaggggaucuaccaguuuggcuaucuuacaaaguugccucagaaggcuuccaguacuccgacagaagauggugcuuugacggggaaaggaacaaccagguguuggaggagaacauggacguggagaucuggacaaaagaaggagaaagaaagaaauugcgaccucgcugguuagaugccagaaccuacucugauccacuggcccugcgcgaguuuaaagaguucgcagcaggaagaagaagugucucaggugaccuaauauuagaaauagggaaacucccacagcauuugacgcuaagggcccagaaugcuuuggacaacuuggucauguugcacaauuccgaacaagggggaaaagccuauagacaugcuauggaagaacuaccagacaccauagaaacauugaugcuacuagccuugauagcugugcugacugguggaguuacguuguuuuuccuaucaggaaaaggucuagggaaaacauccauuggccuacuuuguguaauggccucaaguguacuguuauggauggccaguguggagccccauuggauagcggccuccaucauacuagaguuuuuucugauggugcugcuuauuccagagccagacagacagcguacuccacaggacaaucaacuagcauauguggugauagguuuguuauucaugauauugacaguggcagccaaugagaugggauuacuggaaaccacaaagaaagaccuggggauuggccauguagucgccgaaaaccaccaccaugccacaaugcuagacauagacuuacauccagcuucagccuggacccucuaugcaguagccacaacaauuaucacucccaugaugagacacacaauugaaaacacaacggcaaacauuucccugacagcuauugcaaaucaggcggcuauauuaaugggacuugacaagggauggccaauaucgaagauggacauaggagugccacuucucgccuuagggugcuauucccaggugaacccauugacacugacagcggcgguguuaauguuaguggcucauuaugccauaaucggaccuggacugcaagcaaaagcuaccagagaagcccaaaaaaggacugcggccggaauaaugaaaaauccaacuguagacgggauuguugcaauagauuuggauccugugguuuaugaugcaaaauuugaaaaacagcuaggccaaauaauguuacuaauacucugcacaucacagauucucuugaugcggacuacaugggccuuaugugaaucuaucacacuggcuacuggacccuugaccacucucugggagggaucuccuggaaaauucuggaauaccacgauagcaguguccauggcaaacaucuucaggggaaguuauuuagcaggggcaggucuggccuucucauuaaugaaaucuuuaggaggagguaggagagguacgggagcucaaggggaaacauugggagaaaaauggaaaagacaacuaaaccaacugagcaagucagaauuuaacacuuacaaaaggaguggaauuauggagguggacagauccgaagccaaggagggacugaaaagaggagaaacaaccaaacaugcagugucgagaggaacagccaaacuuaggugguuuguggagaggaaccuugugaaaccggaagggaaagugauagaccucgguuguggaagagguggcuggucauauuacugcgcugggcugaagaaggucacagaaguaaagggauacacaaaaggaggacccggucaugaggaaccuaucccaauggcgacuuauggauggaacauagugaagcuacacucuggaagggauguauucuuuacaccaccugagaaaugugacacccuuuugugugauauuggugaguccucuccgaauccaacuauagaagaaggaagaacguuacguguucuaaagaugguggaaccauggcucagaggaaaucaguuuugcauaaaaauccuaaauccuuauaugccaagugugguagaaacucuggagcaaaugcaaagaaaacauggagggaugcuagugcgaaacccacucucaagaaauuccacccaugaaauguacugggucucauguggaacaggaaacauugugucggcagugaacaugacauccagaaugcugcugaaucgguucacaauggcucacaggaagccaacguaugaaagagacguggacuugggcgcuggaacaagacauguggcaguggaaccagagauagccaaccuagacauuauuggccagaggauagagaacauaaaaaaugaacauaagucaacauggcauuaugaugaggacaauccauacaaaacaugggccuaucauggaucauaugaggucaagccaucagggucagccucauccauggugaauggcguggugagauugcucaccaagccaugggauguuauccccauggucacacaaauagcuaugacugauaccacacccuucggacaacagaggguuuucaaagagaaaguugacacacgcacaccaagaccaaaacgaggcacagcacaaauuauggaggugacagccaagugguuguggggauuccucucuagaaauaaaaaacccagaaucugcacaagagaggaguucacaagaaaaguuaggucaaacgcagcaauuggagcaguguuuguugaugaaaaccaauggaacucagcaaaagaagcaguggaagacgaaagguuuugggaccucgugcacagagagagggagcuucauaaacagggaaaaugugccacgugugucuacaauaugauggguaaaagagagaaaaaacuaggagaguuuggaaaggcaaaaggaagucgugcaauaugguacaugugguugggagcacgcuuucuagaauuugaagcccuuggcuucaugaaugaagaccacugguucaguagggagaauucacucaguggaguggaaggagaaggacuacauaaacuuggauacauacucagagacauaucaaagauuccagggggaaauauguaugcagacgacacagcuggaugggacacaagaauaacagaggaugaucuucagaaugaggcuaaaaucaccgacaucauggagccugaacaugcucuacuggcuacgucaaucuucaagcugaccuaucaaaauaaggugguaagggugcaaagaccagcaaaaaguggaaccgugauggacgucauauccagacgugaccagagaggaaguggacaggucggaacuuauggccuaaacacuuucaccaacauggagguccaacuaauaagacaaauggaaucugaaggaaucuuuucacccagcgaauuggaaaauucaaaucuagcugagagaguucucgacugguuggaaaaacauggcgucgaaagguugaaaagaauggcaaucagcggagaugacuguguggugaaaccaacugaugacagguucgcaacagcuuuaacagcccugaaugacaugggaaaggugagaaaagacauaccgcaaugggaaccuucaaaaggauggaaugacuggcagcaagugccuuucuguucacaccacuuccaccaacugauaaugaaggaugggagggagauaguggugccaugccgcaaccaagaugaacuugugggcagggccagaguaucacaaggcgccggguggagccugagagaaacugcuugccuaggcaagucauaugcacaaauguggcagcugauguacuuccacaggagagaccugagacuggcggcuaaugcuaucuguucagccguuccaguuaauugggucccaaccagccgcaccaccuggucgauccaugcccaccaucaauggaugacaacagaagacauguugucaguauggaauaggguuuggauagaggaaaacccauggauggaggacaaaacucauguauccagcugggaagauguuccauacuuaggaaaaagggaagaucaaugguguggaucucugauaggcuuaacagcaagagccaccugggccaccaacauacaaguggccauaaaccaagugagaaggcuuauugggaacgagaauuauuuagacuacaugacaucaaugaagagauucaagaaugagagugaucccgaaggagcccucugguaa

SEQ ID NO: 6311 - RNA, 9879 nt, Artificial Sequence
  derived and/or modified CDS sequence (wt) from DENV-1__KM403582__SS-prME
uccgugaccaugcuccucaugcugcugcccacagcccuggcguuccauuugaccacacgagggggagagccacacaugauaguuagcaagcaggaaagaggaaagucacucuuguuuaagaccucugcaggugucaacaugugcacccucauugcaauggauuugggagaguuaugugaggauacaaugaccuacaaaugcccccggaucacugaagcggaaccagaugauguugauugcuggugcaaugccacagacacaugggugaccuaugggacguguucucagacuggcgaacaccgacgggauagacguucugucgcauuggccccacacguggggcuuggucucgaaacaagaaccgaaacguggauguccucugaaggcgccuggaggcagauacaaagaguggagacuugggccuugagacacccaggauucacggugauagcccuuuuuuuagcacaugccauaggaacauccauuacccagaaagggaucaucuucauuuugcugaugcuggugacaccaucaauggccaugcgaugcgugggaauaggcaacagagacuucguugaaggacugucaggagcaacauggguggaugugguacuggagcauggaagcugugucaccaccauggcaaagaauaaaccaacauuggacauugaacucuugaagacggaggucacgaacccugccgucuugcgcaaacugugcauugaagcuaaaauaucaaacaccaccaccgauucaagauguccaacacaaggagaagcuacacugguggaagaacaagacgcgaacuuugugugucgacgaacauucguggacagaggcugggguaaugguuguggacuauucgggaagggaagcuuacuaacgugugcuaaguuuaagugugugacaaaacuugaaggaaagauaguucaauaugaaaacuuaaaauauucggugauagucacuguccacacuggggaccagcaccagguaggaaaugagacuacagaacauggaacaauugcaaccauaacaccucaagcucccacgucggaaauacagcugacugacuacggagcccuuacauuggacugcucaccuagaacagggcuggacuuuaaugagauggugcuguugacaaugaaagaaaaaucauggcuuguccacaaacaaugguuucuagacuuaccauugccuuggaccucgggggcuucaacaucucaagagacuuggaacagacaagaucugcuggucacauuuaagacagcucaugcaaagaagcaggaaguagucguacuggggucacaagaaggagcaaugcacacugcguugacuggggcgacagaaauccagacgucaggaacgacgacaaucuucgcaggacaccugaaauguagacuaaaaauggauaaacugacuuuaaaaggggugucauaugugaugugcacaggcucauuuaagcuagagaaggaaguggcugagacccagcauggaacuguccuagugcagguuaaauaugaaggaacagaugcaccaugcaagauuccaauuucaacccaagaugagaaaggagugacccagaaugggagauugauaacagccaaucccauaguuacugacaaagaaaaaccagucaacauugaaacagaaccacccuuuggugagagcuacaucgugauaggggcgggugaaaaagcuuugaaacuaagcugguucaagaaaggaagcagcauagggaaaauguucgaagccaccgcccgaggagcacgaaggauggcuauccugggagacacagcaugggacuucgguuccauaggagggguguucacaucugugggaaaauugguacaccagguuuuuggaaccgcauaugggguccuguucagcgguguuucuuggaccaugaaaauaggaauagggauucugcugacauggcuaggauugaauucaaggagcacgucacucucgaugacgugcauugcaguuggcauggucacacuguaccuaggagucaugguucaagcggacucggggugugugaucaacuggaagggcagagaacucaaguguggaaguggcaucuuugucacuaaugaaguccacacuuggacagagcaauacaaauuucaggcugacuccccaaaaagacuaucagcagccauugggaaggcaugggaggaaggcguguguggaauucgaucaaccacacgucuugagaacaucauguggaagcaaauaucaaaugaauugaaccacauucuacuugaaaaugacaugaaauucacagugguuguaggagacgccaauggaaucuugacccaaggaaaaaagaugauuaggccacaacccauggaacacaaauacucauggaaaagcuggggaaaagccaaaaucauaggagcagauacacagaauacuaccuucaucaucgauggcccagacacuccagaaugccccgaugaccagagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaacgagaccuggaagcuagcgagagccuccuucauagaagugaagacaugcaucuggccaagaucccacacucuauggagcaauggagucuuggaaagugaaaugguaaucccaaagauauauggaggaccaauaucucagcacaacuacagaccaggguauuucacacaaacagcagggccauggcaccuaggcaaguuggaacuagacuuuaauuugugugaaggcaccacaguuguuguggaugaacauuguggaaaucgagguccaucucuuagaacuacaacagucacaggaaagauaauccaugaauggugcugcagauccugcacgcuaccccccuuacgcuucagaggagaagacggauguugguauggcauggaaaucagaccaguuaaggagaaggaagagaaucuagucaggucaauggucucugcagggucaggagaaguggacaguuuuucauugggacuacuaugcguaucaauaaugauugaagaagugaugagauccagauggaguagaaagaugcugaugacuggaacacuggcuauuuucuuccuucuuauaaugggacaacugacauggaaugaucugaucagguuaugcaucaugguuggagccaaugucucagacagaauggggaugggaacaacguaccuagcuuuaauggccacuuuuaaaaugagaccgauguucgcuguugggcuauuauuucgcagacuaacauccagagaggugcuccuucucacaauuggacuaagccugguggcauccguggagcuaccaaauucuuuagaggagcuaggggacggacuugcgaugggcaucaugauguuaaaauuguugacugauuuucagucacaccaguuguggacuaccuuacugucucugacauucaucaaaacaacucuuucacuggauuaugcauggaagacaauggcuaugguauugucaaucguaucucucuuuccucuaugucuauccacgaccucucaaaaaacaacauggcuuccgguguuguuaggauccuuuggauguaaaccacuaaccauguuucuuauaacagaaaacaaaauuuggggaaggaaaaguuggccccucaaugaaggaauuauggcuguuggaauagucagcauuuuacuaaguucacuccucaaaaaugacgugccacuagccggcccacuaauagcuggaggcaugcugauagcauguuacgucauuuccggaagcucagccgauuuaucauuggagagagcggcugaggucuccugggaagaagaagcagaacacucuggugccucacacaacauacuaguggagguccaagaugauggaacuaugaaaauaaaagaugaagagagagaugacacgcucacuauacuccucaaagcaacuuuguuggcaguuucagggguguacccaaugucaauaccagcaacccuuuuugugugguauuuuuggcagaaaaagaaacagagaucaggagucuugugggacacacccagcccuccagaaguagaaagagcaguucuugaugaugguaucuauagaaucuugcaaagaggacuguuggguaggucccagguaggagugggaguuuuucaagacggcguguuccacacaauguggcaugucaccaggggggcuguccucauguaccaagggaagaggcuggaaccaaguugggccagugucaaaaaagacuugaucucauauggaggagguuggagguuucaaggaucauggaacacgggagaagaaguacaggugauagcuguugaaccagggaaaaacccaaagaauguacagacaacgccgggcaccuucaagaccccugaaggcgaaguuggagccauagcccuagauuucaaaccuggcacaucuggaucucccaucgugaacagagaggggaaaauaguaggucuuuauggaaauggaguggugacaacaaguggaaccuacgucagugccauugcccaagcuaaagcgucacaagaagggccucuaccagagauugaggacgagguguuuaagaaaagaaaccuaacaauaauggaccuacauccaggaucaggaaaaacaagaagauaucuuccagccauaguccgugaggccauaaaaaggaaacugcgcacgcuaaucuuggcucccacaagaguugucgccucugaaauggcagaggcgcuuaaaggaaugccaauaagauaucagacaacagcaguaaagagugaacacacaggaaaggagauagucgaucucaugugccacgccacuuucaccaugcgucuccuaucuccagugagaguucccaauuacaacaugauuaucauggaugaagcacacuuuaccgauccagccagcauagcggccagaggguacaucucaacccgagugggcaugggugaagcagcugcgaucuuuaugacagccacucccccaggaucgguagaggccuuuccacagagcaaugcaguuauccaagaugaggaaagagacauuccugagagaucauggaacucaggcuacgacuggaucacugauuucccaggaaaaacagucugguuuguuccaagcaucaaaucaggaaaugacauugccaacugcuuaagaaaaaacgggaaacgggugauccaauugagcagaaaaaccuuugacacugaauaccagaaaacgaaaaacaaugauugggacuauguugucacaacagacauuuccgaaaugggagcaaauuuccgggccgauaggguaauagacccaaggcggugcuugaagccgguaauacuaaaagauggcccagagcgcgucauucuggccggaccaaugccagugaccgcggccagugcugcccagaggagaggaagaauuggaaggaaccaaaacaaggaaggugaccaguauauuuacaugggacagccuuuaaauaaugaugaggaccacgcucauuggacagaagcaaaaaugcuccuugacaauauaaauacgccagaagggauuaucccagcccucuuugagccagagagagaaaagagugcagcaauagacggggaguauagacugcggggagaagcaaggaaaacguucguggagcuaaugagaagaggggaucuaccaguuuggcuaucuuacaaaguugccucagaaggcuuccaguacuccgacagaagauggugcuuugacggggaaaggaacaaccagguguuggaggagaacauggacguggagaucuggacaaaagaaggagaaagaaagaaauugcgaccucgcugguuagaugccagaaccuacucugauccacuggcccugcgcgaguuuaaagaguucgcagcaggaagaagaagugucucaggugaccuaauauuagaaauagggaaacucccacagcauuugacgcuaagggcccagaaugcuuuggacaacuuggucauguugcacaauuccgaacaagggggaaaagccuauagacaugcuauggaagaacuaccagacaccauagaaacauugaugcuacuagccuugauagcugugcugacugguggaguuacguuguuuuuccuaucaggaaaaggucuagggaaaacauccauuggccuacuuuguguaauggccucaaguguacuguuauggauggccaguguggagccccauuggauagcggccuccaucauacuagaguuuuuucugauggugcugcuuauuccagagccagacagacagcguacuccacaggacaaucaacuagcauauguggugauagguuuguuauucaugauauugacaguggcagccaaugagaugggauuacuggaaaccacaaagaaagaccuggggauuggccauguagucgccgaaaaccaccaccaugccacaaugcuagacauagacuuacauccagcuucagccuggacccucuaugcaguagccacaacaauuaucacucccaugaugagacacacaauugaaaacacaacggcaaacauuucccugacagcuauugcaaaucaggcggcuauauuaaugggacuugacaagggauggccaauaucgaagauggacauaggagugccacuucucgccuuagggugcuauucccaggugaacccauugacacugacagcggcgguguuaauguuaguggcucauuaugccauaaucggaccuggacugcaagcaaaagcuaccagagaagcccaaaaaaggacugcggccggaauaaugaaaaauccaacuguagacgggauuguugcaauagauuuggaucccgugguuuaugaugcaaaauuugaaaaacagcuaggccaaauaauguuacuaauacucugcacaucacagauucucuugaugcggacuacaugggccuuaugugaaucuaucacacuggcuacuggacccuugaccacucucugggagggaucuccuggaaaauucuggaauaccacgauagcaguguccauggcaaacaucuucaggggaaguuauuuagcaggggcaggucuggccuucucauuaaugaaaucuuuaggaggagguaggagagguacgggagcucaaggggaaacauugggagaaaaauggaaaagacaacuaaaccaacugagcaagucagaauuuaacacuuacaaaaggaguggaauuauggagguggacagauccgaagccaaggagggacugaaaagaggagaaacaaccaaacaugcagugucgagaggaacagccaaacuuaggugguuuguggagaggaaccuugugaaaccggaagggaaagugauagaccucgguuguggaagagguggcuggucauauuacugcgcugggcugaagaaggucacagaaguaaagggauacacaaaaggaggacccggucaugaggaaccuaucccaauggcgacuuauggauggaacauagugaagcuacacucuggaagggauguauucuuuacaccaccugagaaaugugacacccuuuugugugauauuggugaguccucuccgaauccaacuauagaagaaggaagaacguuacguguucuaaagaugguggaaccauggcucagaggaaaucaguuuugcauaaaaauccuaaauccuuauaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaaugcugcugaaucgguucacaauggcucacaggaagccaacguaugaaagagacguggacuugggcgcuggaacaagacauguggcaguggaaccagagacagccaaccuagacauuauuggccagaggauagagaacauaaaaaaugaacauaagucaacauggcauuaugaugaggacaauccauacaaaacaugggccuaucauggaucauaugaggucaagccaucagggucagccucauccauggugaauggcguggugagauugcucaccaagccaugggauguuauccccauggucacacaaauagcuaugacugauaccacacccuucggacaacagaggguuuucaaagagaaaguugacacacgcacaccaagaccaaaacgaggcacagcacaaauuauggaggugacagccaagugguuguggggauuccucucuagaaauaaaaaacccagaaucugcacaagagaggaguucacaagaaaaguuaggucaaacgcagcaauuggagcaguguuuguugaugaaaaccaauggaacucagcaaaagaagcaguggaagacgaaagguuuugggaccucgugcacagagagagggagcuucauaaacagggaaaaugugccacgugugucuacaauaugauggguaaaagagagaaaaaacuaggagaguuuggaaaggcaaaaggaagucgugcaauaugguacaugugguugggagcacgcuuucuagaauuugaagcccuuggcuucaugaaugaagaccacugguucaguagggagaauucacucaguggaguggaaggagaaggacuacauaaacuuggauacauacucagagacauaucaaagauuccagggggaaauauguaugcagacgacacagcuggaugggacacaagaauaacagaggaugaucuucagaaugaggcuaaaaucaccgacaucauggagccugaacaugcucuacuggcuacgucaaucuuuaagcugaccuaucaaaauaaggugguaagggugcaaagaccagcaaaaaguggaaccgugauggacgucauauccagacgugaccagagaggaaguggacaggucggaacuuauggccuaaacacuuucaccaacauggagguccaacuaauaagacaaauggaaucugaaggaaucuuuucacccagcgaauuggaaaauucaaaucuagcugagagaguucucgacugguuggaaaaacauggcgucgaaagguugaaaagaauggcaaucagcggagaugacuguguggugaaaccaacugaugacagguucgcaacagcuuuaacagcccugaaugacaugggaaaggugagaaaagacauaccgcaaugggaaccuucaaaaggauggaaugacuggcagcaagugccuuucuguucacaccacuuccaccaacugauuaugaaggaugggagggagauaguggugccaugccgcaaccaagaugaacuugugggcagggccagaguaucacaaggcgccggguggagccugagagaaacugcuugccuaggcaagucauaugcacaaauguggcagcugauguacuuccacaggagagaccugagacuggcggcuaaugcuaucuguucagccguuccaguuaauugggucccaaccagccgcaccaccuggucgauccaugcccaccaucaauggaugacaacagaagacauguugucaguauggaauaggguuuggauagaggaaaacccauggauggaggacaaaacucauguauccagcugggaagauguuccauacuuaggaaaaagggaagaucaaugguguggaucucugauaggcuuaacagcaagagccaccugggccaccaacauacaaguggccauaaaccaagugagaaggcuuauugggaacgagaauuauuuagacuacaugacaucaaugaagagauucaagaaugagagugaucccgaaggagcccucugguaa

SEQ ID NO: 6312 - RNA, 9879 nt, Artificial Sequence
  derived and/or modified CDS sequence (wt) from DENV-1__KM403577__SS-prME
uccgugaccaugcuccucaugcugcugcccacagcccuggcguuccauuugaccacacgagggggagagccacacaugauaguuagcaagcaggaaagaggaaagucacucuuguuuaagaccucugcaggugucaacaugugcacccucauugcaauggauuugggagaguuaugugaggauacaaugaccuacaaaugcccccggaucacugaagcggaaccagaugauguugauugcuggugcaaugccacagacacaugggugaccuaugggacguguucucagacuggcgaacaccgacgggauaaacguucugucgcauuggccccacacguggggcuuggucucgaaacaagaaccgaaacguggauguccucugaaggcgccuggaggcagauacaaaaaguggagacuugggccuugagacacccaggauucacggugauagccuuuuuuuuagcacaugccauaggaacauccauuacccagaaagggaucaucuucauuuugcugaugcuggugacaccaucaauggccaugcgaugcgugggaauaggcaacagagacuucguugaaggacugucaggagcaacauggguggaugugguacuggagcauggaagcugugucaccaccauggcaaagaauaaaccaacauuggacauugaacucuugaagacggaggucacgaacccugccgucuugcgcaaacugugcauugaagcuaaaauaucaaacaccaccaccgauucaagauguccaacacaaggagaagcuacacugguggaagaacaagacgcgaacuuugugugucgacgaacauucguggacagaggcugggguaaugguuguggacuauucgggaagggaagcuuacuaacgugugcuaaguuuaagugugugacaaaacuugaaggaaagauaguucaauaugaaaacuuaaaauauucggugauagucacuguccacacuggggaccagcaccagguaggaaaugagacuacagaacauggaacaauugcaaccauaacaccucaagcucccacgucggaaauacagcugacugacuacggagcccuuacauuggacugcucaccuagaacagggcuggacuuuaaugagauggugcuguugacaaugaaagaaaaaucauggcuuguccacaaacaaugguuucuagacuuaccauugccuuggaccucgggggcuucaacaucucaagagacuuggaacagacaagaucugcuggucacauuuaagacagcucaugcaaagaagcaggaaguagucguacuggggucacaagaaggagcaaugcacacugcguugacuggggcgacagaaauccagacgucaggaacgacgacaaucuucgcaggacaccugaaauguagacuaaaaauggauaaacugacuuuaaaaggggugucauaugugaugugcacaggcucauuuaagcuagagaaggaaguggcugagacccagcauggaacuguccuagugcagguuaaauaugaaggaacagaugcaccaugcaagauuccaauuucaacccaagaugagaaaggagugacccagaaugggagauugauaacagccaaucccauaguuacugacaaagaaaaaccagucaacauugaaacagaaccacccuuuggugagagcuacaucgugauaggggcgggugaaaaagcuuugaaacuaagcugguucaagaaaggaagcagcauagggaaaauguucgaagccaccgcccgaggagcacgaaggauggcuauccugggagacacagcaugggacuucgguuccauaggagggguguucacaucugugggaaaauugguacaccagguuuuuggaaccgcauaugggguccuguucagcgguguuucuuggaccaugaaaauaggaauagggauucugcugacauggcuaggauugaauucaaggagcacgucacucucgaugacgugcauugcaguuggcauggucacacuguaccuaggagucaugguucaagcggacucggggugugugaucaacuggaagggcagagaacucaaguguggaaguggcaucuuugucacuaaugaaguccacacuuggacagagcaauacaaauuucaggcugacuccccaaaaagacuaucagcagccauugggaaggcaugggaggaaggcguguguggaauucgaucagccacacgucuugagaacaucauguggaagcaaauaucaaaugaauugaaccacauucuacuugaaaaugacaugaaauucacagugguuguaggagacgccaauggaaucuugacccaaggaaaaaagaugauuaggccacaacccauggaacacaaauacucauggaaaagcuggggaaaagccaaaaucauaggagcagauacacagaacacuaccuucaucaucgauggcccagacacuccagaaugccccgaugaccagagagcauggaacauuugggaaguugaggacuauggguuuggaguuuucacgacaaauauauggcugaaauugcgugacuccuacacccaaaugugugaccaccggcuaaugucagcugccaucaaggacagcaaggcaguccaugcugacaugggguacuggauagaaagugaaaagaacgagaccuggaagcuagcgagagccuccuucauagaagugaagacaugcaucuggccaagaucccacacucuauggagcaauggagucuuggaaagugaaaugauaaucccaaagauauauggaggaccaauaucucagcacaacuacagaccaggguauuucacacaaacagcagggccauggcaccuaggcaaguuggaacuagacuuuaauuugugugaaggcaccacaguuguuguggaugaacauuguggaaaucgagguccaucucuuagaacuacaacagucacaggaaagauaauccaugaauggugcugcagauccugcacgcuaccccccuuacgcuucagaggagaagacggauguugguauggcauggaaaucagaccaguuaaggagaaggaagagaaucuagucaggucaauggucucugcagggucaggagaaguggacaguuuuucauugggacuacuaugcguaucaauaaugauugaagaagugaugagauccagauggaguagaaagaugcugaugacuggaacacuggcuguuuucuuccuucuuauaaugggacaacugacauggaaugaucugaucagguuaugcaucaugguuggagccaaugucucagacagaauggggaugggaacaacguaccuagcuuuaauggccacuuuuaaaaugagaccgauguucgcuguugggcuauuauuucgcagacuaacauccagagaggugcuccuucucacaauuggacuaagccugguggcauccguggagcuaccaaauucuuuagaagagcuaggggacggacuugcgaugggcaucaugauguuaaaauuguugacugauuuucagucacaccaguuguggacuaccuuacugucucugacauucaucaaaacaacucuuucacuggauuaugcauggaagacaauggcuaugguauugucaaucguaucucucuuuccucuaugucuauccacgaccucucaaaaaacaacauggcuuccgguguuguuaggauccuuuggauguaaaccacuaaccauguuucuuauaacagaaaacaaaauuuggggaaggaaaaguuggccccucaaugaaggaauuauggcuguuggaauagucagcauuuuacuaaguucacuccucaaaaaugacgugccacuagccggcccacuaauagcuggaggcaugcugauagcauguuacgucauuuccggaagcucagccgauuuaucauuggagagagcggcugaggucuccugggaagaagaagcagaacacucuggugccucacacaacauacuaguggagguccaagaugauggaacuaugaaaauaaaagaugaagagagagaugacacgcucacuauacuccucaaagcaacuuuguuggcaguuucagggguguacccaaugucaauaccagcaacccuuuuugugugguauuuuuggcagaaaaagaaacagagaucaggagucuugugggacacacccagcccuccagaaguagaaagagcaguucuugaugaugguaucuauagaaucuugcaaagaggacuguuggguaggucccagguaggagugggaguuuuucaagacggcguguuccacacaauguggcaugucaccaggggggcuguccucauguaccaagggaagaggcuggaaccaaguugggccagugucaaaaaagacuugaucucauauggaggagguuggagguuucaaggaucauggaacacgggagaagaaguacaggugauagcuguugaaccagggaaaaacccaaagaauguacagacaacgccgggcaccuucaagaccccugaaggcgaaguuggagccauagcccuagauuucaaaccuggcacaucuggaucucccaucgugaacagagaggggaaaauaguaggucuuuauggaaauggaguggugacaacaaguggaaccuacgucagugccauugcccaagcuaaagcgucacaagaagggccucuaccagagauugaggacgagguguuuaagaaaagaaaccuaacaauaauggaccuacauccaggaucagggaaaacaagaagauaucuuccagccauaguccgugaggccauaaaaaggaaacugcgcacgcuaaucuuggcucccacaagaguugucgccucugaaauggcagaggcgcuuaaaggaaugccaauaagauaucagacaacagcaguaaagagugaacacacaggaaaggagauagucgaucucaugugccacgccacuuucaccaugcgucuccuaucuccagugagaguucccaauuacaacaugauuaucauggaugaagcacacuuuaccgauccagccagcauagcggccagaggguacaucucaacccgaguggguaugggugaagcagcugcgaucuuuaugacagccacucccccaggaucgguagaggccuuuccacagagcaaugcaguuauccaagaugaggaaagagacauuccugagagaucauggaacucaggcuacgacuggaucacugacuucccaggaaaaacagucugguuuguuccaagcaucaaaucaggaaaugacauugccaacugcuuaagaaaaaaugggaaacgggugauccaauugagcagaaaaaccuuugacacugaauaccagaaaacgaaaaacaaugauugggacuauguugucacaacagacauuuccgaaaugggagcaaauuuccgggccgauaggguaauagacccaaggcggugcuugaagccgguaauacuaaaagauggcccagagcgcgucauucuggccggaccaaugccagugaccgcggccagugcugcccagaggagaggaagaauuggaaggaaccaaaacaaggaaggugaccaguauauuuacaugggacagccuuuaaacaaugaugaggaccacgcucauuggacagaagcaaaaaugcuccuugacaauauaaauacgccagaagggauuaucccagcccucuuugagccagagagagaaaagagugcagcaauagacggggaguauagacugcggggagaagcaaggaaaacguucguggagcuaaugagaagaggggaucuaccaguuugguuaucuuacaaaguugccucagaaggcuuccaguacuccgacagaagauggugcuuugacggggaaaggaacaaccagguguuggaggagaacauggacguggagaucuggacaaaagaaggagaaagaaagaaauugcgaccucgcugguuagaugccagaaccuacucugauccacuggcccugcgcgaguuuaaagaguucgcagcaggaagaagaagugucucaggugaccuaauauuagaaauagggaaacucccacagcauuugacgcuaagggcccagaaugcuuuggacaacuuggucauguugcacaauuccgaacaagggggaaaagccuauagacaugcuauggaagaacuaccagacaccauagaaacauugaugcuacuagccuugauagcugugcugacugguggaguuacguuguuuuuccuaucaggaaaaggucuagggaaaacauccauuggccuacuuuguguaauggccucaaguguacuguuauggauggccaguguggagccccauuggauagcggccuccaucauacuagaguuuuuucugauggugcugcuuauuccagagccagacagacagcguacuccacaggacaaucaacuagcauauguggugauagguuuguuauucaugauauugacaguggcagccaaugagaugggauuacuggaaaccacaaagaaagaccuggggauuggccauguagucgccgaaaaccaccaccaugccacaaugcuagacauagacuuacauccagcuucagccuggacccucuaugcaguagccacaacaauuaucacucccaugaugagacacacaauugaaaacacaacggcaaacauuucccugacagcuauugcaaaucaggcggcuauauuaaugggacuugacaagggauggccaauaucgaagauggacauaggagugccacuucucgccuuagggugcuauucccaggugaacccauugacacugacagcggcgguguuaauguuaguggcucauuaugccauaaucggaccuggacugcaagcaaaagcuaccagagaagcccaaaaaaggacugcggccggaauaaugaaaaauccaacuguagacgggauuguugcaauagauuuggauccugugguuuaugaugcaaaauuugaaaaacagcuaggccaaauaauguuacuaauacucugcacaucacagauucucuugaugcggacuacaugggccuuaugugaaucuaucacacuggcuacuggacccuugaccacucucugggagggaucuccuggaaaauucuggaauaccacgauagcaguguccauggcaaacaucuucaggggaaguuauuuagcaggggcaggucuggccuucucauuaaugaaaucuuuaggaggagguaggagagguacgggagcucaaggggaaacauugggagaaaaauggaaaagacaacuaaaccaacugagcaagucagaauuuaacacuuacaaaaggaguggaauuauggagguggacagauccgaagccaaggagggacugaaaagaggagaaacaaccaaacaugcagugucgagaggaacagccaaacuuaggugguuuguggagaggaaccuugugaaaccggaagggaaagugauagaccucgguuguggaagagguggcuggucauauuacugcgcugggcugaagaaggucacagaaguaaagggauacacaaaaggaggacccggucaugaggaaccuaucccaauggcgacuuauggauggaacauagugaagcuacacucuggaagggauguauucuuuacaccaccugagaaaugugacacccuuuugugugauauuggugaguccucuccgaauccaacuauagaagaaggaagaacguuacguguucuaaagaugguggaaccauggcucagaggaaaucaguuuugcauaaaaauccuaaauccuuauaugccaagugugguagaaacucuggagcaaaugcaaagaaaacauggagggaugcuagugcgaaacccacucucaagaaauuccacccaugaaauguacugggucucauguggaacaggaaacauugugucggcagugaacaugacauccagaaugcugcugaaucgguucacaauggcucacaggaagccaacguaugaaagagacguggacuugggcgcuggaacaagacauguggcaguggaaccagagauagccaaccuagacauuauuggccagaggauagagaacauaaaaaaugaacauaagucaacauggcauuaugaugaggacaauccauacaaaacaugggccuaucauggaucauaugaggucaagccaucagggucagccucauccauggugaauggcguggugagauugcucaccaagccaugggauguuauccccauggucacacaaauagcuaugacugauaccacacccuucggacaacagaggguuuucaaagagaaaguugacacacgcacaccaagaccaaaacgaggcacagcacaaauuauggaggugacagccaagugguuguggggauuccucucuagaaauaaaaaacccagaaucugcacaagagaggaguucacaagaaaaguuaggucaaacgcagcaauuggagcaguguuuguugaugaaaaccaauggaacucagcaaaagaagcaguggaagacgaaagguuuugggaccucgugcacagagagagggagcuucauaaacagggaaaaugugccacgugugucuacaauaugauggguaaaagagagaaaaaacuaggagaguuuggaaaggcaaaaggaagucgugcaauaugguacaugugguugggagcacgcuuucuagaauuugaagcccuuggcuucaugaaugaagaccacugguucaguagggagaauucacucaguggaguggaaggagaaggacuacauaaacuuggauacauacucagagacauaucaaagauuccagggggaaauauguaugcagacgacacagcuggaugggacacaagaauaacagaggaugaucuucagaaugaggcuaaaaucaccgacaucauggagccugaacaugcucuacuggcuacgucaaucuucaagcugaccuaucaaaauaaggugguaagggugcaaagaccagcaaaaaguggaaccgugauggacgucauauccagacgugaccagagaggaaguggacaggucggaacuuauggccuaaacacuuucaccaacauggagguccaacuaauaagacaaauggaaucugaaggaaucuuuucacccagcgaauuggaaaauucaaaucuagcugagagaguucucgacugguuggaaaaacauggcgucgaaagguugaaaagaauggcaaucagcggagaugacuguguggugaaaccaacugaugacagguucgcaacagcuuuaacagcccugaaugacaugggaaaggugagaaaagacauaccgcaaugggaaccuucaaaaggauggaaugacuggcagcaagugccuuucuguucacaccacuuccaccaacugauuaugaaggaugggagggagauaguggugccaugccgcaaccaagaugaacuugugggcagggccagaguaucacaaggcgccggguggagccugagagaaacugcuugccuaggcaagucauaugcacaaauguggcagcugauguacuuccacaggagagaccugagacuggcggcuaaugcuaucuguucagccguuccaguuaauugggucccaaccagccgcaccaccuggucgauccaugcccaccaucaauggaugacaacagaagacauguugucaguauggaauaggguuuggauagaggaaaacccauggauggaggacaaaacucauguauccagcugggaagauguuccauacuuaggaaaaagggaagaucaaugguguggaucucugauaggcuuaacagcaagagccaccugggccaccaacauacaaguggccauaaaccaagugagaaggcuuauugggaacgagaauuauuuagacuacaugacaucaaugaagagauucaagaaugagagugaucccgaaggagcccucugguaa

SEQ ID NO: 6313 - RNA, 9879 nt, Artificial Sequence
  derived and/or modified CDS sequence (wt) from DENV-1__KM403631__SS-prME
uccgugaccaugcuccucaugcugcugcccacagcccuggcguuccauuugaccacacgagggggagagccacacaugauaguuagcaagcaggaaagaggaaagucacucuuguuuaagaccucugcaggugucaacaugugcacccucauugcaauggauuugggagaguuaugugaggauacaaugaccuacaaaugcccccggaucacugaagcggaaccagaugauguugauugcuggugcaaugccacagacacaugggugaccuaugggacguguucucagacuggcgaacaccgacgggauaaacguucugucgcauuggccccacacguggggcuuggucucgaaacaagaaccgaaacguggauguccucugaaggcgccuggaggcagauacaaaaaguggagacuugggccuugagacacccaggauucacggugauagcccuuuuuuuagcacaugccauaggaacauccauuacccagaaagggaucaucuucauuuugcugaugcuggugacaccaucaauggccaugcgaugcgugggaauaggcaacagagacuucguugaaggacugucaggagcaacauggguggaugugguacuggagcauggaagcugugucaccaccauggcaaagaauaaaccaacauuggacauugaacucuugaagacggaggucacgaacccugccgucuugcgcaaacugugcauugaagcuaaaauaucaaacaccaccaccgauucaagauguccaacacaaggagaagcuacacugguggaagaacaagacgcgaacuuugugugucgacgaacauucguggacagaggcugggguaaugguuguggacuauucgggaagggaagcuuacuaacgugugcuaaguuuaagugugugacaaaacuugaaggaaagauaguucaauaugaaaacuuaaaauauucggugauagucacuguccacacuggggaccagcaccagguaggaaaugagacuacagaacauggaacaauugcaaccauaacaccucaagcucccacgucggaaauacagcugacugacuacggagcccuuacauuggacugcucaccuagaacagggcuggacuuuaaugagauggugcuguugacaaugaaagaaaaaucauggcuuguccacaaacaaugguuucuagacuuaccauuaccuuggaccucgggggcuucaacaucucaagagacuuggaacagacaagaucugcuggucacauuuaagacagcucaugcaaagaagcaggaaguagucguacuggggucacaagaaggagcaaugcacacugcguugacuggggcgacagaaauccagacgucaggaacgacgacaaucuucgcaggacaccugaaauguagacuaaaaauggauaaacugacuuuaaaaggggugucauaugugaugugcacaggcucauuuaagcuagagaaggaaguggcugagacccagcauggaacuguccuagugcagguuaaauaugaaggaacagaugcaccaugcaagauuccaauuucaacccaagaugagaaaggagugacccagaaugggagauugauaacagccaaucccauaguuacugacaaagaaaaaccaaucaacauugaaacagaaccacccuuuggugagagcuacaucgugauaggggcgggugaaaaagcuuugaaacuaagcugguucaagaaaggaagcagcauagggaaaauguucgaagccaccgcccgaggagcacgaaggauggcuauccugggagacacagcaugggacuucgguuccauaggagggguguucacaucugugggaaaauugguacaccagguuuuuggaaccgcauaugggguccuguucagcgguguuucuuggaccaugaaaauaggaauagggauucugcugacauggcuaggauugaauucaaggagcacgucacucucgaugacgugcauugcaguuggcauggucacacuguaccuaggagucaugguucaagcggacucggggugugugaucaacuggaagggcagagaacucaaguguggaaguggcaucuuugucacuaaugaaguccacacuuggacagagcaauacaaauuucaggcugacuccccaaaaagacuaucagcagccauugggaaggcaugggaggaaggcguguguggaauucgaucagccacacgucuugagaacaucauguggaagcaaauaucaaaugaauugaaccacauucuacuugaaaaugacaugaaauucacagugguuguaggagacgccaauggaaucuugacccaaggaaaaaagaugauuaggccacaacccauggaacacaaauacucauggaaaagcuggggaaaagccaaaaucauaggagcagauacacagaauacuaccuucaucaucgauggcccagacacuccagaaugccccgaugaccagagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaacgagaccuggaagcuagcgagagccuccuucauagaagugaagacaugcaucuggccaagaucccacacucuauggagcaauggagucuuggaaagugaaaugauaaucccaaagauauauggaggaccaauaucucagcacaacuacagaccaggguauuucacacaaacagcagggccauggcaccuaggcaaguuggaacuagacuuuaauuugugugaaggcaccacaguuguuguggaugaacauuguggaaaucgagguccaucucuuagaacuacaacagucacaggaaagauaauccaugaauggugcugcagauccugcacgcuaccccccuuacgcuucagaggagaagacggauguugguauggcauggaaaucagaccagucaaggagaaggaagagaaucuagucaggucaauggucucugcagggucaggagaaguggacaguuuuucauugggacuacuaugcguaucaauaaugauugaagaagugaugagauccagauggaguagaaagaugcugaugacuggaacacuggcuguuuucuuccuucuuauaaugggacaacugacauggaaugaucugaucagguuaugcaucaugguuggagccaaugucucagacagaauggggaugggaacaacguaccuagcuuuaauggccacuuuuaaaaugagaccgauguucgcuguugggcuauuauuucgcagacuaacauccagagaggugcuccuucucacaauuggacuaagccugguggcauccguggagcuaccaaauucuuuagaggagcuaggggacggacuugcgaugggcaucaugauguuaaaauuguugacugauuuucagucacaccaguuguggacuaccuuacugucucugacauucaucaaaacaacucuuucacuagauuaugcauggaagacaauggcuaugguauugucaaucguaucucucuuuccucuaugucuauccacgaccucucaaaaaacaacauggcuuccgguguuguuaggauccuuuggauguaaaccacuaaccauguuucuuauaacagaaaacaaaauuuggggaaggaaaaguuggccccucaaugaaggaauuauggcuguuggaauagucagcauuuuacuaaguucacuccucaaaaaugacgugccacuagccggcccacuaauagcuggaggcaugcugauagcauguuacgucauuuccggaagcucagccgauuuaucauuggagagagcggcugaggucuccugggaagaagaagcagaacacucuggugccucacacaacauacuaguggagguccaagaugauggaaccaugaaaauaaaagaugaagagagagaugacacgcucacuauacuccucaaagcaacuuuguuggcaguuucagggguguacccaaugucaauaccagcaacccuuuuugugugguauuuuuggcagaaaaagaaacagagaucaggagucuugugggacacacccagcccuccagaaguagaaagagcaguucuugaugaugguaucuauagaaucuugcaaagaggacuguuggguaggucccagguaggagugggaguuuuucaagacggcguguuccacacaauguggcaugucaccaggggggcuguccucauguaccaagggaagaggcuggaaccaaguugggccagugucaaaaaagacuugaucucauauggaggagguuggagguuucaaggaucauggaacacgggagaagaaguacaggugauagcuguugaaccagggaaaaacccaaagaauguacagacaacgccgggcaccuucaagaccccugaaggcgaaguuggagccauagcccuagauuucaaaccuggcacaucuggaucucccaucgugaacagagaggggaaaauaguaggucuuuauggaaauggaguggugacaacaaguggaaccuacgucagugccauugcccaagcuaaagcgucacaagaagggccucuaccagagauugaggacgagguguuuaagaaaagaaaccuaacaauaauggaccuacauccaggaucaggaaaaacaagaagauaucuuccagccauaguccgugaggccauaaaaaggaaacugcgcacgcuaaucuuggcucccacaagaguugucgccucugaaauggcagaggcgcuuaaaggaaugccaauaagauaucagacaacagcaguaaagagugaacacacaggaaaggagauagucgaucucaugugccacgccacuuucaccaugcgucuccuaucuccagugagaguucccaauuacaacaugauuaucauggaugaagcacacuuuaccgauccagccagcauagcggccagaggguacaucucaacccgaguggguaugggugaagcagcugcgaucuucaugacagccacucccccaggaucgguagaggccuuuccacagagcaaugcaguuauccaagaugaggaaagagacauuccugagagaucauggaacucaggcuacgacuggaucacugacuucccaggaaaaacagucugguuuguuccaagcaucaaaucaggaaaugacauugccaacugcuuaagaaaaaacgggaaacgggugauccaauugagcagaaaaaccuuugacacugaauaccagaaaacgaaaaacaaugauugggacuauguugucacaacagacauuuccgaaaugggagcaaauuuccgggccgauaggguaauagacccaaggcggugcuugaagccgguaauacuaaaagauggcccagagcgcgucauucuggccggaccaaugccagugaccgcggccagugcugcccagaggagaggaagaauuggaaggaaccaaaacaaggaaggugaccaguauauuuacaugggacagccuuuaaauaaugaugaggaccacgcucauuggacagaagcaaaaaugcuccuugacaauauaaauacgccagaagggauuaucccagcccucuuugagccagagagagaaaagagugcagcaauagacggggaguauagacugcggggagaagcaaggaaaacguucguggagcuaaugagaagaggggaucuaccaguuuggcuaucuuacaaaguugccucagaaggcuuccaguacuccgacagaagauggugcuuugacggggaaaggaacaaccagguguuggaggagaacauggacguggagaucuggacaaaagaaggagaaagaaagaaauugcgaccucgcugguuagaugccagaaccuacucugauccacuggcccugcgcgaguuuaaggaguucgcagcaggaagaagaagugucucaggugaccuaauauuagaaauagggaaacucccacagcauuugacgcuaagggcccagaaugcuuuggacaacuuggucauguugcacaauuccgaacaagggggaaaagccuauagacaugcuauggaagaacuaccagacaccauagaaacauugaugcuacuagccuugauagcugugcugacugguggaguuacguuguuuuuccuaucaggaaaaggucuagggaaaacauccauuggccuacuuuguguaauggccucaaguguacuguuauggauggccaguguggagccccauuggauagcggccuccaucauacuagaguuuuuucugauggugcugcuuauuccagagccagacagacagcguacuccacaggacaaucaacuagcauauguggugauagguuuguuauucaugauauugacaguggcagccaaugagaugggauuacuggaaaccacaaagaaagaccuggggauuggccauguagucgccgaaaaccaccaccaugccacaaugcuagacauagacuuacauccagcuucagccuggacccucuaugcaguagccacaacaauuaucacucccaugaugagacacacaauugaaaacacaacggcaaacauuucccugacagcuauugcaaaucaggcggcuauauuaaugggacuugacaagggauggccaauaucgaagauggacauaggagugccacuucucgccuuagggugcuauucccaggugaacccauugacacugacagcggcgguguuaauguuaguggcucauuaugccauaauuggaccuggacugcaagcaaaagcuaccagagaagcccaaaaaaggacugcggccggaauaaugaaaaauccaacuguagacgggauuguugcaauagauuuggauccugugguuuaugaugcaaaauuugaaaaacagcuaggccaaauaauguuacuaauacucugcacaucacagauucucuugaugcggacuacaugggccuuaugugaaucuaucacacuggcuacuggacccuugaccacucucugggagggaucuccuggaaaauucuggaauaccacgauagcaguguccauggcaaacaucuucaggggaaguuauuuagcaggggcaggucuggccuucucauuaaugaaaucuuuaggaggagguaggagagguacgggagcucaaggggaaacauugggagaaaaauggaaaagacaacuaaaccaacugagcaagucagaauuuaacacuuacaaaaggaguggaauuauggagguggacagauccgaagccaaggagggacugaaaagaggagaaacaaccaaacaugcagugucgagaggaacagccaaacuuaggugguuuguggagaggaaccuugugaaaccggaagggaaagugauagaccucgguuguggaagagguggcuggucauauuacugcgcugggcugaagaaggucacagaaguaaagggauacacaaaaggaggacccggucaugaggaaccuaucccaauggcgacuuauggauggaacauagugaagcuacacucuggaagggauguauucuuuacaccaccugagaaaugugacacccuuuugugugauauuggugaguccucuccgaauccaacuauagaagaaggaagaacguuacguguucuaaagaugguggaaccauggcucagaggaaaucaguuuugcauaaaaauccuaaauccuuacaugccaagugugguagaaacucuggagcaaaugcaaagaaaacauggagggaugcuagugcgaaacccacucucaagaaauuccacccaugaaauguacugggucucauguggaacaggaaacauugugucggcagugaacaugacauccagaaugcugcugaaucgguucacaauggcucacaggaagccaacguaugaaagagacguggacuugggcgcuggaacaagacauguggcaguggaaccagagauagccaaccuagacauuauuggccagaggauagagaacauaaaaaaugaacauaagucaacauggcauuaugaugaggacaauccauacaaaacaugggccuaucauggaucauaugaggucaagccaucagggucagccucauccauggugaauggcguggugagauugcucaccaagccaugggauguuauccccauggucacacaaauagcuaugacugauaccacacccuucggacaacagaggguuuucaaagagaaaguugacacacgcacaccaagaccaaaacgaggcacagcacaaauuauggaggugacagccaagugguuguggggauuccucucuagaaauaaaaaacccagaaucugcacaagagaggaguucacaagaaaaguuaggucaaacgcagcaauuggagcaguguuuguugaugaaaaccaauggaacucagcaaaagaagcaguggaagacgaaagguuuugggaccucgugcacagagagagggagcuucauaaacagggaaaaugugccacgugugucuacaauaugauggguaaaagagagaaaaaacuaggagaguuuggaaaggcaaaaggaagucgugcaauaugguacaugugguugggagcacgcuuucuagaauuugaagcccuuggcuucaugaaugaagaccacugguucaguagggagaauucacucaguggaguggaaggagaaggacuacauaaacuuggauacauacucagagacauaucaaagauuccagggggaaauauguaugcagacgacacagcuggaugggacacaagaauaacagaggaugaucuucagaaugaggcuaaaaucaccgacaucauggagccugaacaugcucuacuggcuacgucaaucuucaagcugaccuaucaaaauaaggugguaagggugcaaagaccagcaaaaaguggaaccgugauggacgucauauccagacgugaccagagaggaaguggacaggucggaacuuauggccuaaacacuuucaccaacauggagguccaacuaauaagacaaauggaaucugaaggaaucuuuucacccagcgaauuggaaaauucaaaucuagcugagagaguucucgacugguuggaaaaacauggcgucgaaagguugaaaagaauggcaaucagcggagaugacuguguggugaaaccaacugaugacagguucgcaacagcuuuaacagcccugaaugacaugggaaaggugagaaaagacauaccgcaaugggaaccuucaaaaggauggaaugacuggcagcaagugccuuucuguucacaccacuuccaccaacugauuaugaaggaugggagggagauaguggugccaugccgcaaccaagaugaacuugugggcagggccagaguaucacaaggcgccggguggagccugagagaaacugcuugccuaggcaagucauaugcacaaauguggcagcugauguacuuccacaggagagaccugagacuggcggcuaaugcuaucuguucagccguuccaguuaauugggucccaaccagccgcaccaccuggucgauccaugcccaccaucaauggaugacaacagaagacauguugucaguauggaauaggguuuggauagaggaaaacccauggauggaggacaaaacucauguauccagcugggaagauguuccauacuuaggaaaaagggaagaucaaugguguggaucucugauaggcuuaacagcaagagccaccugggccaccaacauacaaguggccauaaaccaagugagaaggcuuauugggaacgagaauuauuuagacuacaugacaucaaugaagagauucaagaaugagagugaucccgaaggagcccucugguaa

SEQ ID NO: 6314 - RNA, 9879 nt, Artificial Sequence
  derived and/or modified CDS sequence (wt) from DENV-1__KM403632__SS-prME
uccgugaccaugcuccucaugcugcugcccacagcccuggcguuccauuugaccacacgagggggagagccacacaugauaguuagcaagcaggaaagaggaaagucacucuuguuuaagaccucugcaggugucaacaugugcacccucauugcaauggauuugggagaguuaugugaggauacaaugaccuacaaaugcccccggaucacugaagcggaaccagaugauguugauugcuggugcaaugccacagacacaugggugaccuaugggacguguucucagacuggcgaacaccgacgggauaaacguucugucgcauuggccccacacguggggcuuggucucgaaacaagaaccgaaacguggauguccucugaaggcgccuggaggcagauacaaaaaguggagacuugggccuugagacacccaggauucacggugauagcccuuuuuuuagcacaugccauaggaacauccauuacccagaaagggaucaucuucauuuugcugaugcuggugacaccaucaauggccaugcgaugcgugggaauaggcaacagagacuucguugaaggacugucaggagcaacauggguggaugugguacuggagcauggaagcugugucaccaccauggcaaagaauaaaccaacacuggacauugaacucuugaagacggaggucacgaacccugccgucuugcgcaaacugugcauugaagcuaaaauaucaaacaccaccaccgauucaagauguccaacacaaggagaagcuacacugguggaagaacaagacgcgaacuuugugugucgacgaacauucguggacagaggcugggguaaugguuguggacuauucgggaagggaagcuuacuaacgugugcuaaguuuaggugugugacaaaacuugaaggaaagauaguucaauaugaaaacuuaaaauauucggugauagucacuguccacacuggggaccagcaccagguaggaaaugagacuacagaacauggaacaauugcaaccauaacaccucaagcucccacgucggaaauacagcugacugacuacggagcccuuacauuggacugcucaccuagaacagggcuggacuuuaaugagauggugcuguugacaaugaaagaaaaaucauggcuuguccacaaacaaugguuucuagacuuaccauuaccuuggaccucgggggcuucaacaucucaagagacuuggaacagacaagaucugcuggucacauuuaagacagcucaugcaaagaagcaggaaguagucguacuggggucacaagaaggagcaaugcacacugcguugacuggggcgacagaaauccagacgucaggaacgacgacaaucuucgcaggacaccugaaauguagacuaaaaauggauaaacugacuuuaaaaggggugucauaugugaugugcacaggcucauuuaagcuagagaaggaaguggcugagacccagcauggaacuguccuagugcagguuaaauaugaaggaacagaugcaccaugcaagauuccaauuucaacccaagaugagaaaggagugacccagaaugggagauugauaacagccaaucccauaguuacugacaaagaaaaaccagucaacauugaaacagaaccacccuuuggugagagcuacaucgugauaggggcgggugaaaaagcuuugaaacuaagcugguucaagaaaggaagcagcauagggaaaauguucgaagccaccgcccgaggagcacgaaggauggcuauccugggagacacagcaugggacuucgguuccauaggagggguguucacaucugugggaaaauugguacaccagguuuuuggaaccgcauaugggguccuguucagcgguguuucuuggaccaugaaaauaggaauagggauucugcugacauggcuaggauugaauucaaggagcacgucacucucgaugacgugcauugcaguuggcauggucacacuguaccuaggagucaugguucaagcggacucggggugugugaucaacuggaagggcagagaacucaaguguggaaguggcaucuuugucacuaaugaaguccacacuuggacagagcaauacaaauuucaggcugacuccccaaaaagacuaucagcagccauugggaaggcaugggaggaaggcguguguggaauucgaucagccacacgucuugagaacaucauguggaagcaaauaucaaaugaauugaaccacauucuacuugaaaaugacaugaaauucacagugguuguaggagacgccaauggaaucuugacccaaggaaaaaagaugauuaggccacaacccauggaacacaaauacucauggaaaagcuggggaaaagccaaaaucauaggagcagauacacagaauacuaccuucaucaucgauggcccagacacuccagaaugccccgaugaccagagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaacgagaccuggaagcuagcgagagccuccuucauagaagugaagacaugcaucuggccaagaucccacacucuauggagcaauggagucuuggaaagugaaaugauaaucccaaagauauauggaggaccaauaucucagcacaacuacagaccaggguauuucacacaaacagcagggccauggcaccuaggcaaguuggaacuagacuuuaauuugugugaaggcaccacaguuguuguggaugaacauuguggaaaucgagguccaucucuuagaacuacaacagucacaggaaagauaauccaugaauggugcugcagauccugcacgcuaccccccuuacgcuucagaggagaagacggauguugguauggcauggaaaucagaccagucaaggagaaggaagagaaucuagucaggucaauggucucugcagggucaggagaaguggacaguuuuucauugggacuacuaugcguaucaauaaugauugaagaagugaugagauccagauggaguagaaagaugcugaugacuggaacacuggcuguuuucuuccuucuuauaaugggacaacugacauggaaugaucugaucagguuaugcaucaugguuggagccaaugucucagacagaauggggaugggaacaacguaccuagcuuuaauggccacuuuuaaaaugagaccgauguucgcuguugggcuauuauuucgcagacuaacauccagagaggugcuccuucucacaauuggacuaagccugguggcauccguggagcuaccaaauucuuuagaggagcuaggggacggacuugcgaugggcaucaugauguuaaaauuguugacugauuuucagucacaccaguuguggacuaccuuacugucucugacauucaucaaaacaacucuuucacuagauuaugcauggaagacaauggcuaugguauugucaaucguaucucucuuuccucuaugucuauccacgaccucucaaaaaacaacauggcuuccgguguuguuaggauccuuuggauguaaaccacuaaccauguuucuuauaacagaaaacaaaauuuggggaaggaaaaguuggccccucaaugaaggaauuauggcuguuggaauagucagcauuuuacuaaguucacuccucaaaaaugacgugccacuagccggcccacuaauagcuggaggcaugcugauagcauguuacgucauuuccggaagcucagccgauuuaucauuggagagagcggcugaggucuccugggaagaagaagcagaacacucuggugccucacacaacauacuaguggagguccaagaugauggaaccaugaaaauaaaagaugaagagagagaugacacgcucacuauacuccucaaagcaacuuuguuggcaguuucagggguguacccaaugucaauaccagcaacccuuuuugugugguauuuuuggcagaaaaagaaacagagaucaggagucuugugggacacacccagcccuccagaaguagaaagagcaguucuugaugaugguaucuauagaaucuugcaaagaggacuguuggguaggucccagguaggagugggaguuuuucaagacggcguguuccacacaauguggcaugucaccaggggggcuguccucauguaccaagggaagaggcuggaaccaaguugggccagugucaaaaaagacuugaucucauauggaggagguuggagguuucaaggaucauggaacacgggagaagaaguacaggugauagcuguugaaccagggaaaaacccaaagaauguacagacaacgccgggcaccuucaagaccccugaaggcgaaguuggagccauagcccuagauuucaaaccuggcacaucuggaucucccaucgugaacagagaggggaaaauaguaggucuuuauggaaauggaguggugacaacaaguggaaccuacgucagugccauugcccaagcuaaagcgucacaagaagggccucuaccagagauugaggacgagguguuuaagaaaagaaaccuaacaauaauggaccuacauccaggaucaggaaaaacaagaagauaucuuccagccauaguccgugaggccauaaaaaggaaacugcgcacgcuaaucuuggcucccacaagaguugucgccucugaaauggcagaggcgcuuaaaggaaugccaauaagauaucagacaacagcaguaaagagugaacacacaggaaaggagauagucgaucucaugugccacgccacuuucaccaugcgucuccuaucuccagugagaguucccaauuacaacaugauuaucauggaugaagcacacuucaccgauccagccagcauagcggccagaggguacaucucaacccgaguggguaugggugaagcagcugcgaucuucaugacagccacucccccaggaucgguagaggccuuuccacagagcaaugcaguuauccaagaugaggaaagagacauuccugagagaucauggaacucaggcuacgacuggaucacugacuucccaggaaaaacagucugguuuguuccaagcaucaaaucaggaaaugacauugccaacugcuuaagaaaaaacgggaaacgggugauccaauugagcagaaaaaccuuugacacugaauaccagaaaacgaaaaacaaugauugggacuauguugucacaacagacauuuccgaaaugggagcaaauuuccgggccgauaggguaauagacccaaggcggugcuugaagccgguaauacuaaaagauggcccagagcgcgucauucuggccggaccaaugccagugaccgcggccagugcugcccagaggagaggaagaauuggaaggaaccaaaacaaggaaggugaccaguauauuuacaugggacagccuuuaaauaaugaugaggaccacgcucauuggacagaagcaaaaaugcuccuugacaauauaaauacgccagaagggauuaucccagcccucuuugagccagagagagaaaagagugcagcaauagacggggaguauagacugcggggagaagcaaggaaaacguuuguggagcuaaugagaagaggggaucuaccaguuuggcuaucuuacaaaguugccucagaaggcuuccaguacuccgacagaagauggugcuuugacggggaaaggaacaaccagguguuggaggagaacauggacguggagaucuggacaaaagaaggagaaagaaagaaauugcgaccucgcugguuagaugccagaaccuacucugauccacuggcccugcgcgaguuuaaggaguucgcagcaggaagaagaagugucucaggugaccuaauauuagaaauagggaaacucccacagcauuugacgcuaagggcccagaaugcuuuggacaacuuggucauguugcacaauuccgaacaagggggaaaagccuauagacaugcuauggaagaacuaccagacaccauagaaacauugaugcuacuagccuugauagcugugcugacugguggaguuacguuguuuuuccuaucaggaaaaggucuagggaaaacauccauuggccuacuuuguguaauggccucaaguguacuguuauggauggccaguguggagccccauuggauagcggccuccaucauacuagaguuuuuucugauggugcugcuuauuccagagccagacagacagcguacuccacaggacaaucaacuagcauauguggugauagguuuguuauucaugauauugacaguggcagccaaugagaugggauuacuggaaaccacaaagaaagaccuggggauuggccauguagucgccgaaaaccaccaccaugccacaaugcuagacauagacuuacauccagcuucagccuggacccucuaugcaguagccacaacaauuaucacucccaugaugagacacacaauugaaaacacaacggcaaacauuucccugacagcuauugcaaaucaggcggcuauauuaaugggacuugacaagggauggccaauaucgaagauggacauaggagugccacuucucgccuuagggugcuauucccaggugaacccauugacacugacagcggcgguguuaauguuaguggcucauuaugccauaauuggaccuggacugcaagcaaaagcuaccagagaagcccaaaaaaggacugcggccggaauaaugaaaaauccaacuguagacgggauuguugcaauagauuuggauccugugguuuaugaugcaaaauuugaaaaacagcuaggccaaauaauguuacuaauacucugcacaucacagauucucuugaugcggacuacaugggccuuaugugaaucuaucacacuggcuacuggacccuugaccacucucugggagggaucuccuggaaaauucuggaauaccacgauagcaguguccauggcaaacaucuucaggggaaguuauuuagcaggggcaggucuggccuucucauuaaugaaaucuuuaggaggagguaggagagguacgggagcucaaggggaaacauugggagaaaaauggaaaagacaacuaaaccaacugagcaagucagaauuuaacacuuacaaaaggaguggaauuauggagguggacagauccgaagccaaggagggacugaaaagaggagaaacaaccaaacaugcagugucgagaggaacagccaaacuuaggugguuuguggagaggaaccuugugaaaccggaagggaaagugauagaccucgguuguggaagagguggcuggucauauuacugcgcugggcugaagaaggucacagaaguaaagggauacacaaaaggaggacccggucaugaggaaccuaucccaauggcgacuuauggauggaacauagugaagcuacacucuggaagggauguauucuuuacaccaccugagaaaugugacacccuuuugugugauauuggugaguccucuccgaauccaacuauagaagaaggaagaacguuacguguucuaaagaugguggaaccauggcucagaggaaaucaguuuugcauaaaaauccuaaauccuuauaugccaagugugguagaaacucuggagcaaaugcaaagaaaacauggagggaugcuagugcgaaacccacucucaagaaauuccacccaugaaauguacugggucucauguggaacaggaaacauugugucggcagugaacaugacauccagaaugcugcugaaucgguucacaauggcucacaggaagccaacguaugaaagagacguggacuugggcgcuggaacaagacauguggcaguggaaccagagauagccaaccuagacauuauuggccagaggauagagaacauaaaaaaugaacauaagucaacauggcauuaugaugaggacaauccauacaaaacaugggccuaucauggaucauaugaggucaagccaucagggucagccucauccauggugaauggcguggugagauugcucaccaagccaugggauguuauccccauggucacacaaauagcuaugacugauaccacacccuucggacaacagaggguuuucaaagagaaaguugacacacgcacaccaagaccaaaacgaggcacagcacaaauuauggaggugacagccaagugguuguggggauuccucucuagaaauaaaaaacccagaaucugcacaagagaggaguucacaagaaaaguuaggucaaacgcagcaauuggagcaguguuuguugaugaaaaccaauggaacucagcaaaagaagcaguggaagacgaaagguuuugggaccucgugcacagagagagggagcuucauaaacagggaaaaugugccacgugugucuacaauaugauggguaaaagagagaaaaaacuaggagaguuuggaaaggcaaaaggaagucgugcaauaugguacaugugguugggagcacgcuuucuagaauuugaagcccuuggcuucaugaaugaagaccacugguucaguagggagaauucacucaguggaguggaaggagaaggacuacauaaacuuggauacauacucagagacauaucaaagauuccagggggaaauauguaugcagacgacacagcuggaugggacacaagaauaacagaggaugaucuccagaaugaggcuaaaaucaccgacaucauggagccugaacaugcucuacuggcuacgucaaucuucaagcugaccuaucaaaauaaggugguaagggugcaaagaccagcaaaaaguggaaccgugauggacgucauauccagacgugaccagagaggaaguggacaggucggaacuuauggccuaaacacuuucaccaacauggagguccaacuaauaagacaaauggaauccgaaggaaucuuuucacccagcgaauuggaaaauucaaaucuagcugagagaguucucgacugguuggaaaaacauggcgucgaaagguugaaaagaauggcaaucagcggagaugacuguguggugaaaccaacugaugacagguucgcaacagcuuuaacagcccugaaugacaugggaaaggugagaaaagacauaccgcaaugggaaccuucaaaaggauggaaugacuggcagcaagugccuuucuguucacaccacuuccaccaacugauuaugaaggaugggagggagauaguggugccaugccgcaaccaagaugaacuugugggcagggccagaguaucacaaggcgccggguggagccugagagaaacugcuugccuaggcaagucauaugcacaaauguggcagcugauguacuuccacaggagagaccugagacuggcggcuaaugcuaucuguucagccguuccaguuaauugggucccaaccagccgcaccaccuggucgauccaugcccaccaucaauggaugacaacagaagacauguugucaguauggaauaggguuuggauagaggaaaacccauggauggaggacaaaacucauguauccagcugggaagauguuccauacuuaggaaaaagggaagaucaaugguguggaucucugauaggcuuaacagcaagagccaccugggccaccaacauacaaguggccauaaaccaagugagaaggcuuauugggaacgagaauuauuuagacuacaugacaucaaugaagagauucaagaaugagagugaucccgaaggagcccucugguaa

SEQ ID NO: 6315 - RNA, 9879 nt, Artificial Sequence
  derived and/or modified CDS sequence (wt) from DENV-1__KM403583__SS-prME
uccgugaccaugcuccucaugcugcugcccacagcccuggcguuccauuugaccacacgagggggagagccacacaugauaguuagcaagcaggaaagaggaaagucacucuuguuuaagaccucugcaggugucaacaugugcacccucauugcaauggauuugggagaguuaugugaggauacaaugaccuacaaaugcccccggaucacugaagcggaaccagaugauguugauugcuggugcaaugccacagacacaugggugaccuaugggacguguucucagacuggcgaacaccgacgggauagacguucugucgcauuggccccacacguggggcuuggucucgaaacaagaaccgaaacguggauguccucugaaggcgccuggaggcagauacaaagaguggagacuugggccuugagacacccaggauucacggugauagcccuuuuuuuagcacaugccauaggaacauccauuacccagaaagggaucaucuucauuuugcugaugcuggugacaccaucaauggccaugcgaugcgugggaauaggcaacagagacuucguugaaggacugucaggagcaacauggguggaugugguacuggagcauggaagcugugucaccaccauggcaaagaauaaaccaacauuggacauugaacucuugaagacggaggucacgaacccugccgucuugcgcaaacugugcauugaagcuaaaauaucaaacaccaccaccgauucaagauguccaacacaaggagaagcuacacugguggaagaacaagacgcgaacuuugugugucgacgaacauucguggacagaggcugggguaaugguuguggacuauucgggaagggaagcuuacuaacgugugcuaaguuuaagugugugacaaaacuugaaggaaagauaguucaauaugaaaacuuaaaauauucggugauagucacuguccacacuggggaccagcaccagguaggaaaugagacuacagaacauggaacaauugcaaccauaacaccucaagcucccacgucggaaauacagcugacugacuacggagcccuuacauuggacugcucaccuagaacagggcuggacuuuaaugagauggugcuguugacaaugaaagaaaaaucauggcuuguccacaaacaaugguuucuagacuuaccauugccuuggaccucgggggcuucaacaucucaagagacuuggaacagacaagaucugcuggucacauuuaagacagcucaugcaaagaagcaggaaguagucguacuggggucacaagaaggagcaaugcacacugcguugacuggggcgacagaaauccagacgucaggaacgacgacaaucuucgcaggacaccugaaauguagacuaaaaauggauaaacugacuuuaaaaggggugucauaugugaugugcacaggcucauuuaagcuagagaaggaaguggcugagacccagcauggaacuguccuagugcagguuaaauaugaaggaacagaugcaccaugcaagauuccaauuucaacccaagaugagaaaggagugacccagaaugggagauugauaacagccaaucccauaguuacugacaaagaaaaaccagucaacauugaaacagaaccacccuuuggugagagcuacaucgugauaggggcgggugaaaaagcuuugaaacuaagcugguucaagaaaggaagcagcauagggaaaauguucgaagccaccgcccgaggagcacgaaggauggcuauccugggagacacagcaugggacuucgguuccauaggagggguguucacaucugugggaaaauugguacaccagguuuuuggaaccgcauaugggguccuguucagcgguguuucuuggaccaugaaaauaggaauagggauucugcugacauggcuaggauugaauucaaggagcacgucacucucgaugacgugcauugcaguuggcauggucacacuguaccuaggagucaugguucaagcggacucggggugugugaucaacuggaagggcagagaacucaaguguggaaguggcaucuuugucacuaaugaaguccacacuuggacagagcaauacaaauuucaggcugacuccccaaaaagacuaucagcagccauugggaaggcaugggaggaaggcguguguggaauucgaucagccacacgucuugagaacaucauguggaagcaaauaucaaaugaauugaaccacauucuacuugaaaaugacaugaaauucacagugguuguaggagacgccaauggaaucuugacccaaggaaaaaagaugauuaggccacaacccauggaacacaaauacucauggaaaagcuggggaaaagccaaaaucauaggagcagauacacagaauacuaccuucaucaucgauggcccagacacuccagaaugccccgaugaccagagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaacgagaccuggaagcuagcgagagccuccuucauagaagugaagacaugcaucuggccaagaucccacacucuauggagcaauggagucuuggaaagugaaaugauaaucccaaagauauauggaggaccaauaucucagcacaacuacagaccaggguauuucacacaaacagcagggccauggcaccuaggcaaguuggaacuagacuuuaauuugugugaaggcaccacaguuguuguggaugaacauuguggaaaucgagguccaucucuuagaacuacaacagucacaggaaagauaauccaugaauggugcugcagauccugcacgcuaccccccuuacgcuucagaggagaagacggauguugguauggcauggaaaucagaccaguuaaggagaaggaagagaaucuagucaggucaauggucucugcagggucaggagaaguggacaguuuuucauugggacuacuaugcguaucaauaaugauugaagaagugaugagauccagauggaguagaaagaugcugaugacuggaacacuggcuauuuucuuccuucuuauaaugggacaacugacauggaaugaucugaucagguuaugcaucaugguuggagccaaugucucagacagaauggggaugggaacaacguaccuagcuuuaauggccacuuuuaaaaugagaccgauguucgcuguugggcuauuauuucgcagacuaacauccagagaggugcuccuucucacaauuggacuaagccugguggcauccguggagcuaccaaauucuuuagaggagcuaggggacggacuugcgaugggcaucaugauguuaaaauuguugacugauuuucagucacaccaguuguggacuaccuuacugucucugacauucaucaaaacaacucuuucacuggauuaugcauggaagacaauggcuaugguauugucaaucguaucucucuuuccucuaugucuauccacgaccucucaaaaaacaacauggcuuccgguguuguuaggauccuuuggauguaaaccacuaaccauguuucuuauaacagaaaacaaaauuuggggaaggaaaaguuggccccucaaugaaggaauuauggcuguuggaauagucagcauuuuacuaaguucacuccucaaaaaugacgugccacuagccggcccacuaauagcuggaggcaugcugauagcauguuacgucauuuccggaagcucagccgauuuaucauuggagagagcggcugaggucuccugggaagaagaagcagaacacucuggugccucacacaacauacuaguggagguccaagaugauggaacuaugaaaauaaaagaugaagagagagaugacacgcucacuauacuccucaaagcaacuuuguuggcaguuucagggguguacccaaugucaauaccagcaacccuuuuugugugguauuuuuggcagaaaaagaaacagagaucaggagucuugugggacacacccagcccuccagaaguagaaagagcaguucuugaugaugguaucuauagaaucuugcaaagaggacuguuggguaggucccagguaggagugggaguuuuucaagacggcguguuccacacaauguggcaugucaccaggggggcuguccucauguaccaagggaagaggcuggaaccaaguugggccagugucaaaaaagacuugaucucauauggaggagguuggagguuucaaggaucauggaacacgggagaagaaguacaggugauagcuguugaaccagggaaaaacccaaagaauguacagacaacgccgggcaccuucaagaccccugaaggcgaaguuggagccauagcccuagauuucaaaccuggcacaucuggaucucccaucgugaacagagaggggaaaauaguaggucuuuauggaaauggaguggugacaacaaguggaaccuacgucagugccauugcccaagcuaaagcgucacaagaagggccucuaccagagauugaggacgagguguuuaagaaaagaaaccuaacaauaauggaccuacauccaggaucaggaaaaacaagaagauaucuuccagccauaguccgugaggccauaaaaaggaaacugcgcacgcuaaucuuggcucccacaagaguugucgccucugaaauggcagaggcgcuuaaaggaaugccaauaagauaucagacaacagcaguaaagagugaacacacaggaaaggagauagucgaucucaugugccacgccacuuucaccaugcgucuccuaucuccagugagaguucccaauuacaacaugauuaucauggaugaagcacacuuuaccgauccagccagcauagcggccagaggguacaucucaacccgaguggguaugggugaagcagcugcgaucuuuaugacagccacucccccaggaucgguagaggccuuuccacagagcaaugcaguuauccaagaugaggaaagagacauuccugagagaucauggaacucaggcuacgacuggaucacugauuucccaggaaaaacagucugguuuguuccaagcaucaaaucaggaaaugacauugccaacugcuuaagaaaaaacgggaaacgggugauccaauugagcagaaaaaccuuugacacugaauaccagaaaacgaaaaacaaugauugggacuauguugucacaacagacauuuccgaaaugggagcaaauuuccgggccgauaggguaauagacccaaggcggugcuugaagccgguaauacuaaaagauggcccagagcgcgucauucuggccggaccaaugccagugaccgcggccagugcugcccagaggagaggaagaauuggaaggaaccaaaacaaggaaggugaccaguauauuuacaugggacagccuuuaaauaaugaugaggaccacgcucauuggacagaagcaaaaaugcuccuugacaauauaaauacgccagaagggauuaucccagcccucuuugagccagagagagaaaagagugcagcaauagacggggaguauagacugcggggagaagcaaggaaaacguucguggagcuaaugagaagaggggaucuaccaguuuggcuaucuuacaaaguugccucagaaggcuuccaguacuccgacagaagauggugcuuugacggggaaaggaacaaccagguguuggaggagaacauggacguggagaucuggacaaaagaaggagaaagaaagaaauugcgaccucgcugguuagaugccagaaccuacucugauccacuggcccugcgcgaguuuaaagaguucgcagcaggaagaagaagugucucaggugaccuaauauuagaaauagggaaacucccacagcauuugacgcuaagggcccagaaugcuuuggacaacuuggucauguugcacaauuccgaacaagggggaaaagccuauagacaugcuauggaagaacuaccagacaccauagaaacauugaugcuacuagccuugauagcugugcugacugguggaguuacguuguuuuuccuaucaggaaaaggucuagggaaaacauccauuggccuacuuuguguaauggccucaaguguacuguuauggauggccaguguggagccccauuggauagcggccuccaucauacuagaguuuuuucugauggugcugcuuauuccagagccagacagacagcguacuccacaggacaaucaacuagcauauguggugauagguuuguuauucaugauauugacaguggcagccaaugagaugggauuacuggaaaccacaaagaaagaccuggggauuggccauguagucgccgaaaaccaccaccaugccacaaugcuagacauagacuuacauccagcuucagccuggacccucuaugcaguagccacaacaauuaucacucccaugaugagacacacaauugaaaacacaacggcaaacauuucccugacagcuauugcaaaucaggcggcuauauuaaugggacuugacaagggauggccaauaucgaagauggacauaggagugccacuucucgccuuagggugcuauucccaggugaacccauugacacugacagcggcgguguuaauguuaguggcucauuaugccauaaucggaccuggacugcaagcaaaagcuaccagagaagcccaaaaaaggacugcggccggaauaaugaaaaauccaacuguagacgggauuguugcaauagauuuggauccugugguuuaugaugcaaaauuugaaaaacagcuaggccaaauaauguuacuaauacucugcacaucacagauucucuugaugcggacuacaugggccuuaugugaaucuaucacacuggcuacuggacccuugaccacucucugggagggaucuccuggaaaauucuggaauaccacgauagcaguguccauggcaaacaucuucaggggaaguuauuuagcaggggcaggucuggccuucucauuaaugaaaucuuuaggaggagguaggagagguacgggagcucaaggggaaacauugggagaaaaauggaaaagacaacuaaaccaacugagcaagucagaauuuaacacuuacaaaaggaguggaauuauggagguggacagauccgaagccaaggagggacugaaaagaggagaaacaaccaaacaugcagugucgagaggaacagccaaacuuaggugguuuguggagaggaaccuugugaaaccggaagggaaagugauagaccucgguuguggaagagguggcuggucauauuacugcgcugggcugaagaaggucacagaaguaaagggauacacaaaaggaggacccggucaugaggaaccuaucccaauggcgacuuauggauggaacauagugaagcuacacucuggaagggauguauucuuuacaccaccugagaaaugugacacccuuuugugugauauuggugaguccucuccgaauccaacuauagaagaaggaagaacguuacguguucuaaagaugguggaaccauggcucagaggaaaucaguuuugcauaaaaauccuaaauccuuauaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaaugcugcugaaucgguucacaauggcucacaggaagccaacguaugaaagagacguggacuugggcgcuggaacaagacauguggcaguggaaccagagauagccaaccuagacauuauuggccagaggauagagaacauaaaaaaugaacauaagucaacauggcauuaugaugaggacaauccauacaaaacaugggccuaucauggaucauaugaggucaagccaucagggucagccucauccauggugaauggcguggugagauugcucaccaagccaugggauguuauccccauggucacacaaauagcuaugacugauaccacacccuucggacaacagaggguuuucaaagagaaaguugacacacgcacaccaagaccaaaacgaggcacagcacaaauuauggaggugacagccaagugguuguggggauuccucucuagaaauaaaaaacccagaaucugcacaagagaggaguucacaagaaaaguuaggucaaacgcagcaauuggagcaguguuuguugaugaaaaccaauggaacucagcaaaagaagcaguggaagacgaaagguuuugggaccucgugcacagagagagggagcuucauaaacagggaaaaugugccacgugugucuacaauaugauggguaaaagagagaaaaaacuaggagaguuuggaaaggcaaaaggaagucgugcaauaugguacaugugguugggagcacgcuuucuagaauuugaagcccuuggcuucaugaaugaagaccacugguucaguagggagaauucacucaguggaguggaaggagaaggacuacauaaacuuggauacauacucagagacauaucaaagauuccagggggaaauauguaugcagacgacacagcuggaugggacacaagaauaacagaggaugaucuucagaaugaggcuaaaaucaccgacaucauggagccugaacaugcucuacuggcuacgucaaucuucaagcugaccuaucaaaauaaggugguaagggugcaaagaccagcaaaaaguggaaccgugauggacgucauauccagacgugaccagagaggaaguggacaggucggaacuuauggccuaaacacuuucaccaacauggagguccaacuaauaagacaaauggaaucugaaggaaucuuuucacccagcgaauuggaaaauucaaaucuagcugagagaguucucgacugguuggaaaaacauggcgucgaaagguugaaaagaauggcaaucagcggagaugacuguguggugaaaccaacugaugacagguucgcaacagcuuuaacagcccugaaugacaugggaaaggugagaaaagacauaccgcaaugggaaccuucaaaaggauggaaugacuggcagcaagugccuuucuguucacaccacuuccaccaacugauuaugaaggaugggagggagauaguggugccaugccgcaaccaagaugaacuugugggcagggccagaguaucacaaggcgccggguggagccugagagaaacugcuugccuaggcaagucauaugcacaaauguggcagcugauguacuuccacaggagagaccugagacuggcggcuaaugcuaucuguucagccguuccaguuaauugggucccaaccagccgcaccaccuggucgauccaugcccaccaucaauggaugacaacagaagacauguugucaguauggaauaggguuuggauagaggaaaacccauggauggaggacaaaacucauguauccagcugggaagauguuccauacuuaggaaaaagggaagaucaaugguguggaucucugauaggcuuaacagcaagagccaccugggccaccaacauacaaguggccauaaaccaagugagaaggcuuauugggaacgagaauuauuuagacuacaugacaucaaugaagagauucaagaaugagagugaucccgaaggagcccucugguaa

SEQ ID NO: 6316 - RNA, 9879 nt, Artificial Sequence
  derived and/or modified CDS sequence (wt) from DENV-1__KM403579__SS-prME
uccgugaccaugcuccucaugcugcugcccacagcccuggcguuccauuugaccacacgagggggagagccacacaugauaguuagcaagcaggaaagaggaaagucacucuuguuuaagaccucugcaggugucaacaugugcacccucauugcaauggauuugggagaguuaugugaggauacaaugaccuacaaaugcccccggaucacugaagcggaaccagaugauguugauugcuggugcaaugccacagacacaugggugaccuaugggacguguucucagacuggcgaacaccgacgggauaaacguucugucgcauuggccccacacguggggcuuggucucgaaacaagaaccgaaacguggauguccucugaaggcgccuggaggcagauacaaaaaguggagacuugggccuugagacacccaggauucacggugauagcccuuuuuuuagcacaugccauaggaacauccauuacccagaaagggaucaucuucauuuugcugaugcuggugacaccaucaauggccaugcgaugcgugggaauaggcaacagagacuucguugaaggacugucaggagcaacauggguggaugugguacuggagcauggaagcugugucaccaccauggcaaagaauaaaccaacauuggacauugaacucuugaagacggaggucacgaacccugccgucuugcgcaaacugugcauugaagcuaaaauaucaaacaccaccaccgauucaagauguccaacacaaggagaagcuacacugguggaagaacaagacgcgaacuuugugugucgacgaacauucguggacagaggcugggguaaugguuguggacuauucgggaagggaagcuuacuaacgugugcuaaguuuaagugugugacaaaacuugaaggaaagauaguucaauaugaaaacuuaaaauauucggugauagucacuguccacacuggggaccagcaccagguaggaaaugagacuacagaacauggaacaauugcaaccauaacaccucaagcucccacgucggaaauacagcugacugacuacggagcccuuacauuggacugcucaccuagaacagggcuggacuuuaaugagauggugcuguugacaaugaaagaaaaaucauggcuuguccacaaacaaugguuucuagacuuaccauugccuuggaccucgggggcuucaacaucucaagagacuuggaacagacaagaucugcuggucacauuuaagacagcucaugcaaagaagcaggaaguagucguacuggggucacaagaaggagcaaugcacacugcguugacuggggcgacagaaauccagacgucaggaacgacgacaaucuucgcaggacaccugaaauguagacuaaaaauggauaaacugacuuuaaaaggggugucauaugugaugugcacaggcucauuuaagcuagagaaggaaguggcugagacccagcauggaacuguccuagugcagguuaaauaugaaggaacagaugcaccaugcaagauuccaauuucaacccaagaugagaaaggagugacccagaaugggagauugauaacagccaaucccauaguuacugacaaagaaaaaccagucaacauugaaacagaaccacccuuuggugagagcuacaucgugauaggggcgggugaaaaagcuuugaaacuaagcugguucaagaaaggaagcagcauagggaaaauguucgaagccaccgcccgaggagcacgaaggauggcuauccugggagacacagcaugggacuucgguuccauaggagggguguucacaucugugggaaaauugguacaccagguuuuuggaaccgcauaugggguccuguucagcgguguuucuuggaccaugaaaauaggaauagggauucugcugacauggcuaggauugaauucaaggagcacgucacucucgaugacgugcauugcaguuggcauggucacacuguaccuaggagucaugguucaagcggacucggggugugugaucaacuggaagggcagagaacucaaguguggaaguggcaucuuugucacuaaugaaguccacacuuggacagagcaauacaaauuucaggcugacuccccaaaaagacuaucagcagccauugggaaggcaugggaggaaggcguguguggaauucgaucagccacacgucuugagaacaucauguggaagcaaauaucaaaugaauugaaccacauucuacuugaaaaugacaugaaauucacagugguuguaggagacgccaauggaaucuugacccaaggaaaaaagaugauuaggccacaacccauggaacacaaauacucauggaaaagcuggggaaaagccaaaaucauaggagcagauauacagaauacuaccuucaucaucgauggcccagacacuccagaaugccccgaugaccagagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaacgagaccuggaagcuagcgagagccuccuucauagaagugaagacaugcaucuggccaagaucccacacucuauggagcaauggagucuuggaaagugaaaugauaaucccaaagauauauggaggaccaauaucucagcacaacuacagaccaggguauuucacacaaacagcagggccauggcaccuaggcaaguuggaacuagacuuuaauuugugugaaggcaccacaguuguuguggaugaacauuguggaaaucgagguccaucucuuagaacuacaacagucacaggaaagauaauccaugaauggugcugcagauccugcacgcuaccccccuuacgcuucagaggagaagacggauguugguauggcauggaaaucagaccaguuaaggagaaggaagagaaucuagucaggucaauggucucugcagggucaggagaaguggacaguuuuucauugggacuacuaugcguaucaauaaugauugaagaagugaugagauccagauggaguagaaagaugcugaugacuggaacacuggcuguuuucuuccuucuuauaaugggacaacugacauggaaugaucugaucagguuaugcaucaugguuggagccaaugucucagacagaauggggaugggaacaacguaccuagcuuuaauggccacuuuuaaaaugagaccgauguucgcuguugggcuauuauuucgcagacuaacauccagagaggugcuccuucucacaauuggacuaagccugguggcauccguggagcuaccaaauucuuuagaggagcuaggggacggacuugcgaugggcaucaugauguuaaaauuguugacugauuuucagucacaccaguuguggacuaccuuacugucucugacauucaucaaaacaacucuuucacuggauuaugcauggaagacaauggcuaugguauugucaaucguaucucucuuuccucuaugucuauccacgaccucucaaaaaacaacauggcuuccgguguuguuaggauccuuuggauguaaaccacuaaccauguuucuuauaacagaaaacaaaauuuggggaaggaaaaguuggccccucaaugaaggaauuauggcuguuggaauagucagcauuuuacuaaguucacuccucaaaaaugacgugccacuagccggcccacuaauagcuggaggcaugcugauagcauguuacgucauuuccggaagcucagccgauuuaucauuggagagagcggcugaggucuccugggaagaagaagcagaacacucuggugccucacacaacauacuaguggagguccaagaugauggaacuaugaaaauaaaagaugaagagagagaugacacgcucacuauacuccucaaagcaacuuuguuggcaguuucagggguguacccaaugucaauaccagcaacccuuuuugugugguauuuuuggcagaaaaagaaacagagaucaggagucuugugggacacacccagcccuccagaaguagaaagagcaguucuugaugaugguaucuauagaaucuugcaaagaggacuguuggguaggucccagguaggagugggaguuuuucaagacggcguguuccacacaauguggcaugucaccaggggggcuguccucauguaccaagggaagaggcuggaaccaaguugggcuagugucaaaaaagacuugaucucauauggaggagguuggagguuucaaggaucauggaacacgggagaagaaguacaggugauagcuguugaaccagggaaaaacccaaagaauguacagacaacgccgggcaccuucaagaccccugaaggcgaaguuggagccauagcccuagauuucaaaccuggcacaucuggaucucccaucgugaacagagaggggaaaauaguaggucuuuauggaaauggaguggugacaacaaguggaaccuacgucagugccauugcccaagcuaaagcgucacaagaagggccucuaccagagauugaggacgagguguuuaagaaaagaaaccuaacaauaauggaccuacauccaggaucaggaaaaacaagaagauaucuuccagccauaguccgugaggccauaaaaaggaaacugcgcacgcuaaucuuggcucccacaagaguugucgccucugaaauggcagaggcgcuuaaaggaaugccaauaagauaucagacaacagcaguaaagagugaacacacaggaaaggagauagucgaucucaugugccacgccacuuucaccaugcgucuccuaucuccagugagaguucccaauuacaacaugauuaucauggaugaagcacacuuuaccgauccagccagcauagcggccagaggguacaucucaacccgaguggguaugggugaagcagcugcgaucuuuaugacagccacucccccaggaucgguagaggccuuuccacagagcaaugcaguuauccaagaugaggaaagagacauuccugagagaucauggaacucaggcuacgacuggaucacugacuucccaggaaaaacagucugguuuguuccaagcaucaaaucaggaaaugacauugccaacugcuuaagaaaaaacgggaaacgggugauccaauugagcagaaaaaccuuugacacugaauaccagaaaacgaaaaacaaugauugggacuauguugucacaacagacauuuccgaaaugggagcaaauuuccgggccgauaggguaauagacccaaggcggugcuugaagccgguaauacuaaaagauggcccagagcgcgucauucuggccggaccaaugccagugaccgcggccagugcugcccagaggagaggaagaauuggaaggaaccaaaacaaggaaggugaccaguauauuuacaugggacagccuuuaaauaaugaugaggaccacgcucauuggacagaagcaaaaaugcuccuugacaauauaaauacgccagaagggauuaucccagcccucuuugagccagagagagaaaagagugcagcaauagacggggaguauagacugcggggagaagcaaggaaaacguucguggagcuaaugagaagaggggaucuaccaguuuggcuaucuuacaaaguugccucagaaggcuuccaguacuccgacagaagauggugcuuugacggggaaaggaacaaccagguguuggaggagaacauggacguggagaucuggacaaaagaaggagaaagaaagaaauugcgaccucgcugguuagaugccagaaccuacucugauccacuggcccugcgcgaguuuaaagaguucgcagcaggaagaagaagugucucaggugaccuaauauuagaaauugggaaacucccacagcauuugacgcuaagggcccagaaugcuuuggacaacuuggucauguugcacaauuccgaacaagggggaaaagccuauagacaugcuauggaagaacuaccagacaccauagaaacauugaugcuacuagccuugauagcugugcugacugguggaguuacguuguuuuuccuaucaggaaaaggucuagggaaaacauccauuggccuacuuuguguaauggccucaaguguacuguuauggauggccaguguggagccccauuggauagcggccuccaucauacuagaguuuuuucugauggugcugcuuauuccagagccagacagacagcguacuccacaggacaaucaacuagcauauguggugauagguuuguuauucaugauauugacaguggcagccaaugagaugggauuacuggaaaccacaaagaaagaccuggggauuggccauguagucgccgaaaaccaccaccaugccacaaugcuagacauagacuuacauccagcuucagccuggacccucuaugcaguagccacaacaauuaucacucccaugaugagacacacaauugaaaacacaacggcaaacauuucccugacagcuauugcaaaucaggcggcuauauuaaugggacuugacaagggauggccaauaucgaagauggacauaggagugccacuucucgccuuagggugcuauucccaggugaacccauugacacugacagcggcgguguuaauguuaguggcucauuaugccauaaucggaccuggacugcaagcaaaagcuaccagagaagcccaaaaaaggacugcggccggaauaaugaaaaauccaacuguagacgggauuguugcaauagauuuggauccugugguuuaugaugcaaaauuugaaaaacagcuaggccaaauaauguuacuaauacucugcacaucacagauucucuugaugcggacuacaugggccuuaugugaaucuaucacacuggcuacuggacccuugaccacucucugggagggaucuccuggaaaauucuggaauaccacgauagcaguguccauggcaaacaucuucaggggaaguuauuuagcaggggcaggucuggccuucucauuaaugaaaucuuuaggaggagguaggagagguacgggagcucaaggggaaacauugggagaaaaauggaaaagacaacuaaaccaacugagcaagucagaauuuaacacuuacaaaaggaguggaauuauggagguggacagauccgaagccaaggagggacugaaaagaggagaaacaaccaaacaugcagugucgagaggaacagccaaacuuaggugguuuguggagaggaaccuugugaaaccggaagggaaagugauagaccucgguuguggaagagguggcuggucauauuacugcgcugggcugaagaaggucacagaaguaaagggauacacaaaaggaggacccggucaugaggaaccuaucccaauggcgacuuauggauggaacauagugaagcuacacucuggaagggauguauucuuuacaccaccugagaaaugugacacccuuuugugugauauuggugaguccucuccgaauccaacuauagaagaaggaagaacguuacguguucuaaagaugguggaaccauggcucagaggaaaucaguuuugcauaaaaauccuaaauccuuauaugccaagugugguagaaacucuggagcaaaugcaaagaaaacauggagggaugcuagugcgaaacccacucucaagaaauuccacccaugaaauguacugggucucauguggaacaggaaacauugugucggcagugaacaugacauccagaaugcugcugaaucgguucacaauggcucacaggaagccaacguaugaaagagacguggacuugggcgcuggaacaagacauguggcaguggaaccagagauagccaaccuagacauuauuggccagaggauagagaacauaaaaaaugaacauaagucaacauggcauuaugaugaggacaauccauacaaaacaugggccuaucauggaucauaugaggucaagccaucagggucagccucauccauggugaauggcguggugagauugcucaccaagccaugggauguuauccccauggucacacaaauagcuaugacugauaccacacccuucggacaacagaggguuuucaaagagaaaguugacacacgcacaccaagaccaaaacgaggcacagcacaaauuauggaggugacagccaagugguuguggggauuccucucuagaaauaaaaaacccagaaucugcacaagagaggaguucacaagaaaaguuaggucaaacgcagcaauuggagcaguguuuguugaugaaaaccaauggaacucagcaaaagaagcaguggaagacgaaagguuuugggaccucgugcacagagagagggagcuucauaaacagggaaaaugugccacgugugucuacaauaugauggguaaaagagagaaaaaacuaggagaguuuggaaaggcaaaaggaagucgugcaauaugguacaugugguugggagcacgcuuucuagaauuugaagcccuuggcuucaugaaugaagaccacugguucaguagggagaauucacucaguggaguggaaggagaaggacuacauaaacuuggauacauacucagagacauaucaaagauuccagggggaaauauguaugcagacgacacagcuggaugggacacaagaauaacagaggaugaucuucagaaugaggcuaaaaucaccgacaucauggagccugaacaugcucuacuggcuacgucaaucuucaagcugaccuaucaaaauaaggugguaagggugcaaagaccagcaaaaaguggaaccgugauggacgucauauccagacgugaccagagaggaaguggacaggucggaacuuauggccuaaacacuuucaccaacauggagguccaacuaauaagacaaauggaaucugaaggaaucuuuucacccagcgaauugggaaauucaaaucuagcugagagaguucucgacugguuggaaaaacauggcgucgaaagguugaaaagaauggcaaucagcggagaugacuguguggugaaaccaacugaugacagguucgcaacagcuuuaacagcccugaaugacaugggaaaggugagaaaagacauaccgcaaugggaaccuucaaaaggauggaaugacuggcagcaagugccuuucuguucacaccacuuccaccaacugauuaugaaggaugggagggagauaguggugccaugccgcaaccaagaugaacuugugggcagggccagaguaucacaaggcgccggguggagccugagagaaacugcuugccuaggcaagucauaugcacaaauguggcagcugauguacuuccacaggagagaccugagacuggcggcuaaugcuaucuguucagccguuccaguuaauugggucccaaccagccgcaccaccuggucgauccaugcccaccaucaauggaugacaacagaagacauguugucaguauggaauaggguuuggauagaggaaaacccauggauggaggacaaaacucauguauccagcugggaagauguuccauacuuaggaaaaagggaagaucaaugguguggaucucugauaggcuuaacagcaagagccaccugggccaccaacauacaaguggccauaaaccaagugagaaagcuuauugggaacgagaauuauuuagacuacaugacaucaaugaagagauucaagaaugagagugaucccgaaggagcccucugguaa

SEQ ID NO: 6317 - RNA, 9879 nt, Artificial Sequence
  derived and/or modified CDS sequence (wt) from DENV-1__HM469968__SS-prME
ucugugaccaugcuccucaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuaugugaggacacaaugacuuacaaaugcccucgaaucacugaggcggaaccagaugacguugauuguuggugcaaugcuacagacacaugggugaccuauggaacauguucccaaacuggcgagcaccgacgagacaaacguuccgucgcacuagccccacacgugggacuugguuuggaaacaagaaccgaaacguggauguccuccgaaggcgcuuggaaacagauacaaagaguggagacuugggcccugagacacccaggauucacggugauagcccucuuucuagcacaugccauaggaacauccaucacccagaaagggaucaucuucauuuugcuaaugcugguuacaccauccauggccaugcgaugcgugggaauaggcagcagggacuucguggaaggacugucaggagcaacuuggguagauguggugcuggaacauggaaguugcgucacuaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuuauaacgugugcuaaguucaagugugugacaaaacuggaaggaaaaauaguucaauaugaaaacuugaaauauucaguaauagucaccguccacacuggagaccagcaccagguggggaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaagucauggcuaguccacaaacaaugguuucuagaccuaccacugccuuggaccucgggagcuucaacaucacaagaaacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagccaaccccauagucacugacaaagaaaaaccagucaacauugaggcagaaccgccuuuuggugagaguuacaucgugauaggagcaggugaaaaagcuuugaaacugagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcggcguuuccuggaccaugaaaauaggaauaggggcucugcugacauggcugggauuaaacucaaggagcacgucacuuucgaugacgugcauugcaguuggccuaguaacgcuauacuuaggagucaugguucaggcggauucaggauguguaauuaauuggaaagguagagaacucaaauguggaaguggcauuuuugucaccaaugaaguucacacuuggacagagcaauacaaauuucaagcugauuccccaaagagacuaucagcagccauugggaaagcaugggaggaggguguguguggaauucgaucagcaacucgucucgagaacaucauguggaagcaaauaucaaaugaauugaaccacaucuuacuugaaaaugacaugaaauucacagugguuguaggagauguugcugggaucuuggcucaagggaaaaaaaugauuaggccacaacccauggaauacaaauacucguggaaaagcuggggaaaggcuaaaaucauaggggcagauguacagaacaccaccuucaucaucgacggcccaaacaccccagaaugcccugaugaucaaagagcguggaacauuugggaaguugaggauuauggauuuggaauuuucacgacaaacauauggcugaaauugcgugacuccuacacccaagugugugaccaucggcuaaugucagcugccaucaaggacagcaaggcaguucacgcugacaugggguacuggauagaaagugaaaagaacgagaccuggaagcuggcaagagccucuuucauagaagucaaaacauguaucuggccaaaaucccacacucuauggagcaauggaguucuggaaagugaaaugauaauuccaaagaucuauggaggaccaauaucucagcacaacuacagaccaggauauuucacacaaacggcaggaccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucagaggagaagaugggugcugguacggcauggaaaucagaccagucaaggaaaaggaagagaaucuagucaaaucaaugguuucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaacugacauggaaugaucugaucagauuaugcaucauggucggagccaaugcuuccgacaggauggggaugggaacgacguaccuagcucugauggccacuuuuaaaaugagaccaauguuugcuguagggcuacuauuccgcagacuaacauccagagaaguucuccuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuaugcauggaagacaauggcuaugguacugucaauuguaucucucuuccccuuaugccuguccacgaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaucuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacgggagaagaagugcaggugauugcuguugaaccagggaaaaaccccaaaaauguacaaacagcgccgggcaccuuuaagaccccugaaggcgaaguuggagccauugcccuagauuuuaaacccggcacaucuggaucucccaucgugaacagagaagggaaaauaguaggucuuuauggaaauggaguagugacaacaaguggaaccuacgucagugccauagcucaagcuaaagcaucacaagaagggccccuaccagagauugaagacgagguguuuaggaaaagaaacuuaacaauaauggaccuacauccaggaucggggaaaacaagaagauaccuuccagccauaguccgugaagccauaaaaaggaagcugcgcacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuuuaccaugcgucuccugucucccgugagaguucccaauuacaacaugauuaucauggaugaagcacauuucaccgauccaucuagcauagcggcuagaggguacaucucaacccgagugggcaugggugaagcagcugcgaucuucaugacagccacucccccaggaucaguggaggccuuuccacagaguaacgcaguuauccaagaugaggaaagagacauuccugagagaucauggaacucaggcuaugaguggaucacugacuucccaggcaaaacaguuugguuuguuccaagcauuaaaucaggaaaugauauugccaacugcuuaagaaagaaugggaaacgggugauucaauugagcaggaaaaccuuugacacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucacgcucacuggacggaagcaaaaaugcuccuugauaauauaaacacaccagaagggauuaucccagcccucuuugagccggagagagaaaagagugcagcaauagacggggaauacagacugcggggugaagcaaggaaaacguuuguggagcucaugagaagaggagaucuaccugucuggcuauccuacaaaguugccucagaaggcuuccaguacucugauagaagauggugcuuugacggggaaaggaacaaccagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguagagccccauuggauagcggccuccaucauacuggaguucuuccugauggugcugcuuauuccagaaccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagaccuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucaaagauggacauaggaguuccacuucucgccuuggggugcuauucccaggugaauccacugacgcugacagcggcgguauugaugcuaguggcucauuacgcuauaauuggaccuggacugcaagcaaaagcuacuagagaagcucaaaaaaggacagcggccggaauaaugaaaaauccaaccguugauggaaucguugcaauagauuuggacccugugguuuaugaugcgaaauuugagaagcaacuaggccaaauaauguuguugauacuaugcacaucacagauccucuugaugcggacuacaugggccuugugcgaauccaucacacuggccacuggaccucugaccacgcucugggagggaucuccaggaaaauuuuggaacaccacgauagcgguuuccauggcaaacauuuucagaggaaguuaccuagcaggagcaggucuggccuucucacuaaugaaaucucuaggaggagguaggagaggcacgggagcccaaggggaaacacugggagagaaauggaaaagacagcugaaccaacugagcaagucagaauucaacaccuauaaaaggagugggauuauggaaguggacagauccgaagccaaagagggacugaaaagaggagaaacaaccaaacaugcagugucgagaggaaccgcuaaauugaggugguuuguggagaggaaccucgugaaaccagaagggaaagucauagaccucgguuguggaagagguggcuggucauacuauugcgcugggcugaagaaagucacagaagugaagggauauacaaaaggaggaccuggacaugaagaaccaaucccaauggcgaccuauggauggaaccuaguaaaguugcacuccgggaaagacguauucuuuauaccaccugagaaaugugacacccuuuugugugauauuggugaguccucuccaaacccaacuauagaggaaggaagaacgcuacgcguccuaaagaugguggaaccauggcucagagguaaccaauucugcauaaaaauucugaaucccuacaugccaagugugguggaaacucuggagcaaaugcaaagaaaauauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacauaugaaagagacguggaccuaggcgccggaacaagacauguggcaguggaaccagagguagccaaccuagauaucauuggccagaggauugagaacauaaaacaugaacacaagucaacauggcauuaugaugaggacaauccauauaaaacaugggccuaucauggaucauaugaggucaagccaucaggaucagccucauccauggucaauggcguggugaaacugcucaccaaaccaugggaugucauccccauggucacacaaauagccaugacugacacuacaccuuuuggacaacagaggguguuuaaagagaaaguugacacacgcacaccaaaagcaaaacgaggcacagcacaaaucauggaggugacagccaggugguuaugggguuuucuuucuagaaacaagaagccaagaauuuguacaagagaggaguucacaagaaaaguuaggucaaacgcagccaucggagcaguguucguugacgaaaaucaauggaacucagcaaaagaagcaguggaagaugagcgguucugggaccuugugcacagagagagggagcuucacaaacagggaaaaugugccacguguguuuacaacaugauggggaagagagagaaaaagcuaggagaguuuggaaaggcaaaaggaagucgugcaauaugguacaugugguugggagcacgcuuucuagaguucgaagcucuugguuucaugaacgaagaccacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccaaaauuacugacaucauggaacccgaacaugcccuacuggcuaaggcaaucuucaagcuaaccuaccaaaauaaagugguaaggguacagagaccagcaaaaaaugggaccgugauggaugucauauccagacgugaccagagaggaaguggccaggucggaacuuauggcuuaaacacuuucaccaacauggaagcccagcugauaagacaaauggagucugagggaaucuuuuuacccagugaauuagagaccccaaauuuagcugagagaguucucgacuggcuggaaaaauauggcgucgaaaggcuaaaaagaauggcaaucaguggagaugacugcguagugaaaccaauugaugauagguuugcaacagccuuaacagcucugaaugauaugggaaaaguaagaaaagauauaccacaaugggaacccucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaaaucauaugcacaaauguggcagcugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccauauauccaguugggaagauguuccauauuuagggaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6318 - RNA, 9879 nt, Artificial Sequence
  derived and/or modified CDS sequence (wt) from DENV-1__KC172834__SS-prME
ucugugaccaugcuccuuaugcugaugcccacagccuuggcguuccauuugacaacacgagggggagagccgcacaugauagucagcaagcaggaaagaggaaagucacuuuuguuuaagaccucagcaggugucaacaugugcacccucauagcgauggauuugggagaguuaugugaggacacaaugacuuacaaaugcccucgaaucacugaggcggaaccagaugacguugauuguuggugcaaugccacagacacaugggugaccuauggaacauguucccaagcuggcgagcaccgacgagacaaacguuccgucgcacuggccccacacgugggacuugguuuggaaacaagaacugaaacguggauguccucugaaggcgcuuggaaacagauacaaagaguggagacuugggcccugaggcacccaggauucacggugauagcccuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacacuaccaccgacucaagauguccaacacaaggagaagccacacugguggaagaacaagacgcgaacuuugugugucgacgaacguuuguggacagaggguggggcaauggcugugggcucuucggaaaaggaagccuacuaacgugugcuaaguucaagugugugacaaaacuggaaggaaagauaguucaauaugaaaacuugaaauauucaguaauagucaccguccacacuggagaccagcaucaggugggaaaugaaagcacagaacaugggacaacugcaacuauaacaccucaagcuccuacgacggaaauacagcugaccgacuacggagcucucacauuggauuguucaccuagaacaggacuagacuuuaaugaaaugguguuguugacaaugaaagaaaaaucauggcuaguccacaaacaaugguuucuagacuuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacauuugaaauguagacuaaagauggacaaacugacucuaaaagggaugucauaugugaugugcacaggcucauucaagcuagagaaagaaguggcugagacccagcauggaaccguucuagugcagauuaaauaugaaggaacagaugcaccauguaagaucccuuuuucgacccaagaugaaaaaggaguaacccagaacgggagauugauaacagccaaccccauagucacugacaaagaaaaaccagucaacauugaggcagaaccgccuuuuggugagaguuacaucgugauaggagcaggugaaaaagcuuugaaauuaagcugguucaagaaaggaagcagcauagggaaaauguuugaggcaacugccagaggagcacgaaggauggccauacugggagacaccgcaugggacuuugguucuauaggaggaguguucacgucuguuggaaaauuagugcaccagauuuuuggaacugcauauggaguuuuguucagcgguguuuccuggaccaugaaaauaggaauagggguucugcugacauggcuaggauuaaacucaaggaguacgucccucucgaugacguguauugcaguuggccuaguaacacuauaccuaggagucaugguucaggcggauucaggaugcguaauuaauuggaaagguagagaacucaaauguggaaguggcauuuuugucaccaaugaaguucacacuuggacagagcaauauaaauuucaagcugacuccccaaagagacuaucagcagccaucgggaaggcaugggaggaggguguguguggaauucgaucagcaacucgucucgagaacaucauguggaagcaaauaucaaaugaacugaaccacaucuuacuugaaaaugacaugaaauucacagugguuguaggagauguugcugggaucuuggcucaaggaaaaaaaaugauuaggccacaacccauggaauacaaauacucguggaaaagcuggggaaaggcuaaaaucauaggggcagauguacagaacuccaccuucaucauugacggcccaaacaccccagaaugcccugaugaucaaagagcauggaacauuugggaaguugaggacuauggauuuggaauuuucacgacaaacauauggcugaaauugcgugacuccuacacccaagugugugaccaccggcuaaugucagcugccaucaaggacagcaaggcagugcacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucccagcauaacuacagaccaggauacuucacacaaacggcagggccguggcaccuaggcaaguuggaacuggacuuugauuugugugagggcaccacagucguuguggaugaacauuguggaaaucgaggaccaucucuuaggaccacaacaguuacaggaaagauaauucaugaaugguguugcagaucuuguacgcuaccacccuuacguuucagaggagaagaugggugcugguacggcauggaaaucagaccagucaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagacuaugcaucaugguuggagccaacgcuuccgacagaauggggaugggaacgacguaccuagcucugauggccacuuuuaaaaugagaccaauguuugcuguagggcuauuauuccgcagacuaacauccagagaaguucuucuucuaacaauuggacugagucuaguggcaucuguggaguuaccaaauuccuuggaggagcugggggauggacuugcaaugggcaucaugauuuuaaaauuauugacugacuuucaaucacaucaguuaugggcuaccuugcuguccuugacauuuaucaaaacaacguuuuccuugcacuaugcauggaagacaauggcuaugguacugucaauuguaucucucuuccccuuaugccuguccacgaccucucagaaaacaacauggcuuccggugcuauugggaucucuuggaugcaaaccacuaaccauguuucuuauagcagaaaacaaaaucuggggaaggaaaaguuggccccucaaugaagggaucauggcuguuggaauagucagcauccuacuaaguucacuccuaaaaaaugaugugccgcuagcugggccacuaauagcuggaggcaugcuaauagcauguuaugucauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaacuauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguggggguaggaguuuuucaagaaaacguguuccacacaauguggcaugucaccaggggagcuguacucauguaucaagggaagagacuggaaccgagcugggccagugucaaaaaagaccugaucucauauggaggagguuggagguuucaaggauccuggaacacgggagaagaagugcaggugauugcuguugaaccagggaaaaaccccaaaaauguacaaacagcgccgggcaccuuuaagaccccugaaggugaaguuggagccauugccuuagauuuuaaacccggcacaucuggaucucccaucgugaacagagaaggaaaaauaguaggucuuuauggaaauggaguaguaacaacaaguggaaccuacgucagugccauagcucaagccaaagcaucacaagaagggccccuaccagagauugaagacgaaguguuuaggaaaagaaacuuaacaauaauggaccuacauccaggaucgggaaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaauaugauuaucauggaugaagcacauuucaccgauccauccagcauagcggccagaggguacaucucaacccgaguggguaugggugaagcagcugcgaucuucaugacagccacucccccaggaucaauggaggccuuuccacagagcaacgcagucauccaagaugaggaaagagacauuccugagagaucauggaacuuaggacaugaguggaucacugacuucccagguaaaacagucugguuuguuccaagcauuaaagcagggaaugacauugccaacugcuuaagaaagaauggaaaacgagugauucaauugagcaggaaaaccuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaggaucacgcucacuggacagaagcaaaaaugcuccuugauaauauaaacacaccagaagggauuaucccagcccucuucgagccggagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaagaaacaaccagguguuggaggagaacauggacguggagaucuggacaaaagaaggagaaagaaagaaacugcgaccccgcuggcuggaugccagaacauacucagacccacuggcccugcgcgaguuuaaagaguuugcagcaggaagaagaagcgucucaggugaucuaauacuagaaauagggaaacuuccacaacacuugacgcaaagggcccagaaugccuuggacaaccuggucauauugcacaacuccgaacaaggaggaagagccuauagacaugcaauggaagaacugccagacaccauagaaacguugaugcuccuagcucugauagcuguguuaacugguggagugacgcuguucuuccuaucaggaaagggccuagggaaaacaucuaucggccuacucugcgugauggcuucaaguguacugcuauggauggccaguguggagccccauuggauagcggccuccaucauacuagaguucuuccugaugguauugcuuauuccagagccagacagacaacgcacuccgcaggacaaccagcuggcauauguggugauagguuuguuauuuaugauacugacaguagcagccaaugagaugggacuguuggaaaccacaaagaaagacuuagggauuggccauguggcuguugaaaaucaccaccaugccgcaaugcuggacguagacuuacauccagcuucagccuggacccuuuaugcaguggccacaacaauuaucacucccaugaugaggcacacaaucgaaaacacaacggcaaacaucucccugacagccauugcaaaccaggcagcuauauugaugggacuugauaaaggauggccaauaucgaagauggacauaggaguuccacuucucgccuuggggugcuauucccaggugaauccacugacgcugacagcggcgguguugaugcuaguggcucauuacgccauaauugggccuggacugcaagcaaaagccacuagagaagcucaaaaaaggacagcggccggaauaaugaaaaauccaaccauugauggaauuguugcaauagauuuggacccugugguuuaugaugcaaaauuugagaaacaacuaggccaaauaauguuguugauacuaugcacaucacagauccucuugaugcggaccacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacaccuauaaaaggagugggauuauggaaguggacagauccgaagccaaagagggacugaaaagaggagaaacaaccaaacaugcagugucgagaggaaccgcuaaacugaggugguuuguggagaggaaccuugugaaaccagaagggaaagucauagaccucggcuguggaagagguggcuggucauacuauugcgcugggcugaagaaagucacagaagugaagggauauacgaaaggaggaccuggacaugaggaaccaaucccaauggcgaccuauggauggaaccuaguaaaacugcacuccgggaaagacguauucuuuguaccacccgagaaaugugauacccuuuugugugacauuggugaguccucuccaaacccaaccauagaggaaggaagaacgcuacgcguucuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacauacgaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucauccccauggucacacaaauagccaugacugacaccacacccuuuggacaacagaggguguuuaaagagaaaguugacacacgcacaccaaaagcaaaacgaggcacagcacaaaucauggaggugacagccaggugguuaugggguuuucucucuagaaacaagaaaccaagaauuuguacaagagaggaguucacaagaaaaguuaggucaaacgcagccauuggagcaguguucguugaugaaaaucaauggaacucagcaaaagaagcaguggaagaugaccgguucugggaccuugugcacagagagagggagcuucacaaacagggaaaaugugccacguguguuuacaacaugauggggaagagagagaagaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuucacaaacuuggauauauacucagagacauaucaaagauuccagggggaaacauguaugcagaugacacagccggaugggauacaaggauaacagaggaugaccuccagaaugaggccaaaauuacugacaucauggaacccgaacaugcccuacuggcuaagucaaucuucaagcuaaccuaccaaaauaaggugguaaggguacagagaccagcaaaaaauggaaccgugauggaugucauauccagacgugaccagagaggaaguggccagguuggaaccuauggcuuaaacacuuucaccaacauggaagcccagcugauaagacaaauggagucugagggaaucuuuucacccaacgaauuagagaccccaaauuuagccgagagaguucucgacuggcuggaaaaauauggcgucgaaaggcugaaaagaauggcaauuagcggagaugacugcguagugaaaccaauugacgauagguucgcgacagccuuaacagcucugaaugauaugggaaaaguaagaaaagacauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggggccugagagaaacugcaugccuaggcaagucauaugcacaaauguggcagcugauguacuuccacaggagagaccugagacuagccgcuaaugcuaucuguucagccguuccaguugauugggucccaaccagccgcaccacuuggucgauccaugcccaucaccaauggaugacaacagaagacaugcugucaguguggaauaggguuuggauagaggaaaacccauggauggaggacaaaacccguauauccaguugggaagaugucccauaucuagggaaaagggaagaucaaugguguggaucucuaauaggcuuaacagcaagggccaccugggccaccaacauacaaguggccauaaaccaagugagaagacuaauugggaaugagaacuauucagauuacaugacaucaaugaagagauucaagaacgagagugaacccgaaggggcacucugguga

SEQ ID NO: 6319 - RNA, 9879 nt, Artificial Sequence
  derived and/or modified CDS sequence (wt) from DENV-1__KJ933413__SS-prME
ucugugaccaugcuccucaugcugcugcccacagcccuagcguuucaucugaccacucggggaggagagccgcacaugauaguuagcaagcaggaaagaggaaaaucacuuuuguuuaagaccucuacaggugucaacauguguacccuuauugcaauggauuugggagaguuaugugaggacacaaugaccuacaaaugccccaggaucacugagacggagccagaugacguugacuguuggugcaaugccacggagacaugggugaccuauggaacauguucucaaacuggugaacaccgacgagacaaacguuccgucgcauuggcaccacacguagggcuuggccuagaaacaagaaccgaaacguggauguccucugaaggugcuuggagacaaauacaaaaaguggagacuugggcucugagacacccaggauucacggugauagcccuuuuucuagcacaugcuauaggaacauccaucacccagaaagggauuauuuuuauuuuguugaugcugguaacuccauccauggccaugcggugcguagggauaggcaacagagacuucguggaaggacugucgggagcuacguggguggauguagugcuggagcauggaaguugcgucacuaccauggcaaaagacaaaccaacacuggacauugaacuccugaagacggaggucacaaacccugcaguccugcgcaaacugugcauugaagcuaaaauaucaaauaccaccaccgauucgagauguccaacacaaggagaagccacgcugguggaagagcaggacacgaacuuugugugccgacgaacgcucguggacagaggcuggggcaaugguugugggcuauuuggaaaagguagcuuaauaacgugugcuaaguuuaagugugugacaaaacuggaaggaaagauaguccaauaugaaaacuuaaaauauucagucauagucaccguacacacuggagaccaacaccaaguuggaaaugagaccacagaacauggaacaacugcaaccauaacaccucaagcucccacgucggaaauacagcugacagacuacggagcucuaacacuggauuguucaccuagaacaggacuagacuuuaaugagaugguguuguugacgaugaaagaaaaaucauggcucguccacaaacaaugguuucuggaccuaccacugccuuggaccucaggggccucaacaucccaagagacuuggaauagacaagaccugcuggucacauucaagacagcucaugcaaaaaagcaagaaguagucgugcuaggaucacaagaaggagcaaugcauacugcgcugacuggagcgacagaaauccaaacgucuggaacgacaacaauuuuugcagggcaccugaaaugcagacuaaaaauggauaaacugaccuuaaaagggguaucauauguaaugugcacagggucauucaagcuagagaaggaaguggcugagacccagcauggaacuguucuagugcaaguuaaauacgaaggaacagaugcaccaugcaagauccccuucacgucccaagaugagaagggaguaacccagaaugggagauugauaacagccaaccccauagucacugacaaagaaaaaccagucaacauugaagcggagccaccuuuuggggagagcuaccuugugguaggagcaggugaaaaagcuuugaaacuaagcugguucaagaagggaagcaguauagggaaaauguuugaagcaacugcccgcggagcacgaaggauggccauccugggagacaccgcaugggacuucgguucuauaggagggguguucacaucugugggaaaacugauacaccagauuuuugggacugcguauggagucuuguucagcgggguuucuuggaccaugaaaauaggaauagggauucugcugacauggcuaggauuaaauucaaggagcacaucccuuucaaugacguguaucgcagucggcauggucacacuguaccuaggagucaugguucaggcggacucgggauguguaaucaacuggaaaggcagagaacucaaauguggaagcggcauuuuugucaccaaugaaguccacaccuggacagagcaauacaaauuccaggccgacucccccaagagacuaucagcggccauugggaaggcaugggaggagggugugugugggauccgaucagucacucgucucgagaacauuauguggaagcaaauaucaaaugaauuaaaccacaucuuacuugagaaugacaugaaauuuacaguggucguaggagacguuaauggaaucuuggcccaaggaaagaaaaugauuaggccgcaacccauggaacacaaauacucguggaaaagcuggggaaaagccaaagucauaggagcagauguacagaauagcaccuucaucaucgacggcccaaacaccccagaaugcccugaugaucaaagagcauggaauauuugggaagucgaagacuauggauuuggaauuuucacgacaaacauaugguugaaauugcgugacuccuacacucaagugugugaccaccggcuaaugucagcugccaucaaggauagcaaagcaguccaugcugacaugggguacuggauagaaagugaaaagaacgagacuuggaaguugacaagagccuccuucauagaaguuaagacaugcgucuggccaaaaucccacacccuauggagcaauggagucuuggaaagugagaugauaaucccaaagauauauggaggaccaauaucucagcacaacuacagaccaggauauuucacacaaacagcaggaccguggcacuugggcaagcuagaacuggauuuugguuuaugugaagguaccacuguuguuguggaugaacauuguggaaaccgaggaccaucucuuagaaccacaacagucacaggaaagauaauccaugaauggugcuguagaucuugcacguuaccccccuuacgauucaaaggagaagacgggugcugguacggcauggaaaucagaccagucaaggagaaggaagagaaccuagucaagucaauggucucugcagggucaggagaaguggacaguuuuucacuaggacugcuaugcauaucaauaaugaucgaagagguaaugagauccagauggagcagaaaaaugcugaugacuggaacacuggcuguguuccuccuucuuauaaugggacaguugacauggaaugaucugaucagacugugcaucaugguuggagccaaugccucagacaagauggggaugggaacgacguaccuagcuuugauggccacuuucagaaugagaccaauguucgcagucgggcuacuguuucgcagauuaacaucuagagaaguucuccuucucacaguuggauugagucuaguggcaucuguagaacuaccaaauuccuuggaggagcuaggggauggacuugcaaugggcauuaugauguugaaauuacugacugauuuucagucacaucagcuaugggcugccuugcugucuuuaacauuugucaaaacaacuuuuucauugcacuaugcauggaagacaauggcuaugauacugucaauuguaucucucuucccuuuaugccuguccacgacuucucaaaaaacaacauggcuuccgguguugcugggaucucuuggaugcaaaccacuaaccauguuucuuauuacagaaaacagaaucuggggaagaaaaagcuggccucucaaugagggaauuauggcuguuggaauaguuagcauucuucuaaguucacuucuuaaaaaugauguaccacuagcuggcccacuaauagcuggaggcaugcugauagcauguuaugucauaucuggaagcucggccgauuuaucacuggagaaagcggcugaggucuccugggaagaagaagcagaacacucuggugccucacacaacauacuaguggagguccaagaugauggaaccaugaagauaaaagaugaagagagagaugacacacuuaccauucuccucaaagcaacucugcuagcaaucucagggguauacccaaugucaauaccggcgacccucuuugugugguauuuuuggcagaaaaagaaacagagaucaggagugcuaugggacacacccagcccuccagaaguggaaagagcaguccuugaugaugguauuuauagaauucuccaaagaggacuguugggcaagucucaaguagggguaggagucuuucaagaagguguguuccacacaauguggcacgucaccaggggagcuguccucauguaccaagggaagagauuggaaccaaguugggccagugucaaaaaagacuugaucucauauggaggagguuggagguuucaaggauccuggaacacgggagaagaagugcaggugauugcuguugaaccgggaaagaacccaaaaaauguacagacagccccggguaccuuuaaaaccccugaaggcgaaguuggagccauagcucuagacuucaaacccggcacaucuggaucuccuauugugaacagagagggaaaaauaguaggucuuuauggaaauggaguggugacaacaaguggaaccuacgucagugccauagcucaagccaaagcaucacaagaagggccucuaccagagauugaggacgagguguuuaggaaaagaaaccugacaauaauggaccuacauccaggaucgggaaaaacaagaagauaccuuccagccauaguccgugaggcuauaaaaagaaaacuacgcacgcuagucuuggcucccacaagaguugucgccucugaaauggcagaggcacucaagggaaugccaauaagguaccagacaacagcagugaaaagugaacacacgggaaaggagauaguugaccuuaugugucacgccacuuuuaccaugcgucuccucuccccugugagaguucccaauuauaauaugauuaucauggaugaagcacauuucacugauccagccagcauagcagccagaggguauaucucaacccgaguggguaugggugaagcagcugcaauuuucaugacggccacuccccccggaucgauggaggccuuuccacagagcaaugcagcuauccaagaugaggaaagagauauuccugaaaggucuuggaacucaggcuaugacuggauuacugauuucccaggaaaaacaguuugguuuguuccaagcaucaaaucaggaaaugacauugccaacuguuuaagaaagaaugggaaacgggugguccaauuaagcagaaaaaccuuugacacugaguaccagaagacaaaaaacaacgacugggacuauguugucacaacagacauauccgaaaugggagcaaacuuccgagcugacaggguaauagacccaaggcggugccuaaaaccgguaauacuaaaagauggcccagagcgugucauucuagccggaccaaugccagugacuguggcuagcgccgcccagaggagaggaagaauuggaaggaaccaaaauaaggaaggugaucaguauauuuacaugggacagccucugaacaaugaugaggaccaugcccauuggacagaagcaaaaaugcuccuugacaacauaaacacaccagaagggauuaucccagcccucuuugagccggagagagaaaagagcgcagcaauagacggggaauacagacuacggggugaagcgaggaaaaccuucguggagcuuaugagaagaggagaucuaccugucuggcuauccuacaaaguugccucagaaggcuuccaguacucugacagaagguggugcuuugauggagaaaggaacaaccaggugcuggaggagaacauggauguggagaucuggacaaaagaaggagaaagaaagaaacuacgaccccgcuggcuggacgccagaacauacucugacccacuggcucugcgcgaauucaaagaguucgcagcaggaagaagaagcgucucaggugaccuaauauuagaaauagggaaacuuccacaacaucuaacgcaaagggcccagaaugccuuggacaaccugguuaugcugcacaacucugaacaaggaggaaaagccuauagacacgccauggaagaacuaccagacacuauagaaacguuaaugcuucuggcuuugauagcuguguugacugguggggugacguuguucuuccuaucaggaaggggucuaggaaaaacauccauuggucuacucugcgugauggccucaagugcacuguuauggauggccaguguggaaccccauuggauagcggccucuaucauacuggaguucuuucugaugguguugcuuauuccagaaccggacagacagcgcacuccacaagacaaccagcuagcauacguggugauaggucuauuauucaugauauugacaguggcagccaaugagaugggauuacuggaaaccacaaagaaggaccuagggauuggucauguggcugcugaaagccaucaucaugcugcaaugcuggacguagaccuacauccagcuucagccuggacccuuuaugcaguggccacaacaguuaucacucccaugaugagacacacaauugaaaacacaacggcaaacaucucccugacagcuauugcaaaccaggcagcuauauugaugggacuugacaagggauggccaauaucaaagauggacauaggaguuccccuucuugccuuggggugcuauucucaggugaacccgcugacgcugacagcggcgguguugauguuaguggcucauuaugccauaauuggacccggacugcaagcaaaagcuacuagagaagcucaaaaaaggacagcagcuggaauaaugaaaaacccaacugucgaugggaucguugcaauagauuuggacccugugguuuacgaugcaaaauuugaaaaacagcuaggccaaauaaugcuguugauacuuugcacaucacagauucuccugaugcggaccacaugggccuugugugaauccaucacacuagccacuggaccucugaccacacucugggagggaucuccaggaaaauucuggaacaccacgauagcgguguccauggcaaacaucuuuaggggaagcuaucuagcaggagcaggucuggccuucucauuaaugaaaucucuaggaggagguaggagaggcacgggagcccaaggggaaacacugggagaaaaauggaaaagacagcugaaccaauugaguaagucagaauucaacacuuacaaaaggagugggaucauagagguggauagaucugaagccaaagagggguuaaaaagaggagaaacgacuaaacacgcggugucgagaggaacggccaaacugaggugguuuguagagaggaaccuugugaaaccagaagggaaagucauagaccucgguuguggaagagguggcuggucauauuauugcgcugggcugaagaaagucacagaagugaaaggauacacgaaaggaggaccugggcaugaggaaccaauuccaauggcaaccuauggauggaaccuaguaaaacuacacuccgggaaagauguauucuuuacaccaccugagaaaugugacacccucuugugcgauauuggugaguccucuccgaacccaaccauagaagaaggaagaacguuacguguacuaaagaugguggaaccauggcuuagaggaaaccaauuuugcauaaaaguucuaaaucccuauaugccgagcgugguagaaacuuuggagcaaaugcaaagaaaacauggaggaaugcuagugcgaaauccacucucaagaaacuccacucaugaaauguacuggguuucauguggaacaggaaauauugugucagcaguaaacaugacaucuagaaugcugcugaaucgauucacaauggcucacaggaagccaacauaugaaagagacguggacuuaggcgcuggaacaagacauguggcaguagaaccagagguggccaaccuagauaucauuggccagaggauagaaaauauaaaaaaugaacacaaaucaacauggcauuaugaugaggauaauccauacaaaacaugggccuaucauggaucauaugaagucaagccaucaggaucagccucauccauggucaaugguguggugagacugcuaaccaaaccaugggaugucauccccauggucacacaaauagccaugacugacacuacacccuuuggacaacagaggguguucaaagagaaaguugacacgcgcacaccaaaagcgaagcgaggcacagcacaaauuauggaggugacagcuaggugguuauggggguuucucucuagaaacaaaaaacccagaaucuguacaagagaggaguucacaaaaaaagucaggucaaacgcagcuauuggagcaguguucguugaugaaaaucaauggaacucagcaaaagaggcaguggaagaugaacgguucugggaccuugugcacagagagagggagcuucauaagcaaggaaagugugccacgugugucuacaacaugaugggaaagagagagaaaaaauuaggagaguuuggaaaggcaaaaggaagucgcgcaauaugguacaugugguugggagcgcgcuuuuuagaguuugaagcccuugguuucaugaaugaagaucauugguucagcagagagaauucacucaguggaguggagggagagggacuccacaaacuuggguacauacucagagacauaucaaagauuccagggggaaauauguaugcagaugacacagccggaugggacacaagaauaacagaggaugaucuucagaaugaggccaaaaucacugacaucauggaaccugaacaugcccuacuggccacgucaaucuucaagcuaaccuaccaaaacaagguaguaagggugcagagaccagcaaaaaauggaaccgugauggaugucauauccaggcgugaccagagaggaaguggacagguuggaaccuauggcuuaaacaccuucaccaacauggaggcccaacuaauaagacaaauggagucugagggaaucuuuuuacccagcgaauuggaaaccccaaaucuagcugaaagaguccuugacugguuggaaaaauauggcaucgagaggcugaaaagaauggcaaucaguggagaugacuguguggugaaaccaauugaugacagauucgcaacagccuuaacagcuuugaaugacaugggaaagguaagaaaagacauaccacaaugggaacccucaaaaggauggaaugauuggcaacaagugcccuucuguucacaccauuuccaccagcugauuaugaaggacgggagggagauaguggugccaugccgcaaccaagaugaacuuguggguagggcuagaguaucacaaggcgccggauggagccugagagaaacugcaugccuaggcaagucauaugcacaaauguggcagcugauguacuuccacaggagagacuugagauuagcggcuaaugcuaucuguucagccgucccaguugauugggucccaaccagccgcaccacuuggucgauccaugcccaccaccaauggaugacaacagaagacauguugucaguguggaauaggguuuggauagaggaaaacccauggauggaagacaaaacucacguguccaguugggaagacguuccauaccuaggaaaaagggaagaucaaugguguggaucccuaauaggcuuaacagcacgagccaccugggccaccaacauacaaguggccauaaaccaagugagaaggcucauugggaaugagaacuaucuagacuacaugacaucaaugaagagauucaaaaacgagagugaucccgaaggggcacucugguga

SEQ ID NO: 6320 - RNA, 9879 nt, Artificial Sequence
  derived and/or modified CDS sequence (wt) from DENV-1__KU666942__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcagguguuaacaugugcacccuuauagcgauggauuugggagaguuaugugaggacacaaugacuuacaaaugcccucgaaucacugaggcggaaccagaugacguugauuguuggugcaaugccacagauacaugggugaccuauggaacauguucccaaacaggcgagcaccgacgagacaaacguuccgucgcacuggccccacacgugggacuuggcuuggaaacaagaaccgaaacguggauguccuccgaaggcgcuuggaaacagauacaaagaguggagacuugggcccugagacacccaggauucacggugauagcccuuuuucuagcacaugccauaggaacauccaucacccagaaagggauuaucuucauauuguuaaugcugguuacaccauccauggccaugcgaugcgugggaauaggcagcagggacuucguggaaggacugucaggagcaacuuggguagacguggugcuggaacauggaaguugcgucacuaccauggcaaaagacaaaccaacauuggacauugaacucuugaagacggaagucacaaacccugccauccugcgcaaacugugcauugaagccaaaauaucaaacaccaccaccgacucaagauguccaacacaaggagaagccacacugguggaagaacaagacgcgaacuuugugugucgacgaacguuuguggacagaggcuggggcaauggcugugggcuuuucggaaaaggaagccuuauaacgugugcuaaguucaagugugugacaaaacuggaaggaaaaauaguucaauaugaaaacuugaaauauucaguaauagucaccguucacacuggagaccagcaccagguaggaaaugaaagcacagaacaugggacaacugcaacuauaacaccucaagcuccuacgacagaaauacagcugaccgacuacggagcucuuacauuggauuguucaccuagaacaggacuagacuucaaugaaaugguguuguugacaaugaaagaaaaaucauggcuaguccacaaacaaugguuucuagaccuaccacugccuuggaccucgggagcuucaacaucacaagaaacuuggaacagacaagauuugcuggugacauuuaagacagcucaugcgaagaagcaggaaguagucguacuaggaucacaagaaggagcaaugcacacugcguugaccggagcgacggaaauccaaacgucuggaacgacaacaauuuuugcaggacacuugaaauguagacuaaagauggauaaacugacucuaaaagggaugucauaugugaugugcacaggcucauuuaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagccaaccccauagucacugacaaagaaaaaccagucaacauugaggcagaaccgccuuuuggugagaguuacauugugauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacaugguugggauuaaacucaaggagcacgucccuuucgaugacgugcauugcaguuggccuaguaacgcuauacuuaggagucaugguucaggcggauucaggauguguaaucaauuggaaagguagagaacucaaauguggaaguggcauuuuugucaccaaugaaguucacacuuggacagagcaauacaaauuucaagcugauuccccgaagagacuaucaacagccauugggaaggcaugggaggaggguguguguggaauucgaucagcaacucgucucgagaacaucauguggaagcaaauaucaaaugaauugaaccacaucuugcuugaaaauggcaugaaauucacagugguuguaggagauguugcugggaucuuggcucaaggaaaaaagaugauuaggccacaacccauggaacacaaauacucguggaaaagcuggggaaaggcuaaaaucauaggggcagaugugcagaacaccaccuuuaucaucgacgguccaaacaccccagaaugcccugaugaucaaagagcauggaacauuugggaaguugaggauuauggauucggaauuuucacgacaaacauauggcugaaauugcgugacucuuacacccaagugugugaccaccggcuaaugucagcugcuaucaaggacagcaaggcaguucacgcugacaugggguacuggauagaaagugaaaagaacgagaccuggaagcuggcaagagccucuuucauagaagucaaaacauguaucuggccaaaaucucacacucuauggagcaauggaguucuggaaagugaaaugauaauuccaaagaucuauggaggaccaauaucucagcacaacuauagaccaggauauuucacacaaacggcagggccguggcaccuaggcaaguuggaacuggauuuugauuugugugaggguaccacgguuguuguggaugaacauuguggaaaucgaggaccaucucuuaggaccacaacagucacaggaaagauaauucaugaaugguguugcagaucuuguacgcuaccacccuuacguuacagaggagaagauggguguugguacggaauggaaaucagaccagucaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguagggcuacuauuccgcagacuaacauccagagaaguucuucuucuaacaauuggauugagucuaguggcaucuauggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuaugcauggaagacgauagccaugguacugucaauuguaucucucuuccccuuaugccuguccacgaccucccaaaaaacaacauggcuuccggugcuguugggaucucuuggaugcaaaccacuaaccauguuucucauagcagaaaauaaaaucuggggaaggaaaaguuggccccucaaugaaggaaucauggcuguuggaauaguuagcauccuacuaaguucacuccucaaaaaugaugugccgcuagcugggccacuaauagcuggagguaugcuaauagcguguuauguuauaucuggaagcucggccgaucuaucacuagagaaagcggcugaggucuccugggaagaagaagcagaacacucuggcgccucacacaacauauuaguggagguccaagaugacggaaccaugaagauaaaggaugaagagagagaugacacgcuaaccauucuccuuaaagcaacucugcuagcaguuucagggguguacccacuaucaauaccagcgacccuuuuugugugguacuucuggcagaaaaagaaacagagaucuggaguguuaugggacacaccuagcccuccagagguggaaagagcaguucuugaugaugguaucuauagaaucaugcagagaggacuguugggcaggucccaaguagggguaggaguuuuucaagaaaacguguuccacacaauguggcaugucaccaggggagcuguacucauguaccaagggaaaagacuggaaccgagcugggcuagugucaaaaaagacuugaucucauauggaggagguuggaggcuucaaggauccuggaacacgggagaagaagugcaggugauugcuguugaaccagggaaaaaccccaaaaauguacaaacagcgccaggcaccuuuaagacuccugaaggcgaaguuggagccauugcccuagauuuuaaacccggcacaucuggaucucccaucgugaacagagaagggaaaauaguaggucuuuauggaaauggaguagugacaacaaguggaaccuaugucagugccauagcucaagccaaagcaucacaagaagggccucuaccagagauugaagacgagguguuuaggaaaagaaacuuaacaauaauggaccuacauccaggaucggggaaaacaagaagauaccuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccagcauagcggcuagaggguacaucucaacccgagugggcaugggugaagcagcugcgaucuucaugacagccacucccccaggaucaguggaggccuuuccacagagcaacgcaguuauccaagaugaggaaagagacauuccugagagaucauggaacucaggcuaugaguggaucacugacuucccaggcaaaacaguuugguuuguuccaagcauuaaaucaggaaaugauauugccaacugcuuaagaaagaaugggaaacgggugauucaauugagcaggaaaaccuuugacacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucacgcucacuggacggaagcaaaaaugcuccuugauaacauaaacacaccagaaggaauuaucccagcccucuucgagccggagagagaaaagagugcagcaauagacggggaauacagacugcggggugaagcaaggaaaacguuuguggagcucaugagaagaggagaucuaccugucuggcuaucuuacaaaguugccucagaagguuuccaguacucugauagaagauggugcuuugacggggaaaggaacaaccagguguuggaggagaacauggacguggagaucuggacaaaagaaggagaaagaaagaaacuacgaccccgcuggcuggaugccagaacauacucagacccacuggcccugcgcgaguucaaagaguuugcagcaggaagaagaagugucucaggugaucuaauauuggaaauagggaaacuuccacaacacuugacgcaaagggcccagaaugccuuggacaaccugguuauguugcacaacuccgaacaaggaggaagagccuauagacaugcaauggaagaacugccagauaccauagaaacguugaugcuccuagcuuugauagcuguguuaacugguggagugacgcuguucuuccuaucaggaaagggcuuagggaaaacaucuaucggccuacucugcgugauggcuucaagcgcacugcuauggauggccaguguagagccccauuggauagcggcuuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucacugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgcuauaauuggaccuggacugcaagcaaaagcuacuagagaagcucaaaaaaggacagcggccggaauaaugaaaaauccaaccguugauggaaucguugcaauagacuuggacccugugguuuaugaugcgaaauuugagaaacaacuaggccaaauaauguuguugauacuaugcacaucacagauccucuugaugcggacuacaugggccuugugcgaauccaucacacuggccacuggaccucugaccacgcucugggagggaucuccaggaaaauuuuggaauaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugaguaagucagaauucaacaccuauaaaaggagugggauuauggaaguggacagauccgaagccaaagagggacugaaaagaggagaaacaaccaaacaugcagugucgagaggaaccgcuaaauugaggugguuuguggagaggaaccuugugaaaccagaagggaaagucauagaccucgguuguggaagagguggcuggucauacuauugcgcugggcugaagaaaguuacagaagugaagggauacacaaaaggaggaccuggacaugaagaaccagucccaauggcgaccuauggauggaaccuaguaaagcugcacuccgggaaagacguauucuuuauaccaccugagaaaugugacacccucuugugugauauuggugaguccucuccaaacccaacuauagaggaaggaagaacgcuacgcguccuaaagaugguggaaccauggcuuagaggaaaccaauuuugcauaaaaauucugaaucccuacaugcccagugugguggaaacucuggagcaaaugcaaagaaaacauggaggaaugcuggugcgaaauccacucucaagaaauucuacucaugaaauguauuggguuucauguggaacaggaaacauugugucagcaauaaacaugacauccagaauguugcuaaaucgauucacaauggcucacaggaaaccaacauaugaaagagacguggaccuaggcgccggaacaagacauguugcaguggaaccagagguagccaaccuagauaucauuggccagaggauagagaacauaaaaugugaacacaagucaacauggcauuaugaugaggacaauccauauaaaacaugggccuaucauggaucauaugaggucaagccaucaggaucagccucauccauggucaaugguguggugaaacugcucaccaaaccaugggaugucauccccauggucacacaaauagccaugacugacacuacacccuuuggacaacagaggguguuuaaagagaaaguugacacacgcacaccaaaagcaaaacgaggcacagcacaaaucauggaggugacagccaggugguuaugggguuuucuuucuagaaacaagaagccaagaauuuguacaagagaggaguucacaagaaaaguuaggucaaacgcagccauuggagcgguguucguugacgaaaaucaauggaacucagcaaaagaagcaguggaagaugagcgguucugggaccuugugcacagagagagggagcuucacaaacagggaaaaugugccacguguguuuacaacaugauggggaagagagagaaaaagcuaggagaauuuggaaaggcaaaaggaagucgugcaauaugguacaugugguugggagcacgcuuucuagaauucgaagcucuugguuucaugaacgaagaucacugguucagcagagagaauucacucagcggaguggaaggagaaggacuccacaaacuuggauauauacuuagagacauaucaaagauuucagggggaaacauguaugcagaugacacagccggaugggauacaaggauaacagaggaugaccuucagaaugaggccaaaauuacugagaucauggaacccgaacaugcccaacuggcuaaggcaaucuucaagcuaaccuaccaaaauaaagugguaaggguacagagaccagcaaaaaauggaaccgugauggaugucauauccagacgugaccagagaggaaguggccaagucggaacuuauggcuuaaacacuuucaccaacauggaagcccagcugauaagacaaauggagucugagggaaucuuuucacccagugaauuagagaccccaaauuuagccgagagaguucucgacuggcuggaaaaauauggcgucgaaaggcuaaaaagaauggcaaucaguggagaugacugcguagugaaaccaauugaugauagguuugcaacagcccuaacugcucugaaugauaugggaaaaguaagaaaagauauaccacaaugggaacccucaaaaggauggaaugauuggcaacaagugccuuuuuguucacaccacuuccaccagcugauuaugaaggaugggagggaaauaguggugccaugccgcaaccaagaugaacuuguggguagggcuagagugucacaaggggcuggauggagccugagagaaaccgcaugccuaggcaaaucauaugcacaaauguggcagcugauguacuuccacaggagagaccugagacuagccgcuaaugcuaucuguucagccguuccaguugauugggucccaaccagccgcaccaccuggucgauccacgcccaucaccaauggaugacaacagaagacaugcugucaguguggaauaggguuuggauagaggaaaacccauggaugaaggacaaaacccauauauccaguugggaagauguuccauauuuagggaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6321 - RNA, 9879 nt, Artificial Sequence
  derived and/or modified CDS sequence (wt) from DENV-1__KU666939__SS-prME
ucugugaccaugcuccuuaugcugaugccuacagccuuggcauuccauuugacuacacgagggggagagccgcacaugauagucagcaagcaggaaagaggaaagucacuuuuguuuaagaccucagcaggugucaacaugugcacccucauagcgauggauuugggagaguuaugugaggacacaaugacuuacaaaugcccucgaaucacugaggcggaaccagaugacguugauuguuggugcaaugccacagacacaugggugaccuauggaacauguucccaaacuggcgagcaccgacgagacaaacguuccguugcacuggccccacacgugggacuugguuuggaaacaagaaccgaaacguggauguccucugaaggcgcuuggaaacagauacaaagaguggagacuuggguccugagacacccaggauucacggugauagcccuuuuucuagcacaugccauaggaacauccaucacccagaaagggauuaucuucauuuuguuaaugcugguuacaccauccauggccaugcgaugcgugggaauaggcagcagggacuucguggaaggacugucaggagcaacuuggguagaugugguguuggaacauggaaguugcgucacuaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuuauaacgugugccaaguucaagugugugacaaaacuggaaggaaaaauaguucaauaugaaaacuugaaauauucaguaauagucaccguccacacuggagaccagcaccaggugggaaaugaaagcacagaacaugggacaacugcaaccauaacaccucaagcuccuacgacagaaauacagcugaccgacuacggagcucuuacauuggauuguuuaccuagaacaggacuggacuucaaugaaaugguguuguugacaaugaaagaaaaaucauggcuaguccacaaacaaugguuucuagaccuaccacugccuuggaccucgggagcuucaacaucacaagaaacuuggaacagacaagauuugcuggugacauuuaagacagcucaugcaaagaagcaggaaguagucguacuaggaucacaagaaggagcaaugcacacugcguugaccggagcgacggaaauccaaacaucuggaacgacaacaauuuuugcaggacacuugaaauguagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagccaaccccauagucacugacaaagaaaaaccagucaacauugaggcagaaccgccuuuuggugagaguuacaucgugauaggagcaggugaaaaggcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcagucggccuaguaacgcuauacuuaggagucaugguucaggcggauucaggauguguaauuaauuggaaagguagagaacucaaaugugggaguggcauuuuugucacuaaugaaguucacacuuggacagagcaauacaaauuucaagcugauuccccaaagagacuaucagcagccauugggaaggcaugggaggaggguguguguggaauucgaucagcaacccgucucgagaacaucauguggaagcaaauaucaaaugaauugaaccacaucuugcuugaaaaugacaugaaauucacagugguuguaggagauguugcugggaucuuggcucaagggaaaaaaaugauuaggccacaacccauggaacacaaauacucguggaaaagcuggggaaaagcuaaaaucauaggggcagauguacagaacaccaccuuuaucaucgacggcccaaacaccccagaaugcccugaugaucaaagagcauggaacauuugggaaguugaggauuauggauuuggaauuuucacgacaaacauauggcugaaauugcgugacuccuacacccaagugugugaccaccggcuaaugucagcugccaucaaagacagcaaggcaguucacgcugacaugggguacuggauagaaagugaaaagaacgagaccuggaagcuggcaagagccucuuucauagaagucaaaacguguaucuggccaaaaucucacacucuauggagcaauggaguucuggaaagugaaaugauaauuccaaagaucuauggaggaccaauaucucagcacaacuacagaccaggauauuucacacaaacggcagggccguggcaucuaggcaaguuggaacuggauuuugauuugugugaggguaccacgguuguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccagucaaggaaaaggaagagaaucuagucaaaucaauggucucugcagggucaggggaaguggacagcuuuucacuaggacuguuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgaccuaccuagcucugauggccacuuuuaaaaugagaccaauguuugccguagggcuacuauuccgcagacuaacauccagagaaguucuucuucuaacaauuggauugagucuaguggcaucuguggaguuaccaaauuccuuggaggagcugggggauggacuugcaaugggcauuaugaucuuaaaauuauugacugacuuucaaucacaucagcugugggcuaccuugcuguccuugacauuuaucaaaacaacguuuuccuugcacuaugcauggaagacaauggcuaugguacugucaauuguaucucucauccccuuaugccuguccacgaccucccaaaaaacaacauggcuuccggugcuguugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccauugauagcuggaggcaugcuaauagcauguuaugucauaucuggaagcucagccgaucuauuacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaauuucagggguguacccauuaucaauaccagcgacccuuuuugugugguacuuuuggcagaaaaagaaacagagaucuggaguguuaugggacacaccuagcccuccagaaguggaaagagcaguucuugaugauggcaucuauagaaucaugcagagaggacuguugggcaggucccaaguggggguaggaguguuucaagaaaacguguuccacacaauguggcaugucaccaggggagcuguacucauguaccaagggaagagacuggaaccgagcugggccagugucaaaaaagaccugaucucauauggaggagguuggaggcuucaaggauccuggaacacgggagaagaagugcaggugauugcuguugaaccagggaaaaaucccaaaaauguacaaacagcgccgggcacuuuuaagaccccugaaggcgaaguuggagccauugcccuagauuuuaaacccggcacaucuggaucucccaucgugaacagagaagggaaaauaguaggucuuuauggaaauggaguggugacaacaagugggaccuacgucagugccauagcucaagccaaagcaucacaagaagggccccuaccagagauugaagaugagguguuuaggaaaagaaacuuaacaauaauggaccugcauccaggaucgggaaaaacaagaagauaccuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacacacaggaaaagagauaguugaccucaugugucacgccaccuucaccaugcgccuccugucucccgugagaguucccaauuauaacaugauuauuauggaugaagcacauuucaccgauccauccagcauagcggcuagaggguacaucucaacccgagugggcaugggugaagcagcugcgauuuucaugacagccacucccccaggaucaguggaggccuuuccacagagcaacgcaguuauccaagaugaggaaagagauauuccugagagaucauggaacucagguuaugaguggaucacugacuucccaggcaaaacaguuugguuuguuccaagcauuaaaucaggaaaugauauugccaacugcuuaagaaagaaugggaaacgggugauucaauugagcagaaaaaccuuugacacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucaucuuagcaggaccgaugccagugacuguggccagugccgcccagaggagaggaagaauuggaaggaaccacaacaaggaaggugaucaguacaucuauaugggacagccuuuaaacaacgaugaagaucacgcucacuggacggaagcaaaaaugcuccuugauaauauaaacacaccagaaggaauuaucccagcccucuucgagccggagagagaaaagagugcggcaauagacggggaauacagacugcggggugaagcaaggaaaacguuuguggagcucaugagaagaggagaucuaccugucuggcuauccuacaaaguugccucagaaggcuuccaauacucugacagaagauggugcuuugacggggaaaggaacaaccagguguuggaagagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuggaaauagggaaacuuccacaacacuugacgcaaagggcccagaaugccuuggauaaccuggucauguugcacaacuccgaacaaggaggaagagccuauagacaugcaauggaagaacugccagacaccauagaaacguuaaugcuccuagcuuugauagcuguguuaacugguggagugacgcuguucuuccuaucaggaaggggcuuagggaaaacaucuaucggccuacucugcgugauggcuucaagcguauugcuauggauggccaguguagagccccauuggauagcggccuccaucauacuggaguucuuccugauggugcugcucauuccagagccagacagacaacgcacuccgcaggacaaucagcuggcauauguggugauagguuuguuauucaugauacuaacaguagcagccaaugagaugggacugcuggaaaccacaaagaaagacuuagggauuggccauguggcuguugaaaaucaccaccaugccacaaugcuggacguagacuuacauccagcuucagccuggacccucuaugcaguggccacaacaaucaucacucccaugaugaggcacacaaucgaaaacacaacggcaaacauuucccugacagccauugcaaaucaggcagcuauauugaugggacuugacaaaggauggccaauaucgaagauggacauaggaguuccacuucucgccuuggggugcuauucccaggugaauccacugacgcugacagcggcgguauugaugcuaguggcccauuacgcuauaauuggaccuggacugcaagcaaaagcuacuagagaagcucaaaaaaggacagcggccggaauaaugaaaaauccaacuguugauggaaucguugcaauagacuuggacccugugguuuaugaugcgaaauuugagaaacaacuaggccaaauaauguuguugauacuaugcacaucacagauccucuugaugcggacuacaugggccuugugcgaauccaucacacuggccacuggaccucugaccacgcucugggagggaucuccaggaaaauuuuggaacaccacgauagcaguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacaccuauaaaaggagugggauuauggaaguggacagauccgaagccaaagagggacugaaaagaggagaaacaaccaaacaugcagugucgagaggaaccgcuaaauugaggugguuuguggagaggaaccuugugaaaccagaagggaaagucauagaccucgguuguggaagagguggcuggucauacuauugcgcugggcugaagaaagucacagaggugaagggauacacaaaaggaggaccuggacacgaagaaccaaucccaauggcgaccuauggauggaaccuaguaaagcuguacuccgggaaagacguauucuuuauaccaccugagaaaugugacacccucuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgguucacaauggcucauaggaaaccaacauacgaaagagacguggaccuaggcgccggaacaagacauguggcaguagaaccagagguagcuaaccuagauaucauuggccagaggauagagaacauaaaacaugaacacaagucaacauggcauuaugaugaggacaauccauauaaaacaugggccuaucauggaucauaugaggucaaaccaucaggaucagccucauccauggucaaugguguggugaaacugcucaccaaaccaugggaugucauccccauggucacacaaauagcuaugacugacacuacacccuuuggacaacagaggguauuuaaagagaaaguugacacacgcacaccaaaagcaaaacgaggcacagcacaaaucauggaggugacagccaggugguuaugggguuuucuuucuagaaacaagaagccaagaauuuguacaagagaggaguucacaagaaaaguuaggucaaacgcagccaucggagcaguguucauugacgaaaaucaauggaacucagcaaaagaagcaguggaagaugagcgguucugggaccuugugcacagagagagggagcuucacaaacagggaaaaugugccacguguguuuacaacaugauggggaagagagagaaaaagcuaggagaauuuggaaaggcaaaaggaagucgugcaauaugguacaugugguugggagcacgcuuucuagaguucgaagcucuugguuucaugaacgaagaccacugguucagcagagagaauucacucagcggaguggaaggagaaggacuccacaaacuuggauauauacucagagacauaucaaagauuccagggggaaacauguacgcugaugacacagccggaugggauacaaggauaacagaggaugaccuucagaaugaggccaaaauuacugacaucauggaacccgaacaugcccuacuggcuaaggcaaucuucaagcuaaccuaccaaaauaaagugguaaggguacagagaccagcaaaaaauggaaccgugauggaugucauauccagacgugaccagagaggaaguggccaggucggaacuuauggcuuaaacacuuucaccaacauggaagcccagcugauaagacaaauggagucugagggaaucuuuucacccagugaauuagagaccccaaauuuagccgagagaguucucgacugguugggaaaauauggcgucgaaaggcugaaaagaauggcaaucaguggagaugacugcguagugaaaccaauugaugauagguuugcaacagccuuaacagcucugaaugauaugggaaaaguaagaaaagauauaccacaaugggaacccucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaaccgcaugccuaggcaaaucauaugcacaaauguggcagcugauguacuuccacaggagagaccugagacuagcugcuaaugcuaucuguucagccguuccaguugauugggucccaacuagccgcaccaccuggucuauccaugcccaucaccaauggaugacaacagaagacaugcugucaguguggaauagaguuuggauagaggaaaacccauggauggaggacaaaacccauauauccaguugggaagauguuccauauuuagggaaaagggaagaucaaugguguggaucccugauaggcuuaacagcaagggccaccugggccaccaacauacaaguggccauaaaccaagugagaagacuaauugggaaugaaaauuaucuagauuacaugacaucaaugaagagauucaagaacgagagugaucccgaaggggcacucugguga

SEQ ID NO: 6322 - RNA, 9879 nt, Artificial Sequence
  derived and/or modified CDS sequence (wt) from DENV-1__KU666940__SS-prME
ucugugaccaugcuccuuaugcugacgccuacagccuuggcguuccauuugacuacacgagggggagagccgcacaugauagucagcaagcaggaaagaggaaagucacuuuuguuuaagaccucagcagguguuaacaugugcacccuuauagcgauggauuugggagaguuaugugaggauacaaugacuuacaaaugcccucgaaucacugaggcggaaccagaugacguugauuguuggugcaaugccacagauacaugggugaccuauggaacauguucccaaacaggcgagcaccgacgagacaaacguuccgucgcacuggccccacacgugggacuugguuuggaaacaagaaccgaaacguggauguccuccgaaggcgcuuggaaacagauacaaagaguggagacuugggcccugagacacccaggauucacggugauagcccuuuuucuagcacaugccauaggaacauccaucacccagaaagggauuaucuucauuuuguuaaugcugguuacaccauccauggccaugcgaugcgugggaauaggcagcagggacuucguggaaggacugucaggagcaacuuggguagacguggugcuggaacauggaaguugcgucacuaccauggcaaaagacaaaccaacauuggacauugaacucuugaagacggaagucacaaacccugccguccugcgcaaacugugcauugaagccaaaauaucaaacaccaccaccgacucaagauguccaacacaaggagaagccacacugguggaagaacaagacgcgaacuuugugugucgacgaacguuuguggacagaggcuggggcaauggcugugggcuuuucggaaaaggaagccuuauaacgugugcuaaguucaagugugugacaaaacuggaaggaaaaauaguucaauaugaaaacuugaaauauucaguaauagucaccguucacacuggagaccagcaccaggugggaaaugaaagcacagaacaugggacaacugcaacuauaacaccucaagcuccuacgacagaaauacagcugaccgacuacggagcucuuacauuggauuguucaccuagaacaggacuagacuucaaugaaaugguguuguugacaaugaaagaaaaaucauggcuaguccacaaacaaugguuucuagaccuaccacugccuuggaccucgggagcuucaacaucacaagaaacuuggaacagacaagauuugcuggugacauuuaagacagcucaugcgaagaagcaggaaguagucguacuaggaucacaagaaggagcaaugcacacugcguugaccggagcgacggaaauccaaacgucuggaacgacaacaauuuuugcaggacacuugaaauguagacuaaagauggauaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagccaaccccauagucacugacaaagaaaaaccagucaacauugaggcagaaccgccuuuuggugagaguuacauugugauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacaugguuaggauuaaacucaaggagcacgucccuuucgaugacgugcauugcaguuggccuaguaacgcuauacuuaggagucaugguucaggcggauucaggauguguaaucaauuggaaagguagagaacucaaauguggaaguggcauuuuugucaccaaugaaguucacacuuggacagagcaauacaaauuucaagcugauuccccaaagagacuaucagcagccauugggaaggcaugggaggaggguguguguggaauucgaucagcaacucgucucgagaacaucauguggaagcaaauaucaaaugaauugaaccacaucuugcuugaaaaugacaugaaauucacagugguuguaggagauguugcugggaucuuggcucaaggaaaaaagaugauuaggccacaacccauggaacacaaauacucguggaaaagcuggggaaaggcuaaaaucauaggagcagaugugcagaacaccaccuuuaucaucgacggcccaaacaccccagaaugcccugaugaucaaagagcauggaacauuugggaaguugaggauuauggauucggaauuuucacgacaaacauauggcugaaauugcgugacuccuacacccaagugugugaccaccggcuaaugucagcugcuaucaaggacagcaaggcaguucacgcugacaugggguacuggauagaaagugaaaagaacgagaccuggaagcuggcaagagccucuuucauagaagucaaaacauguaucuggccaaaaucucacacucuauggagcaauggaguucuggaaagugaaaugauaauuccaaagaucuauggaggaccaauaucucagcacaacuauagaccaggauauuucacacaaacggcagggccguggcaccuaggcaaguuggaacuggauuuugauuugugugaggguaccacgguuguuguggaugaacauuguggaaaucgaggaccaucucuuaggaccacaacagucacaggaaagauaauucaugaaugguguugcagaucuuguacgcuaccacccuuacguuacagaggagaagauggguguugguacggaauggaaaucagaccagucaaggaaaaggaagagaaucuagucaaaucaauggucucugcagggucaggggaaguggauagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguagggcuacuauuccgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuaugcauggaagacgauagccaugguacugucaauuguaucucucuuccccuuaugccuguccacgaccucccaaaaaacaacauggcuuccggugcuguugggaucucuuggaugcaaaccacuaaccauguuucucauagcagaaaauaaaaucuggggaaggaaaaguuggccccucaaugaaggaaucauggcuguuggaauaguuaguauccuacuaaguucacuccucaaaaaugaugugccgcuagcugggccacuaauagcuggagguaugcuaauagcguguuauguuauaucuggaagcucggccgaucuaucacuagagaaagcggcugaggucuccugggaagaagaagcagaacacucuggcgccucacacaacauauuaguggagguccaagaugacggaaccaugaagauaaaggaugaagagagagaugacacgcuaaccauucuccuuaaagcaacucugcuagcaguuucagggguguacccacuaucaauaccagcgacccuuuuugugugguacuucuggcagaaaaagaaacagagaucuggaguguuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcuguacucauguaccaagggaaaagacuggaaccgagcugggcuagugucaaaaaagaccugaucucauauggaggagguuggaggcuucaaggauccuggaacacgggagaagaagugcaggugauugcuguugaaccagggaaaaaccccaaaaauguacaaacagcgccaggcaccuuuaagacuccugaaggcgaaguuggagccauugcccuagauuuuaaacccggcacaucuggaucucccaucgugaacagagaagggaaaauaguaggucuuuauggaaauggaguagugacaacaaguggaaccuaugucagugccauagcucaagccaaagcaucacaagaagggccucuaccagagauugaagacgagguguuuaggaaaagaaacuuaacaauaauggaccuacauccaggaucggggaaaacaagaagauaccuuccagccauaguccgugaggccauaaaaaggaagcugcgcacacuaauucuggcucccacaaggguugucgcuuccgaaauggcagaggcgcuuaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccagcauagcggcuagaggguacaucucaacccgagugggcaugggugaagcagcugcgaucuucaugacagccacucccccaggaucaguggaggccuuuccacagagcaacgcaguuauccaagaugaggaaagagacauuccugagagaucauggaacucaggcuaugaguggaucacugacuucccaggcaaaacaguuugguuuguuccaagcauuaaaucaggaaaugauauugccaacugcuuaagaaagaaugggaaacgggugauucaauugagcaggaaaaccuuugacacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacauuuacaugggacagccuuuaaacaacgaugaagaucacgcucacuggacggaagcaaaaaugcuccuugauaauauaaacacaccagaaggaauuaucccagcccucuucgagccggagagagaaaagagugcagcaauagacggggaauacagacugcggggugaagcaaggaaaacguuuguggagcucaugagaagaggagaucuaccugucuggcuaucuuacaaaguugccucagaagguuuccaguacucugauagaagauggugcuuugacggggaaaggaacaaccagguguuggaggagaacauggacguggagaucuggacaaaagaaggagaaagaaagaaacuacgaccccgcuggcuggaugccagaacauacucagacccacuggcccugcgcgaguucaaagaguuugcagcaggaagaagaagugucucaggugaucuaauauuggaaauagggaaacuuccacaacacuugacgcaaagggcccagaaugccuuggacaaccugguuauguugcacaacuccgaacaaggaggaagagccuauagacaugcaauggaagaacugccagauaccauagaaacguugaugcuccuagcuuugauagcuguguuaacugguggagugacgcuguucuuccuaucaggaaagggcuuagggaaaacaucuaucggccuacucugcgugauggcuucaagcgugcugcuauggauggccaguguagagccccauuggauagcggcuuccaucauacuggaguucuuccugauggugcugcuuauuccagagccagauagacaacgcacuccgcaggacaaccagcuggcauauguggugauaggcuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucacugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgcuauaauuggaccuggacugcaagcaaaagcuacuagagaagcucaaaaaaggacagcggccggaauaaugaaaaauccaaccguugauggaaucguugcaauagauuuggacccugugguuuaugaugcgaaauuugagaaacaacuaggccaaauaauguuguugauacuaugcacaucacagauccucuugaugcggacuacaugggccuugugcgaauccaucacacuggccacuggaccucugaccacgcucugggagggaucuccaggaaaauuuuggaauaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugaguaagucagaauucaacaccuauaaaaggagugggauuauggaaguggacagauccgaagccaaagagggacugaaaagaggagaaacaaccaaacaugcagugucgagaggaaccgcuaaauugaggugguuuguggagaggaaccuugugaaaccagaagggaaagucauagaccucgguuguggaagagguggcuggucauacuauugcgcugggcugaagaaaguuacagaagugaagggauacacaaaaggaggaccuggacaugaagaaccagucccaauggcgaccuauggauggaaccuaguaaagcugcacuccgggaaagacguauucuuuauaccaccugagaaaugugacacccucuugugugauauuggugaguccucuccaaacccaacuauagaggaaggaagaacgcuacgcguccuaaagaugguggaaccauggcuuagaggaaaccaauuuugcauaaaaauucugaaucccuacaugcccagugugguggaaacucuggagcaaaugcaaagaaaacauggaggaaugcuggugcgaaauccacucucaagaaauucuacucaugaaauguauuggguuucauguggaacaggaaacauugugucagcaauaaacaugacauccagaauguugcuaaaucgauucacaauggcucacaggaaaccaacauaugaaagagacguggaccuaggcgccggaacaagacauguugcaguggaaccagagguagccaaccuagauaucauuggccagaggauagagaacauaaaaugugaacacaagucaacauggcauuaugaugaggacaauccauauaaaacaugggccuaucauggaucauaugaggucaagccaucaggaucagccucauccauggucaaugguguggugaaacugcucaccaaaccaugggaugucauccccauggucacacaaauagccaugacugacacuacacccuuuggacaacagaggguguuuaaagagaaaguugacacacgcacaccaaaagcaaaacgaggcacagcacaaaucauggaggugacagccaggugguuaugggguuuucuuucuagaaacaagaagccaagaauuuguacaagagaggaguucacaagaaaaguuaggucaaacgcagccauuggagcaguguucguugacgaaaaucaauggaacucagcaaaagaagcaguggaagaugagcgguucugggaccuugugcacagagagagggagcuucacaaacagggaaaaugugccacguguguuuacaacaugauggggaagagagagaaaaagcuaggagaauuuggaaaggcaaaaggaagucgugcaauaugguacaugugguugggagcacgcuuucuagaauucgaagcucuugguuucaugaacgaagaucacugguucagcagagagaauucacucagcggaguggaaggagaaggacuccacaaacuuggauacauacuuagagacauaucaaagaucucagggggaaacauguaugcagaugacacagccggaugggauacaaggauaacagaggaugaccuucagaaugaggccaaaauuacugagaucauggaacccgaacaugcccaacuggcuaaggcaaucuucaagcuaaccuaccaaaauaaagugguaaggguacagagaccagcaaaaaauggaaccgugauggaugucauauccagacgugaccagagaggaaguggccaagucggaacuuauggcuuaaacacuuucaccaacauggaagcccagcugauaagacaaauggagucugagggaaucuuuucacccagugaauuagagaccccaaauuuagccgagagaguucucgacuggcuggaaaaauauggcgucgaaaggcuaaaaagaauggcaaucaguggagaugacugcguagugaaaccaauugaugauagguuugcaacagcccuaacugcucugaaugauaugggaaaaguaagaaaagauauaccacaaugggaacccucaaaaggauggaaugacuggcaacaagugccuuuuuguucacaccacuuccaccagcugauuaugaaggaugggagggaaauaguggugccaugccgcaaccaagaugaacuuguggguagggcuagagugucacaaggggcuggauggagccugagagaaaccgcaugccuaggcaaaucauaugcacaaauguggcagcugauguacuuccacaggagagaccugagacuagccgcuaaugcuaucuguucagccguuccaguugauugggucccaaccagccgcaccaccuggucgauccacgcccaucaccaauggaugacaacagaagacaugcugucaguguggaauaggguuuggauagaggaaaacccauggaugaaggacaaaacccauauauccaguugggaagauguuccauauuuagggaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6323 - RNA, 9879 nt, Artificial Sequence
  derived and/or modified CDS sequence (wt) from DENV-1__KU666941__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcagguguuaacaugugcacccuuauagcgauggauuugggagaguuaugugaggacacaaugacuuacaaaugcccucgaaucacugaggcggaaccagaugacguugauuguuggugcaaugccacagauacaugggugaccuauggaacauguucccaaacaggcgagcaccgacgagacaaacguuccgucgcacuggccccacacgugggacuugguuuggaaacaagaaccgaaacguggauguccuccgaaggcgcuuggaaacagauacaaagaguggagacuugggcccugagacacccaggauucacggugauagcccuuuuucuagcacaugccauaggaacauccaucacccagaaagggauuaucuucauuuuguuaaugcugguuacaccauccauggccaugcgaugcgugggaauaggcagcagggacuucguggaaggauugucaggagcaacuuggguagacguggugcuggaacauggaagcugcgucacuaccauggcaaaagacaaaccaacauuggacauugaacucuugaagacggaagucacaaacccugccguccugcgcaaacugugcauuggagccaaaauaucaaacaccaccaccgacucaagauguccaacacaaggagaagccacacugguggaagaacaagacgcgaacuuugugugucgacgaacguuuguggacagaggcuggggcaauggcugugggcuuuucggaaaaggaagccuuauaacgugugcuaaguucaagugugugacaaaacuggaaggaaaaauaguucaauaugaaaacuugaaauauucaguaauagucaccguucacacuggagaccagcaccaggugggaaaugaaagcacagaacaugggacaacugcaacuauaacaccucaagcuccuacgacagaaauacagcugaccgacuacggagcucuuacauuggauuguucaccuagaacaggacuagacuucaaugaaaugguguuguugacaaugaaagaaaaaucauggcuaguccacaaacaaugguuucuagaccuaccacugccuuggaccucgggagcuucaacaucacaagaaacuuggaacagacaagauuugcuggugacauuuaagacagcucaugcgaagaagcaggaaguagucguacuaggaucacaagaaggagcaaugcacacugcguugaccggagcgacggaaauccaaacgucuggaacgacaacaauuuuugcaggacacuugaaauguagacuaaagauggauaaacugacucuaaaagggaugucauaugugaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagauugauaacagccaaccccauagucacugacaaagaaaaaccagucaacauugaggcagaaccgccuuuuggugagaguuacauugugauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacaugguuaggauuaaacucaaggagcacgucccuuucgaugacgugcauugcaguuggccuaguaacgcuauacuuaggagucaugguucaggcggauucaggauguguaaucaauuggaaagguagagaacucaaauguggaaguggcauuuuugucaccaaugaaguucacacuuggacagagcaauacaaauuucaagcugauuccccaaagagacuaucagcagccauugggaaggcaugggaggaggguguguguggaauucgaucagcaacucgucucgagaacaucauguggaagcaaauaucaaaugaauugaaccacaucuugcuugaaaaugacaugaaauucacagugguuguaggagauguugcugggaucuuggcucaaggaaaaaagaugauuaggccacaacccauggaacacaaauacucguggaaaagcuggggaaaggcuaaaaucauaggggcagaugugcagaacaccaccuuuaucaucgacggcccaaacaccccagaaugcccugaugaucaaagagcauggaacauuugggaaguugaggauuauggauucggaauuuucacgacaaacauauggcugaaauugcgugacuccuacacccaagugugugaccaccggcuaaugucagcugcuaucaaggacagcaaggcaguucacgcugacaugggguacuggauagaaagugaaaagaacgagaccuggaagcuggcaagagccucuuucauagaagucaaaacauguaucuggccaaaaucucacacucuauggagcaauggaguucuggaaagugaaaugauaauuccaaagaucuauggaggaccaauaucucagcacaacuauagaccaggauauuucacacaaacggcagggccguggcaccuaggcaaguuggaacuggauuuugauuugugugaggguaccacgguuguuguggaugaacauuguggaaaucgaggaccaucucuuaggaccacaacagucacaggaaagauaauucaugaaugguguugcagaucuuguacgcuaccacccuuacguuacagaggagaagauggguguugguacggaauggaaaucagaccagucaaggaaaaggaagagaaucuagucaaaucaauggucucugcagggucaggggaaguggacagcuuuucacuaggacugcuaugcauaucaauaaugaucgaagaggugaugagauccagauggaguaggaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguagggcuacuauuccgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuaugcauggaagacgauagccaugguacuaucaauuguaucucucuuccccuuaugccuguccacgaccucccaaaaaacaacauggcuuccggugcuguugggaucucuuggaugcaaaccacuaaccauguuucucauagcagaaaauaaaaucuggggaaggaaaaguuggccccucaaugaaggaaucauggcuguuggaauaguuagcauccuacuaaguucacuccucaaaaaugaugugccgcuagcugggccacuaauagcuggagguaugcuaauagcguguuauguuauaucuggaagcucggccgaucuaucacuagagaaagcggcugaggucuccugggaggaagaagcagaacacucuggcgccucacacaacauauuaguggagguccaagaugacggaaccaugaagauaaaggaugaagagagagaugacacgcuaaccauucuccuuaaagcaacucugcuagcaguuucagggguguacccacuaucaauaccagcgacccuuuuugugugguacuucuggcagaaaaagaaacagagaucuggaguguuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcuguacucauguaccaagggaaaagacuggaaccgagcugggcuagugucaaaaaagaccugaucucauauggaggagguuggaggcuucaaggauccuggaacacgggagaagaagugcaggugauugcuguugaaccagggaaaaaccccaaaaauguacaaacagcgccaggcaccuuuaagacuccugaaggcgaaguuggagccauugcccuagauuuuaaacccggcacaucuggaucucccaucgugaacagagaagggaaaauaguaggucuuuauggaaauggaguagugacaacaaguggaaccuaugucagugccauagcucaagccaaagcaucacaagaagggccucuaccagagauugaagacgagguguuuaggaaaagaaacuuaacaauaauggaccuacauccaggaucggggaaaacaagaagauaccuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccagcauagcggcuagaggguacaucucaacccgagugggcaugggugaagcagcugcgaucuucaugacagccacucccccaggaucaguggaggccuuuccacagagcaacgcaguuauccaagaugaggaaagagacauuccugagagaucauggaacucaggcuaugaguggaucacugacuucccaggcaaaacaguuugguuuguuccaagcauuaaaucaggaaaugauauugccaacugcuuaagaaagaaugggaaacgggugauucaauugaguaggaaaaccuuugacacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaucacaauaaggaaggugaucaguacaucuacaugggacagccuuuaaacaacgaugaagaucacgcucacuggacggaagcaaaaaugcuccuugauaauauaaacacaccagaaggaauuaucccagcccucuucgagccggagagagaaaagagugcagcaauagacggggaauacagacugcggggugaagcaaggaaaacguuuguggagcucaugagaagaggagaucuaccugucuggcuaucuuacaaaguugccucagaagguuuccaguacucugauagaagauggugcuuugauggggaaaggaacaaccagguguuggaggagaacauggacguggagaucuggacaaaagaaggagaaagaaagaaacuacgaccccgcuggcuggaugccagaacauacucagacccacuagcccugcgcgaguucaaagaguuugcagcaggaagaagaagugucucaggugaucuaauauuggaaauagggaaacuuccacaacacuugacgcaaagggcccagaaugccuuggacaaccugguuauguugcacaacuccgaacaaggaggaagagccuauagacaugcaauggaagaacugccagauaccauagaaacguugaugcuccuagcuuugauagcuguguuaacugguggagugacgcuguucuuccuaucaggaaagggcuuagggaaaacaucuaucggccuacucugcgugauggcuucaagcgugcugcuauggauggccaguguagagccccauuggauagcggcuuccaucauacuggaguucuuccugauggugcugcuuauuccagagccagauagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucacugacagccauugcaaaccaggcagcuauauugaugggacuugacaaaggauggccaauaucgaagauggacauaggaguuccacuucucgccuuggggugcuauucccaggugaauccacugacgcuaacagcggcgguauugaugcuaguggcucauuacgcuauaauuggaccuggacugcaagcaaaagcuacuagagaagcucaaaaaaggacagcggccggaauaaugaaaaauccaaccguugauggaaucguugcaauagauuuggacccugugguuuaugaugcgaaauuugagaaacaacuaggccaaauaauguuguugauacuaugcacaucacagauccucuugaugcggacuacaugggccuugugcgaauccaucacacuggccacuggaccucugaccacgcucugggagggaucuccaggaaaauuuuggaauaccacgauagcgguuuccauggcaaacauuuucagaggaaguuaucuagcaggagcuggucuggccuucucauuaaugaaaucucuaggaggagguaggagaggcacgggagcccaaggggaaacacugggagagaaauggaaaagacagcugaaccaacugaguaagucagaauucaacaccuauaaaaggagugggauuauggaaguggacagauccgaagccaaagagggacugaaaagaggagaaacaaccaaacaugcagugucgagaggaaccgcuaaauugaggugguuuguggagaggaaccuugugaaaccagaagggaaagucauagaccucgguuguggaagagguggcuggucauacuauugcgcugggcugaagaaaguuacagaagugaagggauacacaaaaggaggaccuggacaugaagaaccagucccaauggcgaccuauggauggaaccuaguaaagcugcacuccgggaaagacguauucuuuauaccaccugagaaaugugacacccucuugugugauauuggugaguccucuccaaacccaacuauagaggaaggaagaacgcuacgcguccuaaagaugguggaaccauggcuuagaggaaaccaauuuugcauaaaaauucugaaucccuacaugcccagugugguggaaacucuggagcaaaugcaaagaaaacauggaggaaugcuggugcgaaauccacucucaagaaauucuacucaugaaauguauuggguuucauguggaacaggaaacauugugucagcaauaaacaugacauccagaauguugcuaaaucgauucacaauggcucacaggaaaccaacauaugaaagagacguggaccuaggcgccggaacaagacauguugcaguggaaccagagguagccaaccuagauaucauuggccaaaggauagagaacauaaaaugugaacacaagucaacauggcauuaugaugaggacaauccauauaaaacaugggccuaucauggaucauaugaggucaagccaucaggaucagccucauccauggucaaugguguggugaaacugcucaccaaaccaugggaugucauccccauggucacacaaauagccaugacugacacuacacccuuuggacaacagaggguguuuaaagagaaaguugacacacgcacaccaaaagcaaaacgaggcacagcacaaaucauggaggugacagccaggugguuaugggguuuucucucuagaaacaagaagccaagaauuuguacaagagaggaguucacaagaaaaguuaggucaaacgcagccauuggagcaguguucguugacgaaaaucaauggaacucagcaaaagaagcaguggaagaugagcgguucugggaccuugugcacagagagagggagcuucacaaacagggaaaaugugccacguguguuuacaacaugauggggaagagagagaaaaagcuaggagaauuuggaaaggcaaaaggaagucgugcaauaugguacaugugguugggagcacgcuuucuagaauucgaagcucuugguuucaugaacgaagaucacugguucagcagagagaauucacucagcggaguggaaggagaaggacuccacaaacuuggauacauacuuagagacauaucaaagauuucagggggaaacauguaugcagaugacacagccggaugggauacaaggauaacagaggaugaccuucagaaugaggccaaaauuacugagaucauggaacccgaacaugcccaacuggcuaaggcaaucuucaagcuaaccuaccaaaauaaagugguaaggguacagagaccagcaaaaaauggaaccgugauggaugucauauccagacgugaccagagaggaaguggccaagucggaacuuauggcuuaaacacuuucaccaacauggaagcccagcugauaagacaaauggagucugagggaaucuuuucacccagugaauuagagaccccaaauuuagccgagagaguucucgacuggcuggaaaaauauggcgucgaaaggcuaaaaagaauggcaaucaguggagaugacugcguagugaaaccaauugaugauagguuugcaacagcccuaacugcucugaaugauaugggaaaaguaagaaaagauauaccacaaugggaacccucaaaaggauggaaugauuggcaacaagugccuuuuuguucacaccacuuccaccagcugauuaugaaggaugggagggaaauaguggugccaugccgcaaccaagaugaacuuguggguagggcuagagugucacaaggggcuggauggagccugagagaaaccgcaugccuaggcaaaucauaugcacaaauguggcagcugauguacuuccacaggagagaccugagacuagccgcuaaugcuaucuguucagccguuccaguugauugggucccaaccagccgcaccaccuggucgauccacgcccaucaccaauggaugacaacagaagacaugcugucaguguggaauaggguuuggauagaggaaaacccauggaugaaggacaaaacccauauauccaguugggaagauguuccauauuuagggaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6324 - RNA, 9879 nt, Artificial Sequence
  derived and/or modified CDS sequence (wt) from DENV-1__KC172835__SS-prME
ucugugaccaugcuccuuaugcugaugcccacagccuuggcguuccauuugacuacacgagggggagagccgcacaugauagucagcaagcaggaaagaggaaagucacucuuguuuaagaccucagcaggugucaacaugugcacccuuauagcgauggauuugggagaguugugugaggacacaaugacuuacaaaugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggaugucuucugaaggcgcuuggaaacagauacaaagaguggaaacuugggcccugagacacccaggauucacggugauagcucuuuuucuagcacaugccauaggaacauccaucacccagaaagggaucauuuucauuuuguuaaugcugguaacaccauccauggccaugcgaugugugggaauaggcagcagggacuucguggaaggacugucaggagcaacuuggguagaugugguacuggaacauggaaguugcguaaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacugguggaagaacaagacgcgaacuuugugugucgacgaacguuuguggacagaggcugggguaauggcugugggcucuucggaaaaggaagccuaauaacgugugcuaaguucaagugugugacaaaacuggaaggaaagauaguucaauaugaaaaccugaaauauucaguaauagucaccguccacacuggagaccagcaccaggugggaaaugaaagcacagaacacgggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagaaacuuggaacagacaagauuuguuggugacauuuaagacagcucaugcaaagaagcaggaaguagucguucuaggaucacaagaaggagcaaugcauacugcguugaccggagcgacagaaauccaaacaucuggaacgacaacaauuuuugcaggacacuugaaauguagacuaaagauggacaaacugacucuaaaagggaugucauaugugaugugcacaggcucauucaagcuagagaaagaaguggcugagacccagcauggaacuguucuagugcagauuaaauacgaaggaacagaugcaccaugcaagaucccuuuuuccacccaagaugaaaaaggaguaacccagaaugggagauugauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauauugggagacaccgcaugggauuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaauucaaggagcacgucccuuucgaugacguguauugcaguuggccuaguaacacuauaccuaggagucaugguucaggcggauucaggauguguaguuaauuggaaggguagagaacucaaauguggaaguggcaucuuugucaccaaugaaguucacacuuggacagagcaauacaaauuucaagcugacuccccaaagagauuaucagcagccauugggaaggcaugggaggaggguguguguggaauucgaucagcaacucgucucgagaacgucauguggaagcaaauaucaaaugaacugaaucacaucuuacuugaaaaugacaugaaauucacagugguuguaggagauguugcugggaucuuggcucaaggaaaaaaaaugauuaggccacaacccauggaauacaaauacucguggaaaagcuggggaaaggcuaaaaucauaggggcagauguacagaacaccaccuucaucaucgacgguccaaacaccccagaaugcccugaugaccaaagagcauggaacauuugggaaguugaggacuauggauuuggaauuuucacgacaaacauauggcugagauugcgugacuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuucacacaaacggcagggccauggcaccuaggcaaguuggaacuggauuuugauuugugugaggguaccacaguuguuguggaugaacauugcggaaaccgaggaccaucucuuaggaccacaacagucacaggaaagacaauucaugaaugguguugcagaucuuguacgcuaccacccuuacguuuuagaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaauaggacaauugacauggaaugaucugaucagauuauccaucaugguuggagccaacgcuuccgacaagauggggaugggaacgacguaccuagcucugauggccacuuuuaaaaugagaccaauguuugcuguagggcuauuauuccgcagacuaacauccagagagguucuucuucuaacaauuggauugagucuaguggcaucuguggaguuaccaaauuccuuggaggagcugggggauggacuugcaaugggcauuaugauuuuaaaauuauugacugacuuucaaccacaucagcugugggcuaccuugcuguccuugacauucaucaagacaacguuuuccuugcacuaugcauggaagacaauggcuaugguacugucaauuguaucucucuuccccuuaugccuguccacgaccucccaaaaaacaacauggcuuccggugcuauugggaucucuuggaugcaaaccacuaaccauguuucuuauaacagaaaacaaaaucuggggaaggaaaaguuggccccucaaugaaggaaucauggcuguuggaauagucagcauccuacuaagcucacuccucaaaaaugaugugccgcuagcugggccacuaauagcuggaggcaugcuaauagcauguuauguuauaucuggaagcucagccgaucuaucgcuagagaaagcggcugaggucuccugggaagaagaagcagaacacucuggugccucacauaacauauuaguggagguccaagaugauggaaccaugaagauaaaggaugaagagagagaugacacgcuaaccauucuccuuaaagcaacucuguuagcaguuucagggguguacccauuaucaauaccugcgacccuuuuugugugguacuuuuggcagaaaaagaaacagagaucuggaguguuaugggacacacccagcccuccagaaguggaaagagcagcucuugaugaugguaucuauagaaucaugcagagaggacuguugggcaggucccagguagggguaggaguuuuccaagaaaacguguuccacacaauguggcaugucaccaggggagcuguacucauguaucaagggaagagacuggaaccgagcugggccagugucaaaaaggaccugaucucauauggaggagguuggaggcuucaaggauccuggaacacgggagaagaagugcaggugauugcuguugaaccagggaaaaaccccaaaaauguacaaacagcgccgggcaccuuuaagaccccugaaggugaaguuggagccauugcccuagauuuuaaacccggcacaucuggaucucccaucgugaacagagaaggaaaaauaguaggucuuuauggaaaugggguagugacaacaaguggaaccuacgucagcgccauagcucaagcuaaagcaucacaagaagggccccuaccagagauugaagacgaaguguuuaggaaaagaaacuuaacaauaauggaccuacauccaggaucggggaaaacaagaagauaucuuccagccauaguccgugaggccauaaaaaggaagcugcgcacacuaauuuuggcucccacaaggguugucgcuuccgaaauggcagaggcgcucaagggaaugccaauaagguaccaaacaacagcagugaagagugagcacacaggaaaagagauaguugaccucaugugucacgccacuuucaccaugcgccuccugucucccgugagaguucccaauuacaacaugauuaucauggaugaagcacauuucaccgauccauccagcauagcggccagaggguacauuucaacccgagugggcaugggugaagcagcugcgaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacuguuuaagaaagaaugggaaacgggugauucaauugagcaggaaaaccuuugacacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcucagaggagaggaagaauuggaaggaaccacaauaaggaaggugaucaguacaucuacaugggacagccuuuaaacaacgaugaagaucacgcucacuggacggaagcaaaaaugcuccuugauaauauaaacacaccagaagggauuaucccagcccucuucgagccggagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaauaaccagguguuggaggagaacauggauguggagaucuggacaaaagaaggagaaagaaagaaacuacgaccccgcuggcuggaugccagaacauacucagacccacuggcccugcgcgaguuuaaagaguuugcagcaggaagaagaagcguuucaggugauuuaauauuagaaauagggaaacuuccacaacacuugacgcaaagggcccagaaugccuuggacaaccugguuauguugcacaacuccgaacaaggaggaagagcauauagacaugcaauggaagaacuaccagacaccauagaaacguugaugcuccuagcuuugauagcuguguugacugguggagugacgcuguucuuccuaucaggaaggggccuagggaaaacaucuaucggccuacucugcgugauggcuucaagcgugcugcuauggauggccaguguggagccccauuggauagcggccuccaucauacuggaguucuuccugauggugcugcuuaucccagagccagacagacaacgcacuccgcaggacaaccagcuggcauauguggugauagguuuguuauuuaugauacugacaguagcagccaaugagaugggacugcuagaaaccacaaagaaagacuuagggauuggccauguggcugaugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaucaagcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcagccggaauaaugaagaauccaaccguugauggaauuguugcaauagauuuggacccugugguuuaugaugcaaaauuugagaaacaacuaggccaaauaauguuguugauacuaugcacaucacagauccucuugaugcggaccacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacaccuauaaaaggagugggauuauggaaguggacagauccgaagccaaagagggacugaaaagaggagaaacaaccaaacaugcagugucgagaggaaccgcuaaacugaggugguuuguggagaggaaccuugugaaaccagaaggaaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacuccgggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaagauucugaaucccuacaugccaagugugguggaaacucuggagcaaaugcaaagaaaacauggaggaaugcuagugcgaaacccacuuucaagaaacucuacccaugaaauguauuggguuucauguggaacaggaaacauugugucagcaguaaacaugacauccagaauguugcuaaaucgauucacgaugguucacaggaaaccaacauaugaaagagacguggaucuaggcgcuggaacaagacauguggcaguggaaccagagguggccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucauccccauggucacacaaauagccaugacugacacuacacccuuuggacaacagaggguguuuaaagagaaaguugacacacgcacaccaaaagcaaaacgaggcacagcacaaaucauggaggugacagccaggugguuaugggguuuucuuucuagaaacaagaaaccaagaauuuguacaagagaggaguucacaagaaaaguuaggucaaacgcagccauuggagcaguguucauugaugaaaaucaauggaacucagcaaaagaagcaguggaagaugagcgguucugggaccuugugcacagagagagggagcuucacaaacagggaaaaugugccacguguguuuacaacaugauggggaagagagagaaaaagcuaggagaguucggaaaggcaaaaggaagucgugcaauaugguacaugugguugggagcacgcuuucuagaguuugaagcucuugguuucaugaacgaagaccacugguucaguagagagaauucacuuagcggaguggaaggagaaggacuccacaaacuuggauauauacucagagacauaucaaagaucccagggggaaacauguaugcagaugacacagccggaugggauacaaggauaacagaggaugaucuucagaaugaggccaaaauuacugacaucauggaauccgaacaugcccuacuggcuaagucaaucuucaagcuaaccuaccaaaauaaagugguaaggguacagagaccagcaaaaaauggaacugugauggaugucauauccagacgugaccagagaggaaguggccaggucggaacuuauggcuuaaacacuuucaccaacauggaagcccagcugauaagacaaauggagucugagggaaucuuuucacccagcgaauuagagaccccaaauuuagccgagagagcucucgacuggcuggaaaaacauggcgucgaaaggcugaaaagaauggcaaucagcggagaugacugcguagugaaaccaauugaugauagguuugcaacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacagggugccggauggagccugagagaaacugcaugccuaggcaagucauaugcacaaauguggcagcugauguacuuccacaggagagaccugagacuagccgcuaaugcuaucuguucagccguuccaguugauugggucccaaccagccgcaccaccuggucgauccaugcccaccaccaauggaugacaacagaagacaugcugucaguguggaauaggguuuggauagaggaaaacccauggauggaggacaaaacccauauauccaguugggaagacguuccauacuuagggaaaagggaagaucaaugguguggaucccugauaggcuuaacagcaagggccacuugggccaccaacauacaaguggccauaagccaagugagaagacuaauugggaaugagaauuaucuagauuacaugacaucaaugaagagauucaagaacgagagugaucccgaaggggcacucugguga

SEQ ID NO: 6325 - RNA, 9879 nt, Artificial Sequence
  derived and/or modified CDS sequence (wt) from DENV-1__EU848545__SS-prME
ucugugaccaugcuccuuaugcugcugcccacagcccuggcguuccaucugaccacacgagggggagagccgcacaugauaguuagcaagcaggaaagaggaaagucacuuuuguuuaagaccucugcaggugucaacaugugcaccauuauugcgauggauuugggagaguuaugugaggacacaaugaccuacaaaugcccccggaucacuaaggcggaaccagaugacguugacuguuggugcaaugccacggacacaugggugaccuauggaacguguucucgaacuggcgaacaccgacgagacaagcguuccgucgcacuggccccacauguggggcuuggucuagaaacaagagccgaaacguggauguccucugaaggcgcuuggaaacaaauacaaaaaguggagacuugggcucugagacacccaggauucacgguaauagcccucuuucuagcacaugccauaggaacauccaucacccagaaagggauuauuuucauuuuguugaugcugguaacaccauccauggccaugcgaugcgugggaauaggcaacagagacuucguggaaggacugucaggagcaacguggguggaugugguacuggagcauggaaguugcgucaccaccauggcaaaagauaaaccaacauuggacauugaacucuugaagacggaggucacaaagccugccguccugcguaaacugugcauugaagcuaaaauaucaaacaccaccaccgauucaagauguccaacacaaggggaagccacacugguggaagaacaagacgcgaacuucgugugucgacgaacguuuguggacagaggcuggggcaauggcugugggcuuuucggaaaagguagccuaauaacgugugcuaaguucaagugugugacaaaacuggaaggaaagauuguucaauaugagaacuugaaauauucagugauagucaccguccacacuggugaccagcaccaggugggaaaugagaccacagaacauggaacaauugcaaccauaacaccucaagcuccuacgucggaaauacagcugaccgacuacggagcucuuacauuggauugcucacccagaacagggcuagacuuuaaugagaugguguuguugacaaugaaagaaaaaucauggcuuguccacaaacaaugguuucuagacuuaccacugcccuggaccucgggagcuucaacaccccaagagacuuggaacagagaagauuugcugguuacauuuaagacagcucaugcaaagaagcaggaaguagucguacuaggaucacaagaaggagcaaugcacacugcguugaccggagcgacagaaauccaaacgucuggaacgacaaaaauuuuugcaggacacuugaaauguagacuaaaaaugaacaaacugaccuuaaaagggaugucauaugugaugugcacagguucauucaaguuagagaaagaaguggcugagacccagcauggaacuguucuagugcagguuaaauacgaaggaacagaugcaccaugcaagauccccuuuucgacccaagaugagaaaggaguaacccagaaugggagauugauaacagccaaccccauagucacugacaaagaaaaaccagucaacauugaggcagaaccaccuuuuggugagaguuacaucgugguaggagcaggugaaaaagcuuugaaauuaagcugguucaagaaaggaagcagcauagggaaaaugcuugaagcaacugcccgaggagcacgaaggauggccauccuaggagacaccgcaugggacuucgguucuauaggaggaguguucacgucugugggaaaacugguacaccagaucuuuggaacugcauauggaguuuuguucagcgguguuuccuggacuaugaaaauaggaauagggauucugcugacauggcuaggauuaaauucaaggagcgcgucccuuucgaugacgugcauugcaguuggcaugguuacacuguaccuaggagucaugguucaggcggacucgggauguguaauuaacuggaaaggcagagaacucaaauguggaaguggcauuuuugucaccaaugaaguucacacuuggacagaacaauacaaauuccaggccgacuccccaaagagacuaucagcagccauugggaaggcaugggaagaggguguguguggaauucgaucagccacucgucucgagaacaucauguggaagcagauaucaaaugaacuaaaccacaucuuacuugaaaaugacaugaaauucacaguggucguaggagauguuagugggaucuugacccaaggaagaaaaaugauugggccacaacccauggaacacaaauacucguggaaaagcuggggaaaagccaaaaucauaggagcagauguacagaacaccaccuucauuaucgacggcccaaacaccccagaaugcccugaugaccaaagagcauggaacauuugggaaguugaggacuauggauuuggaauuuucacgacaaauauaugguugaaauugcgugacuccuacacccaagugugugacccccggcuaaugucagcugccaucaaggacagcaaggcaguucaugccgauaugggauacuggauagaaagugaaaagaacgagaccuggaagcuggcgagagccuccuucauagaaguuaagacaugcgucuggccaaaaucccacacucuauggagcaauggaguuuuggaaagugaaaugauaaucccaaagauauauggaggaccaauaucucagcacaacuacagaccaggauauuccacacaaacagcagggccguggcaccuaggcaaguuggaacuagauuuugauuugugugaggguaccacaguuguuguggaugaacauuguggaaaucgaggaccaucucuuagaaccacaacaguaacaggaaagauaauccaugaauggugcuguagaucuuguacgcuaccccccuuacguuucaaaggagaagacggguguugguacggcauggaaaucagaccagucaaggacaaggaagagaaccuaguuaagucauuggucucugcagggucaggagaaguggauagcuuuucacuaggacugcuaugcauaucaauaaugaucgaagaggugaugagauccagauggaguagaaaaaugcugaugacuggaacacuggcuguguuccuccuucucauaaugggacaauugacauggaaugaucugaucagguuaugcaucaugguuggagccaaugcuucagacaggauggggaugggaacaacguaccuagcucugauggccacuuuuaaaaugagaccaauguucgcugucggguuauuauuucgcagacuaacaucuagagaaguucuucuucuuacgauuggauugagucugguggcaucuguggagcuaccaaauuccuuggaggagcugggggauggacuugcaaugggcaucaugauuuuaaaauuacugaccgacuuucagucacaucagcugugggcugcccugcuguccuugacauuuaucaaaacaacuuuuucauugcacuaugcauggaagacaguggcuaugguacugucaauuguaucucucuucccuuuaugccuguccacgaccucucaaaaaacaacauggcuuccggugcuguugggaucucuuggaugcaaaccacuaaccauguuucuuauagcagaaaacaaaaucuggggaaggaaaaguuggccccucaaugaaggaaucauggcuguuggaauaguuagcauccuacuaaguucacuccucaagaaugacgugccgcuagccggcccacuaauagcuggagguaugcuaauagcauguuauguuauauccggaagcucagccgauuuaucacuggagaaagcggcugagaucuccugggaagaagaagcagaacacucuggugccucacacaacauacuaguggaaguccaagaugauggaaccaugaagauaaaagaugaagagagagaugacacacucaccauucuccucaaagcaacucuguuggcagucucagggguguacccaauaucaauaccagcgacccuuuuugugugguauuuuuggcagaaaaagaaacagagaucaggagugcuaugggacacaccuagcccuccagaaguggaaagagcaguucuugaugaugguaucuauagaauucugcaaagaggacuguugggcaggucccagguaggaguaggaguuuuccaagaaggcguguuccacacaauguggcaugucaccaggggagcuguccucauguaucaagggaagagacuggaaccgaguugggccagugucaaaaaagacuugaucucauauggaggagguuggagguuucaaggauccuggaacacgggagaagaagugcaggugauugcuguugaaccggggaaaaaccccaaaaacguacagacagcgccgggcaccuucaagaccccugaaggcgaaguuggagccauagcccuagauuuuaaacccggcacaucuggaucucccauugugaacagagagggaaaaauaguaggucuuuauggaaauggaguggugacaacaaguggaaccuacgucagugccauagcucaagcuaaagcaucacaagaagggccccuaccagagauugaggacgagguguuuaggaaaagaaacuuaacaauaauggaccuacauccaggaucggggaaaacaagaagauaucuuccagccauaguccgugaggcuauaaaaaggaagcugcguacgcuaaucuuggcucccacaagaguugucgcuucugaaauggcagaggcgcucaagggaaugccaauaagguaucagacaacagcagugaagagugaacacacaggaagggagauaguugaccuuaugugccaugccacuuucaccaugcgucuccugucucccgugagaguucccaauuacaacaugaucaucauggaugaagcacauuucaccgauccagccagcauagcggccagaggguacaucucaacccgggugggcaugggugaagcagcugcgaucuucaugacagccacucccccaggaucgguggaggccuuuccacagagcaaugcaguuauccaagaugaggaaagagacauuccugagagaucauggaacucaggcuaugacuggaucacugauuucccagguaaaacagucugguuuguuccaagcauuaaaucaggaaaugacauugccaacuguuuaagaaagaaugggaaacgggugauccaauugagcagaaaaaccuuugauacugaguaccagaaaacaaaaaauaaugacugggacuaugucgucacaacagacauuuccgaaaugggagcaaacuuccgagccgacaggguaauagacccaagacgguguuugaaaccgguaauacuaaaagaugguccagagcgugucauucuagccggaccgaugccagugacuguggccagugccgcccagaggagaggaagaauuggaaggaaccaaaauaaggaaggugaucaguacauuuacaugggacagccuuuaaacaacgaugaggaucacgcucauuggacagaagcaaaaaugcuccuugacaacauaaacacaccagaagggauuaucccagcccucuuugagccggagagaggaaaaagugcagcaauagacggggaauacagacugcggggugaagcaaggaaaacguucguggagcucaugagaagaggagaucuaccugucuggcuauccuacaaaguugccucagaaggcuuccaguacucugacagaaaguggugcuuugauggggaaaggaacaaccaggugcuggaggagaacauggacguggagaucuggacaaaagaaggagaaagaaagaaacuacgaccccgcuggcuggacgccagaacauacucugacccacaggcucugcgcgaguuuaaagaguuugcagcaggaagaagaagcgucucaggugaucuaauauuagaaauagggaaacuuccacaacauuugacgcaaagggcccagaaugcucuggacaaccuggucauguugcacaacuccgaacaaggaggaaaagccuauagacaugcuauggaagaacuaccagacaccauagaaacguugaugcuccuagcuuugauagcuguguuaacugguggagugacgcuguucuuccuaucaggaagaggccuagggaaaacaucuaucggccuacucugcgugauggcuucaagcguacuguuauggguggccaguguggagccccauuggauagcggccuccaucauacuggaguucuuucugauggugcugcuuauuccagagccagacagacaacgcacuccacaggacaaccagcuggcauauguggugauagguuuguuauucaugauauugacaguagcagccaaugagaugggauuauuggaaaccacaaagaaagaccuagggauuggccauguggcuguugaaaaccaccaccaugccacaaugcuggacguagacuuacguccagcuucagccuggacccucuaugcaguggccacaacaaucaucacucccaugaugagacacacaauugaaaacacaacggcaaauauuucccugacagcuauugcaaaccaggcagcuauauugaugggacuugacaagggauggccaauaucgaagauggacauaggaguuccacuccucgccuuggggugcuauucccaggugaacccgcugacgcugauagcggcgguauugaugcuaguggcucauuacgccauaauuggaccuggacugcaagcaaaagccacuagagaagcucaaaaaagaacagcggccggaauaaugaaaaauccaacugucgacggaauuguugcaauagauuuggacccugugguuuaugaugcaaaauuugaaaaacagcuaggccaaauaauguuguugauacuuugcacaucacagauucucuugaugcggacuacaugggccuugugugaauccaucacacuggcuacuggaccucugaccacgcuuugggagggaucuccaggaaaauucuggaacaccacgaucgcgguguccauggcaaacauuuucaggggaaguuaucuagcaggagcaggucuggccuucucauuaaugaaaucucuaggaggagguaggagagguacgggagcccaaggggaaacacugggagaaaaauggaaaagacagcuaaaccaacugagcaagucagaauucaacacuuacaaaaggagugggauuauggagguggauagaucugaagcuaaagagggauugaaaagaggagaaacaaccaaacaugcagugucgagaggaacagccaaacugaggugguuuguggagaggaaccuugugaagccggaagggaaagucauagaccucgguuguggaagagguggcuggucauauuauugugcugggcugaagaaagucacagaagugaaaggauauacaaaaggaggaccuggacaugaggaaccaaucccaauggcgaccuauggauggaaccuaguaaagcuacacuccgggaaagauguauucuuuacaccaccugagaaaugugacacccuuuugugugauauuggugaguccucuccgaacccaacuauagaagaaggaagaacguuacguguucuaaagaugguggaaccauggcucagaggaaaccaauuuugcauaaaaauucugaaucccuauaugccgagugugguggaaacucuggagcaaaugcaaagaaaacauggaggaaugcuagugcgaaauccacucucaagaaauuccacucaugaaauguacuggguuucauguggaacaggaaacauugugucagcaguaaacaugacaucuagaauguugcuaaaucgguucacaauggcucacaggaagccaacauaugaaagagacguggacuuaggugcuggaacaagacauguggcaguggaaccagagguagccaaccuagauaucauuggccagaggauagagaauauaaaaaaugagcauaagucaacauggcauuaugaugaggacaauccauacaaaacaugggccuaucauggaucauaugagguuaagccaucaggaucagccucauccauggucaauggcguggugagauugcucaccaaaccaugggauguuaucccuauggucacacaaauagccaugacugacacuacacccuuuggacaacagaggguguuuaaagagaaaguugacacgcgcacaccaaaagcaaaacgaggcacagcacaaaucauggaggugacagccaggugguuaugggguuuucuuucuagaaacaaaaaaccaagaaucugcacaagagaggaguucacaagaaaagucaggucaaacgcagccauuggagcaguguucguugaugaaaaucaauggaacucagcaaaagaagcgguggaagaugaacgguucugggaccuugugcacagagagagggagcuccauaaacagggaaaaugugccacguguguuuacaauaugauggggaagagagagaaaaaauuaggagaguucggaaaggcaaaaggaagucgugcaauaugguacaugugguugggagcacgcuuucuagaguucgaagcccuugguuucaugaacgaagaucacugguucaguagagagaauucacucaguggaguggaaggagaaggacuccacaaacuuggauauauacucagagacauaucaaagauuccagggggaaauauguaugcagaugacacagccggaugggacacaagaauaacagaggaugaucuucagaaugaggccaaaaucacugacaucauggagcccgaacaugcccuauuggcuacgucaaucuuuaagcugaccuaccaaaacaaggugguaagggugcagagaccagcaaaaaauggaaccgugauggaugucauauccagacgugaccagagaggaaguggacaggucggaacuuauggcuuaaacacuuucacuaacauggagguccaacuaauaagacaaauggagucugagggaaucuuuucacccagcgaauuggagaccccaaauuuagccgaaagaguucucgacugguuggaaaaacauggcgucgaaaggcugaaaagaauggcaaucagcggagaugacuguguggugaaaccaacugaugacagguucgcaacagccuuaacagcuuugaaugacaugggaaaaguaagaaaagacauaccgcaaugggaaccuucaaaaggauggaaugauuggcaacaagugccuuuuuguucacaccauuuccaccagcugaucaugaaggaugggagggagauaguggugccaugccgcaaccaagaugaacuuguggguagggcuagaguaucacaaggcgccggauggagccugagagaaacugcaugccuaggcaagucauaugcacagauguggcagcugauguacuuccacaggagagaccugagacuagcggccaaugccaucuguucagccguuccaauugauugggucccaaccagccgcaccaccuggucgauccaugcccaucaucaauggaugacaacagaagacauguugucaguguggaauaggguuuggauagaggaaaacccauggauggaggauaaaacccauguauccaguugggaagauguuccauacuuaggaaaaagggaagaucagugguguggaucccugauaggcuuaacagcaagggccaccugggccacuaauauacaaguggccauaaaccaagugagaaggcucauugggaaugagaauuaucuagauuacaugacaucaaugaagagauucaagaaugagagugaucucgaaggggcacucugguaa

SEQ ID NO: 6326 - RNA, 9879 nt, Artificial Sequence
  derived and/or modified CDS sequence (wt) from DENV-1__KR024708__SS-prME
uccgugaccaugcuccucaugcugcugcccacagcccuggcguuccauuugaccacacgagggggagagccacacaugauaguuagcaagcaggaaagaggaaagucacucuuguuuaagaccucugcaggugucaacaugugcacccucauugcaauggauuugggagaguuaugugaggauacaaugaccuacaaaugcccccggaucacugaagcggaaccagaugauguugauugcuggugcaaugccacagacacaugggugaccuaugggacguguucucagacuggcgaacaccgacgggauaaacguucugucgcauuggccccacacguggggcuuggucucgaaacaagaacugaaacguggauguccucagaaggagccuggaagcagauacaaaaaguggagacuugggccuugagacacccaggauucacggugauagcccuuuuuuuagcacaugccauaggaacauccauuacccagaaagggaucaucuucauuuugcugaugcuggugacaccaucaauggccaugcgaugcgugggaauaggcaacagagacuucguugaaggacugucaggagcaacauggguggauguggugcuggagcauggaagcugugucaccaccauggcaaagaauaaaccaacauuggacauugaacucuugaagacggaggucacgaacccugccgucuugcgcaaacugugcauugaagcuaaaauaucaaacaccaccaccgauucaagauguccaacacaaggagaagcuacacugguggaagaacaagacgcgaacuuugugugucgacgaacauucguggacagaggcugggguaaugguuguggacuauucgggaagggaagcuuacuaacgugugcuaaguuuaagugugugacaaaacuugaaggaaagauaguucaauaugaaaacuuaaaauauucggugauagucacuguccacacuggggaucagcaccagguaggaaaugagacuacagaacauggaacaauugcaaccauaacaccucaagcucccacgucggaaauacagcugacugacuacggagcccuuacauuggacugcucaccuagaacagggcuggacuuuaaugagauggugcuguugacaaugaaagaaaaaucauggcuuguccacaaacaaugguuucuagacuuaccauugccuuggaccucgggggcuucaacaucucaagagacuuggaacagacaagaucugcuggucacauuuaagacagcucaugcaaagaagcaggaaguagucguacuggggucacaagaaggagcaaugcacacugcguugacuggggcgacagaaauccagacgucaggaacgacgacaaucuucgcaggacaccugaaauguagacuaaaaauggauaaacugacuuuaaaaggggugucauaugugaugugcacaggcucauuuaagcuagagaaggaaguggcugagacccagcauggaacuguccuagugcagguuaaauaugaaggaacagaugcaccaugcaagauuccaauuucaacccaagaugagaaaggagugacccagaaugggagauugauaacagccaaucccauaguuacugacaaagaaaaaccagucaacauugaaacagaaccacccuuuggugagagcuacaucgugauaggggcgggugaaaaagcuuugaaacuaagcugguucaagaaaggaagcagcauagggaaaauguucgaagccaccgcccgaggagcgcgaaggauggcuauccugggagacacagcaugggacuucgguuccauaggagggguguucacaucugugggaaaauugguacaccagguuuuuggaaccgcauaugggguccuguucagcgguguuucuuggaccaugaaaauaggaauagggauucugcugacauggcuaggauugaauucaaggagcacgucacucucgaugacgugcauugcaguuggcauggucacacuguaccuaggagucaugguucaagcggacucggggugugugaucaacuggaagggcagagaacucaaguguggaaguggcaucuuugucacuaaugaaguccacacuuggacagagcaauacaaauuucaggcugacuccccaaaaagacuaucagcagccauugggaaggcaugggaggaaggcguguguggaauucgaucagccacacgucuugagaacaucauguggaagcaaauaucaaaugaauugaaccacauucuacuugaaaaugacaugaaauucacagugguuguaggagacgccaauggaaucuugacccaaggaaaaaagaugauuaggccacaacccauggaacacaaauacucauggaaaagcuggggaaaagccaaaauuauaggagcagauacacagaauacuaccuucaucaucgauggcccagacacuccagaaugccccgaugaccagagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaacgagaccuggaagcuagcgagagccuccuucauagaagugaagacaugcaucuggccaagaucccacacucuauggagcaauggagucuuggaaagugaaaugauaaucccaaagauauauggaggaccaauaucucagcacaacuacagaccaggguauuucacacaaacagcagggccauggcaccuaggcaaguuggaacuagacuuuaauuugugugaaggcaccacaguuguuguggaugaacauuguggaaaucgagguccaucucuuagaacuacaacagucacaggaaagauaauccaugaauggugcugcagauccugcacgcuaccccccuuacgcuucagaggagaagacggauguugguauggcauggaaaucagaccaguuaaggagaaggaagagaaucuagucaggucaauggucucugcagggucaggagaaguggacaguuuuucauugggacuacuaugcguaucaauaaugauugaagaagugaugagauccagauggaguagaaagaugcugaugacuggaacacuggcuguuuucuuccuucuuauaaugggacaacugacauggaaugaucugaucagguuaugcaucaugguuggagccaaugucucagacagaauggggaugggaacaacguaccuagcuuuaauggccacuuuuaaaaugagaccgauguucgcuguugggcuauuauuucgcagacuaacauccagagaggugcuccuucuuacaauuggacuaagccugguggcauccguggagcuaccaaauucuuuagaggagcuaggggacggacuugcgaugggcaucaugauguuaaaauuguugacugacuuucagucacaccaguuguggacuaccuuacugucucugacauucaucaaaacaacucuuucacuggauuaugcauggaagacaauggcuaugguauugucaaucguaucucucuuuccucuaugucuauccacgaccucucaaaaaacaacauggcuuccgguguuguuaggauccuuuggauguaaaccacuaaccauguuucuuauaacagaaaacaaaauuuggggaaggaaaaguuggccccucaaugaaggaauuauggcuguuggaauagucagcauuuuacuaaguucacuccucaaaaaugacgugccacuagccggcccacuaauagcuggaggcaugcugauagcauguuacgucauuuccggaagcucagccgauuuaucauuggagagagcggcugaggucuccugggaagaagaagcagaacacucuggugccucacacaacauacuaguggagguccaagaugauggaacuaugaaaauaaaagaugaagagagagaugacacgcucacuauacuccucaaagcaacuuuguuggcaguuucagggguguacccaaugucaauaccagcaacccuuuuugugugguauuuuuggcagaaaaagaaacagagaucaggagucuugugggacacacccagcccuccagaaguagaaagagcaguucuugaugaugguaucuauagaaucuugcaaagaggacuguuggguaggucccagguaggagugggaguuuuucaagacggcguguuccacacaauguggcaugucaccaggggggcuguccucauguaccaagggaagaggcuggaaccaaguugggccagugucaaaaaagacuugaucucauauggaggagguuggagguuucaaggaucauggaacacgggagaagaaguacaggugauagcuguugaaccagggaaaaacccaaagaauguacagacaacgccgggcacuuucaagaccccugaaggcgaaguuggagccauagcccuagauuucaaaccuggcacaucuggaucucccaucgugaacagagaggggaaaauaguaggucuuuauggaaauggaguggugacaacaaguggaaccuacgucagugccauugcccaagcuaaagcgucacaagaagggccucuaccagagauugaggacgagguguuuaagaaaagaaaccuaacaauaauggaccuacauccaggaucaggaaaaacaagaagauaucuuccagccauaguccgugaggccauaaaaaggaaacugcgcacgcuaaucuuggcucccacaagaguugucgccucugaaauggcagaggcgcuuaaaggaaugccaauaagauaucagacaacagcaguaaagagugaacacacaggaaaggagauagucgaucucaugugccacgccacuuucaccaugcgucuccuaucuccagugagaguucccaauuacaacaugauuaucauggaugaagcacacuuuaccgauccagccagcauagcggccagaggguacaucucaacccgaguggguaugggugaagcagcugcgaucuuuaugacagccacucccccaggaucgguagaguccuuuccacagagcaaugcaguuauccaagaugaggaaagagacauuccugagagaucauggaacucaggcuacgacuggaucacugacuucccaggaaaaacagucugguuuguuccaagcaucaaaucaggaaaugacauugccaacugcuuaagaaaaaacgggaaacgggugauccaauugagcagaaaaaccuuugacacugaauaccagaaaacgaaaaacaaugauugggacuauguugucacaacagacauuuccgaaaugggagcaaauuuccgggccgauaggguaauagacccaaggcggugcuugaagccgguaauacuaaaagauggcccagagcgcgucauucuggccggaccaaugccagugaccgcggccagugcugcccagaggagaggaagaauuggaaggaaccaaaacaaggaaggugaccaguauauuuacaugggacagccuuuaaauaaugaugaggaccacgcucauuggacagaagcaaaaaugcuccuugacaauauaaauacgccagaagggauuaucccagcccucuuugagccagagagagaaaagagugcagcaauagacggggaguauagacugcggggagaagcaaggaaaacguucguggagcuaaugagaagaggggaucuaccaguuuggcuaucuuacaaaguugccucagaaggcuuccaguacuccgacagaagauggugcuuugacggggaaaggaacaaccagguguuggaggagaacauggacguggagaucuggacaaaagaaggagaaagaaagaaauugcgaccucgcugguuagaugccagaaccuacucugauccacuggcccugcgcgaguuuaaagaguucgcagcaggaagaagaagugucucaggugaccuaauauuagaaauagggaaacucccacagcauuugacgcuaagggcccagaaugcuuuggacaacuuggucauguugcacaauuccgaacaagggggaaaagccuauagacaugcuauggaagaacuuccagacaccauagaaacauugaugcuacuagccuugauagcugugcugacugguggaguuacguuguuuuuccuaucaggaaaaggucuagggaaaacauccauuggccuacuuuguguaauggccucaaguguacuguuauggauggccaguguggagccccauuggauagcggccuccaucauacuagaguuuuuucugauggugcugcuuauuccagagccagacagacagcguacuccacaggacaaucaacuagcauauguggugauagguuuguuauucaugauauugacaguggcagccaaugagaugggauuacuggaaaccacaaagaaagaccuggggauuggccauguagucgccgaaaaccaccaccaugccacaaugcuagacauagacuuacauccagcuucagccuggacccucuaugcaguagccacaacaauuaucacucccaugaugagacacacaauugaaaacacaacggcaaacauuucccugacagcuauugcaaaucaggcggcuauauuaaugggacuugacaagggauggccaauaucgaagauggacauaggagugccacuucucgccuuagggugcuauucccaggugaacccauugacacugacagcggcgguguuaauguuaguggcucauuaugccauuaucggaccuggacugcaagcaaaagcuaccagagaagcccaaaaaaggacugcggccggaauaaugaaaaauccaacuguagacgggauuguugcaauagauuuggauccugugguuuaugaugcaaaauuugaaaaacagcuaggccaaauaauguuacuaauacucugcacaucacagauucucuugaugcggacuacaugggccuuaugugaaucuaucacacuggcuacuggacccuugaccacucucugggagggaucuccuggaaaauucuggaauaccacgauagcaguguccauggcaaacaucuucaggggaaguuauuuagcaggggcaggucuggccuucucauuaaugaaaucuuuaggaggagguaggagaggcacgggagcucaaggggaaacauugggagaaaaauggaaaagacaacuaaaccaacugagcaagucagaauuuaacacuuacaaaaggaguggaauuauggagguggacagguccgaagccaaggagggacugaaaagaggagaaacaaccaaacaugcagugucgagaggaacagccaaacuuaggugguuuguggagaggaaccuugugaaaccggaagggaaagugauagaccucgguuguggaagagguggcuggucauauuacugcgcugggcugaagaaggucacagaaguaaagggauacacaaaaggaggacccggucaugaggaaccuaucccaauggcgacuuauggauggaacauagugaagcuacacucuggaagggauguauucuuuacaccaccugagaaaugugacacccuuuugugugauauuggugaguccucuccgaauccaacuauagaagaaggaagaacguuacguguucuaaagaugguggaaccauggcucagaggaaaucaguuuugcauaaaaauccuaaauccuuauaugccaagugugguagaaacucuggagcaaaugcaaagaaaacauggagggaugcuagugcgaaacccacucucaagaaauuccacccaugaaauguacugggucucauguggaacaggaaacauugugucggcagugaacaugacauccagaaugcugcugaaucgguucacaauggcucacaggaagccaacguaugaaagagacguggacuugggcgcuggaacaagacauguggcaguggaaccagagauagccaaccuagacauuauuggccagaggauagagaacauaaaaaaugaacauaagucaacauggcauuaugaugaggacaauccauacaaaacaugggccuaucauggaucauaugaggucaagccaucagggucagccucauccauggugaauggcguggugagauugcucaccaagccaugggauguuauccccauggucacacaaauagcuaugacugauaccacacccuucggacaacagaggguuuucaaagagaaaguugacacacgcacaccaagaccaaaacgaggcacagcacaaauuauggaggugacagccaagugguuguggggauuccucucuagaaauaaaaaacccagaaucugcacaagagaggaguucacaagaaaaguuaggucaaacgcagcaauuggagcaguguuuguugaugaaaaccaauggaacucagcaaaagaagcaguggaagacgaaagguuuugggaccucgugcacagagagagggagcuucauaaacagggaaaaugugccacgugugucuacaauaugauggguaaaagagagaaaaaacuaggagaguuuggaaaggcaaaaggaagucgugcaauaugguacaugugguugggagcacgcuuucuagaauuugaagcccuuggcuucaugaaugaagaccacugguucaguagggagaauucacucaguggaguggaaggagaaggacuacauaaacuuggauacauacucagagacauaucaaagauuccagggggaaauauguaugcagacgacacagcuggaugggacacaagaauaacagaggaugaucuucagaaugaggcuaaaaucaccgacaucauggagccugaacaugcucuacuggcuacgucaaucuucaagcugaccuaucaaaauaaggugguaagggugcaaagaccagcaaaaaguggaaccgugauggacgucauauccagacgugaccagagaggaaguggacaggucggaacuuauggccuaaacacuuucaccaacauggagguccaacuaauaagacaaauggaaucugaaggaaucuuuucacccagcgaauuggaaaauucaaaucuagcugagagaguucucgacugguuggaaaaacauggcgucgaaagguugaaaagaauggcaaucagcggagaugacuguguggugaaaccaacugaugacagguucgcaacagcuuuaacagcccugaaugacaugggaaaggugagaaaagacauaccgcaaugggaaccuucaaaaggauggaaugacuggcagcaagugccuuucuguucacaccacuuccaccaacugauuaugaaggaugggagggagauaguggugccaugccgcaaccaagaugaacuugugggcagggccagaguaucacaaggcgccggguggagccugagagaaacugcuugccuaggcaagucauaugcacaaauguggcagcugauguacuuccacaggagagaccugagacuggcggcuaaugcuaucuguucagccguuccaguuaauugggucccaaccagccgcaccaccuggucgauccaugcccaccaucaauggaugacaacagaagacauguugucaguauggaauaggguuuggauagaggaaaacccauggauggaggacaaaacucauguauccagcugggaagauguuccauacuuaggaaaaagggaagaucaaugguguggaucucugauaggcuuaacagcuagagccaccugggccaccaacauacaaguggccauaaaccaagugagaaggcuuauugggaacgagaauuauuuagacuacaugacaucaaugaagagauucaagaaugagagugaucccgaaggagcccucugguaa

SEQ ID NO: 6327 - RNA, 9879 nt, Artificial Sequence
  derived and/or modified CDS sequence (wt) from DENV-1__KR024705__SS-prME
uccgugaccaugcuccucaugcugcugcccacagcccuggcguuccauuugaccacacgagggggagagccacacaugauaguuagcaagcaggaaagaggaaagucacucuuguuuaagaccucugcaggugucaacaugugcacccucauugcaauggauuugggagaguuaugugaggauacaaugaccuacaaaugcccccggaucacugaagcggaaccagaugauguugauugcuggugcaaugccacagacacaugggugaccuaugggacguguucucagacuggcgaacaccgacgggauaaacguucugucgcauuggccccacacguggggcuuggucucgaaacaagaacugaaacguggauguccucagaaggagccuggaagcagauacaaaaaguggagacuugggccuugagacacccaggauucacggugauagcccuuuuuuuagcacaugccauaggaacauccauuacccagaaagggaucaucuucauuuugcugaugcuggugacaccaucaauggccaugcgaugcgugggaauaggcaacagagacuucguugaaggacugucaggagcaacauggguggaugugguacuggagcauggaagcugugucaccaccauggcaaagaauaaaccaacauuggacauugaacucuugaagacggaggucacgaacccugccgucuugcgcaaacugugcauugaagcuaaaauaucaaacgccaccaccgauucaagauguccaacacaaggagaagcuacacugguggaagaacaagacgcgaacuuugugugucgacgaacauucguggacagaggcugggguaaugguuguggacuauucgggaagggaagcuuacuaacgugugcuaaguuuaagugugugacaaaacuugaaggaaagauaguucaauaugaaaacuuaaaauauucggugauagucacuguccacacuggggaccagcaccagguaggaaaugagacuacagaacauggaacaauugcaaccauaacaccucaagcucccacgucggaaauacagcugacugacuacggagcccuuacauuggacugcucaccuagaacagggcuggacuuuaaugagauggugcuguugacaaugaaagaaaaaucauggcuuguccacaaacaaugguuucuagacuuaccauuaccuuggaccucgggggcuucaacaucucaagagacuuggaacagacaagaucugcuggucacauucaagacagcucaugcaaagaagcaggaaguagucguacuggggucacaagaaggagcaaugcacacugcguugacuggggcgacagaaauccagacgucaggaacgacgacaaucuucgcaggacaccugaaauguagacuaaaaauggauaaacugacuuuaaaaggggugucauaugugaugugcacaggcucauuuaagcuagagaaggaaguggcugagacccagcauggaacuguccuagugcagguuaaauaugaaggaacagaugcaccaugcaagauuccaauuucaacccaagaugagaaaggagugacccagaaugggagauugauaacagccaaucccauaguuacugacaaagaaaaaccagucaacauugaaacagaaccacccuuuggugagagcuacaucgugauaggggcgggugaaaaagcuuugaaacuaagcugguuuaagaaaggaagcagcauagggaaaauguucgaagccaccgcccgaggagcacgaaggauggcuauccugggagacacagcaugggacuucgguuccauaggagggguguucacaucugugggaaaauugguacaccagguuuuuggaaccgcauaugggguccuguucagcgguguuucuuggaccaugaaaauaggaauagggauucugcugacauggcuaggauugaauucaaggagcacgucacucucgaugacgugcauugcaguuggcauggucacacuguaccuaggagucaugguucaagcggacucggggugugugaucaacuggaagggcagagaacucaaguguggaaguggcaucuuugucacuaaugaaguccacacuuggacagagcaauacaaauuccaggcugacuccccaaaaagacuaucagcagccauugggaaggcaugggaggaaggcguguguggaauucgaucagccacacgucuugagaacaucauguggaagcaaauaucaaaugaauugaaccacauucuacuugaaaaugacaugaaauucacagugguuguaggagacgccaauggaaucuugacccaaggaaaaaagaugauuaggccacaacccauggaacacaaauacucauggaaaagcuggggaaaagccaaaaucauaggagcagauacacagaauacuaccuucaucaucgauggcccagacacuccagaaugccccgaugaccagagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaacgagaccuggaagcuagcgagagccuccuucauagaagugaagacaugcaucuggccaagaucccacacucuauggagcaauggagucuuggaaagugaaaugauaaucccaaagauauauggaggaccaauaucucagcacaacuacagaccaggguauuucacacaaacagcagggccauggcaccuaggcaaguuggaacuagacuuuaauuugugugaaggcaccacaguuguuguggaugaacauuguggaaaucgagguccaucucuuagaacuacaacagucacaggaaagauaauccaugaauggugcugcagauccugcacgcuaccccccuuacgcuucagaggagaagacggauguugguauggcauggaaaucagaccagucaaggagaaggaagagaaucuagucaggucaauggucucugcagggucaggagaaguggacaguuuuucauugggacuacuaugcguaucaauaaugauugaagaagugaugagauccagauggaguagaaagaugcugaugacuggaacacuggcuguuuucuuccuucuuauaaugggacaacugacauggaaugaucugaucagguuaugcaucaugguuggagccaaugucucagacagaauggggaugggaacaacguaccuagcuuuaauggccacuuuuaaaaugagaccgauguucgcuguugggcuauuauuucgcagacuaacauccagagaggugcuccuucucacaauuggacuaagccugguggcauccguggagcuaccaaauucuuuagaggagcuaggggacggacuugcgaugggcaucaugauguuaaaauuguugacugauuuucagucacaccaguuguggacuaccuuacugucucugacauucaucaaaacaacucuuucacuagauuaugcauggaagacaauggcuaugguauugucaaucguaucucucuuuccucuaugucuauccacgaccucucaaaaaacaacauggcuuccgguguuguuaggauccuuuggauguaaaccacuaaccauguuucuuauaacagaaaacaaaauuuggggaaggaaaaguuggccccucaaugaaggaauuauggcuguuggaauagucagcauuuuacuaaguucacuccucaaaaaugacgugccacuagccggcccacuaauagcuggaggcaugcugauagcauguuacgucauuuccggaagcucagccgauuuaucauuggagagagcggcugaggucuccugggaagaagaagcagaacacucuggugccucacacaacauacuaguggagguccaagaugauggaaccaugaaaauaaaagaugaagagagagaugacacgcucaccauacuccucaaagcaacuuuguuggcaguuucagggguguacccaaugucaauaccagcaacccuuuuugugugguauuuuuggcagaaaaagaaacagagaucaggagucuugugggacacacccagcccuccagaaguagaaagagcaguucuugaugaugguaucuauagaaucuugcaaagaggacuguuggguaggucccagguaggagugggaguuuuucaagacggcguguuccacacaauguggcaugucaccaggggggcuguccucauguaccaagggaagaggcuggaaccaaguugggccagugucaaaaaagacuugaucucauauggaggagguuggagguuucaaggaucauggaacacgggagaagaaguacaggugauagcuguugaaccagggaaaaacccaaagaauguacagacaacgccgggcaccuucaagaccccugaaggcgaaguuggagccauagcccuagauuucaaaccuggcacaucuggaucucccaucgugaacagagaggggaaaauaguaggucuuuauggaaauggaguggugacaacaaguggaaccuacgucagugccauugcccaagcuaaagcgucacaagaagggccucuaccagagauugaggacgagguguuuaagaaaagaaaccuaacaauaauggaccuacauccaggaucaggaaaaacaagaagauaucuuccagccauaguccgugaggccauaaaaaggaaacugcgcacgcuaaucuuggcucccacaagaguugucgccucugaaauggcagaggcgcuuaaaggaaugccaauaagauaucagacaacagcaguaaagagugaacacacaggaaaggagauagucgaucucaugugccacgccacuuucaccaugcgucuccuaucuccagugagaguucccaauuacaacaugauuaucauggaugaagcacacuuuaccgauccagccagcauagcggccagaggguacaucucaacccgaguggguaugggugaagcagcugcgaucuucaugacagccacucccccaggaucgguagaggccuuuccacagagcaaugcaguuauccaagaugaggaaagagacauuccugagagaucauggaacucaggcuacgacuggaucacugacuucccaggaaaaacagucugguuuguuccaagcaucaaaucaggaaaugacauugccaacugcuuaagaaaaaacgggaaacgggugauccaauugagcagaaaaaccuuugacacugaauaccagaaaacgaaaaacaaugauugggacuauguugucacaacagacauuuccgaaaugggagcaaauuuccgggccgauaggguaauagacccaaggcggugcuugaagccgguaauacuaaaagauggcccagagcgcgucauucuggccggaccaaugccagugaccgcggccagugcugcccagaggagaggaagaauuggaaggaaccaaaacaaggaaggugaccaguauauuuacaugggacagccuuuaaauaaugaugaggaccacgcucauuggacagaagcaaaaaugcuccuugacaauauaaauacgccagaagggauuaucccagcccucuuugagccagagagagaaaagagugcagcaauagacggggaguauagacugcggggagaagcaaggaaaacguucguggagcuaaugagaagaggggaucuaccaguuuggcuaucuuacaaaguugccucagaaggcuuccaguacuccgacagaagauggugcuuugacggggaaaggaacaaccagguguuggaggagaacauggacguggagaucuggacaaaagaaggagaaagaaagaaauugcgaccucgcugguuagaugccagaaccuacucugauccacuggcccugcgcgaguuuaaggaguucgcagcaggaagaagaagugucucaggugaccuaauauuagaaauagggaaacucccacagcauuugacgcuaagggcccagaaugcuuuggacaacuuggucauguugcacaauuccgaacaagggggaaaagccuauagacaugcuauggaagaacuaccagacaccauagaaacauugaugcuacuagccuugauagcugugcugacugguggaguuacguuguuuuuccuaucaggaaaaggucuagggaaaacauccauuggccuacuuuguguaauggccucaaguguacuguuauggauggccaguguggagccccauuggauagcggccuccaucauacuagaguuuuuucugauggugcugcuuauuccagagccagacagacagcguacuccacaggacaaucaacuagcauauguggugauagguuuguuauucaugauauugacaguggcagccaaugagaugggauuacuggaaaccacaaagaaagaccuggggauuggccauguagucgccgaaaaccaccaccaugccacaaugcuagacauagacuuacauccagcuucagccuggacccucuaugcaguagccacaacaauuaucacucccaugaugagacacacaauugaaaacacaacggcaaacauuucccugacagcuauugcaaaucaggcggcuauauuaaugggacuugacaagggauggccaauaucgaagauggacauaggagugccacuucucgccuuagggugcuauucccaggugaacccauugacacugacagcggcgguguuaauguuaguggcucauuaugccauaauuggaccuggacugcaagcaaaagcuaccagagaagcccaaaaaaggacugcggccggaauaaugaaaaauccaacuguagacgggauuguugcaauagauuuggauccugugguuuaugaugcaaaauuugaaaaacagcuaggccaaauaauguuacuaauacucugcacaucacagauucucuugaugcggacuacaugggccuuaugugaaucuaucacacuggcuacuggacccuugaccacucucugggagggaucuccuggaaaauucuggaauaccacgauagcaguguccauggcaaacaucuucaggggaaguuauuuagcaggggcaggucuggccuucucauuaaugaaaucuuuaggaggagguaggagagguacgggagcucaaggggaaacauugggagaaaaauggaaaagacaacuaaaccaacugagcaagucagaauuuaacacuuacaaaaggaguggaauuauggagguggacagauccgaagccaaggagggacugaaaagaggagaaacaaccaaacaugcagugucgagaggaacagccaaacuuaggugguuuguggagaggaaccuugugaaaccggaagggaaagugauagaccucgguuguggaagagguggcuggucauauuacugcgcugggcugaagaaggucacagaaguaaagggauacacaaaaggaggacccggucaugaggaaccuaucccaauggcgacuuauggauggaacauagugaagcuacacucuggaagggauguauucuuuacaccaccugagaaaugugacacccuuuugugugauauuggugaguccucuccgaauccaacuauagaagaaggaagaacguuacguguucuaaagaugguggaaccauggcucagaggaaaucaguuuugcauaaaaauccuaaauccuuauaugccaagugugguagaaacucuggagcaaaugcaaagaaaacauggagggaugcuagugcgaaacccacucucaagaaauuccacccaugaaauguacugggucucauguggaaccggaaacauugugucggcagugaacaugacauccagaaugcugcugaaucgguucacaauggcucacaggaagccaacguaugaaagagacguggacuugggcgcuggaacaagacauguggcaguggaaccagagauagccaaccuagacauuauuggccagaggauagagaacauaaaaaaugaacauaagucaacauggcauuaugaugaggacaauccauacaaaacaugggccuaucauggaucauaugaggucaagccaucagggucagccucauccauggugaauggcguggugagauugcucaccaagccaugggauguuauccccauggucacacaaauagcuaugacugauaccacacccuucggacaacagaggguuuucaaagagaaaguugacacacgcacaccaagaccaaaacgaggcacagcacaaauuauggaggugacagccaagugguuguggggauuccucucuagaaauaaaaaacccagaaucugcacaagagaggaguucacaagaaaaguuaggucaaacgcagcaauuggagcaguguuuguugaugaaaaccaauggaacucagcaaaagaagcaguggaagacgaaagguuuugggaccucgugcacagagagagggagcuucauaaacagggaaaaugugccacgugugucuacaauaugauggguaaaagagagaaaaaacuaggagaguuuggaaaggcaaaaggaagucgugcaauaugguacaugugguugggagcacgcuuucuagaauuugaagcccuuggcuucaugaaugaagaccacugguucaguagggagaauucacucaguggaguggaaggagaaggacuacauaaacuuggauacauacucagagacauaucaaagauuccagggggaaauauguaugcagacgacacagcuggaugggacacaagaauaacagaggaugaucuccagaaugaggcuaaaaucaccgacaucauggagccugaacaugcucuacuggcuacgucaaucuucaagcugaccuaucaaaauaaggugguaagggugcaaagaccagcaaaaaguggaaccgugauggacgucauauccagacgugaccagagaggaaguggacaggucggaacuuauggccuaaacacuuucaccaacauggagguccaacuaauaagacaaauggaaucugaaggaaucuuuucacccagugaauuggaaaauucaaaucuagcugagagaguucucgacugguuggaaaaacauggcgucgaaagguugaaaagaauggcaaucagcggagaugacuguguggugaaaccaacugaugacagguucgcaacagcuuuaacagcccugaaugacaugggaaaggugagaaaagacauaccgcaaugggaaccuucaaaaggauggaaugacuggcagcaagugccuuucuguucacaccacuuccaccaacugauuaugaaggaugggagggagauaguggugccaugccgcaaccaagaugaacuugugggcagggccagaguaucacaaggcgccggguggagccugagagaaacugcuugccuaggcaagucauaugcacaaauguggcagcugauguacuuccacaggagagaccugagacuggcggcuaaugcuaucuguucagccguuccaguuaauugggucccaaccagccgcaccaccuggucgauccaugcccaccaucaauggaugacaacagaagacauguugucaguauggaauaggguuuggauagaggaaaacccauggauggaggacaaaacucauguauccagcugggaagauguuccauacuuaggaaaaagggaagaucaaugguguggaucucugauaggcuuaacagcaagagccaccugggccaccaacauacaaguggccauaaaccaagugagaaggcuuauugggaacgagaauuauuuagacuacaugacaucaaugaagagauucaagaaugagagugaucccgaaggagcccucugguaa

SEQ ID NO: 6328 - RNA, 9879 nt, Artificial Sequence
  derived and/or modified CDS sequence (wt) from DENV-1__KR024706__SS-prME
uccgugaccaugcuccucaugcugcugcccacagcccuggcguuccauuugaccacacgagggggagagccacacaugauaguuagcaagcaggaaagaggaaagucacucuuguuuaagaccucugcaggugucaacaugugcacccucauugcaauggauuugggagaguuaugugaggauacaaugaccuacaaaugcccccggaucacuggagcggaaccagaugauguugauugcuggugcaaugccacagacacaugggugaccuaugggacguguucucagacuggcgaacaccgacgggauaaacguucugucgcauuggccccacacguggggcuuggucucgaaacaagaacugaaacguggauguccucugaaggcgccuggaggcagauacaaaaaguggagacuugggccuugagacacccaggauucacggugauagccuuuuuuuuagcacaugccauaggaacauccauuacccagaaagggaucaucuucauuuugcugaugcuggugacaccaucaauggccaugcgaugcgugggaauaggcaacagagacuucguugaaggacugucaggagcaacauggguggaugugguacuggagcauggaagcugugucaccaccauggcaaagaauaaaccaacauuggacauugaacucuugaagacggaggucacgaacccugccgucuugcgcaaacugugcauugaagcuaaaauaucaaacaccaccaccgauucaagauguccaacacaaggagaagcuacacugguggaagaacaagacgcgaacuuugugugucgacgaacacucguggacagaggcugggguaaugguuguggacuauucgggaagggaagcuuacuaacgugugcuaaguuuaagugugugacaaaacuugaaggaaagauaguucaauaugaaaacuuaaaauauucggugauagucacuguccacacuggggaccagcaccagguaggaaaugagacuacagaacauggaacaauugcaaccauaacaccucaagcucccacgucggaaauacagcugacugacuacggagcccuuacauuggacugcucaccuagaacagggcuggacuuuaaugagauggugcuguugacaaugaaagaaaaaucauggcuuguccacaaacaaugguuucuagacuuaccauuaccuuggaccucgggggcuucaacaucucaagagacuuggaacagacaagaucugcuggucacauuuaagacagcucaugcaaagaagcaggaaguagucguacuggggucacaagaaggagcaaugcacacugcguugacuggggcgacagaaauccagacgucaggaacgacgacaaucuucgcaggacaccugaaauguagacuaaaaauggauaaacugacuuuaaaaggggugucauaugugaugugcacaggcucauuuaagcuagagaaggaaguggcugagacccagcauggaacuguccuagugcagguuaaauaugaaggaacagaugcaccaugcaagauuccaauuucaacccaagaugagaaaggagugacccagaaugggagauugauaacagccaaucccauaguuacugacaaagaaaaaccagucaacauugaaacagaaccacccuuuggugagagcuacaucgugauaggggcgggugaaaaagcuuugaaacuaagcugguuuaagaaaggaagcagcauagggaaaauguucgaagccaccgcccgaggagcacgaaggauggcuauccugggagacacagcaugggacuucgguuccauaggagggguguucacaucugugggaaaauugguacaccagguuuuuggaaccgcauaugggguccuguucagcgguguuucuuggaccaugaaaauaggaauagggauucugcugacauggcuaggauugaauucaaggagcacgucacucucgaugacgugcauugcaguuggcauggucacacuguaccuaggagucaugguucaagcggacucggggugugugaucaacuggaagggcagagaacucaaguguggaaguggcaucuuugucacuaaugaaguccacacuuggacagagcaauacaaauuccaggcugacuccccaaaaagacuaucagcagccauugggaaggcaugggaggaaggcguguguggaauucgaucagccacacgucuugagaacaucauguggaagcaaauaucaaaugaauugaaccacauucuacuugaaaaugacaugaaauucacagugguuguaggagacgccaauggaaucuugacccaaggaaaaaagaugauuaggccacaacccauggaacacaaauacucauggaaaagcuggggaaaagccaaaaucauaggagcagauacacagaauacuaccuucaucaucgauggcccagacacuccagaaugccccgaugaccagagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaacgagaccuggaagcuagcgagagccuccuucauagaagugaagacaugcaucuggccaagaucccacacucuauggagcaauggagucuuggaaagugaaaugauaaucccaaagauauauggaggaccaauaucucagcacaacuacagaccaggguauuucacacaaacagcagggccauggcaccuaggcaaguuggaacuagacuuuaauuugugugaaggcaccacaguuguuguggaugaacauuguggaaaucgagguccaucucuuagaacuacaacagucacaggaaagauaauccaugaauggugcugcagauccugcacgcuaccccccuuacgcuucagaggagaagacggauguugguauggcauggaaaucagaccagucaaggagaaggaagagaaucuagucaggucaauggucucugcagggucaggagaaguggacaguuuuucauugggacuacuaugcguaucaauaaugauugaagaagugaugagauccagauggaguagaaagaugcugaugacuggaacacuggcuguuuucuuccuucuuauaaugggacaacugacauggaaugaucugaucagguuaugcaucaugguuggagccaaugucucagacagaauggggaugggaacaacguaccuagcuuuaauggccacuuuuaaaaugagaccgauguucgcuguugggcuauuauuucgcagacuaacauccagagaggugcuccuucucacaauuggacuaagccugguggcauccguggagcuaccaaauucuuuagaggagcuaggggacggacuugcgaugggcaucaugauguuaaaauuguugacugauuuucagucacaccaguuguggacuaccuuacugucucugacauucaucaaaacaacucuuucacuagauuaugcauggaagacaauggcuaugguauugucaaucguaucucucuuuccucuaugucuauccacgaccucucaaaaaacaacauggcuuccgguguuguuaggauccuuuggauguaaaccacuaaccauguuucuuauaacagaaaacaaaauuuggggaaggaaaaguuggccccucaaugaaggaauuauggcuguuggaauagucagcauuuuacuaaguucacuccucaaaaaugacgugccacuagccggcccacuaauagcuggaggcaugcugauagcauguuacgucauuuccggaagcucagccgauuuaucauuggagagagcggcugaggucuccugggaagaagaagcagaacacucuggugccucacacaacauacuaguggagguccaagaugauggaaccaugaaaauaaaagaugaagagagagaugacacgcucacuauacuccucaaagcaacuuuguuggcaguuucagggguguacccaaugucaauaccagcaacccuuuuugugugguauuuuuggcagaaaaagaaacagagaucaggagucuugugggacacacccagcccuccagaaguagaaagagcaguucuugaugaugguaucuauagaaucuugcaaagaggacuguuggguaggucccagguaggagugggaguuuuucaagacggcguguuccacacaauguggcaugucaccaggggggcuguccucauguaccaagggaagaggcuggaaccaaguugggccagugucaaaaaagacuugaucucauauggaggagguuggagguuucaaggaucauggaacacgggagaagaaguacaggugauagcuguugaaccagggaaaaacccaaagaauguacagacaacgccgggcaccuucaagaccccugaaggcgaaguuggagccauagcccuagauuucaaaccuggcacaucuggaucucccaucgugaacagagaggggaaaauaguaggucuuuauggaaauggaguggugacaacaaguggaaccuacgucagugccauugcccaagcuaaagcgucacaagaagggccucuaccagagauugaggacgagguguuuaagaaaagaaaccuaacaauaauggaccuacauccaggaucaggaaaaacaagaagauaucuuccagccauaguccgugaggccauaaaaaggaaacugcgcacgcuaaucuuggcucccacaagaguugucgccucugaaauggcagaggcgcuuaaaggaaugccaauaagauaucagacaacagcaguaaagagugaacacacaggaaaggagauagucgaucucaugugccacgccacuuucaccaugcgucuccuaucuccagugagaguucccaauuacaacaugauuaucauggaugaagcacacuuuaccgauccagccagcauagcggccagaggguacaucucaacccgaguggguaugggugaagcagcugcgaucuucaugacagccacucccccaggaucgguagaggccuuuccacagagcaaugcaguuauccaagaugaggaaagagacauuccugagagaucauggaacucaggcuacgacuggaucacugacuucccaggaaaaacagucugguuuguuccaagcaucaaaucaggaaaugacauugccaacugcuuaagaaaaaacgggaaacgggugauccaauugagcagaaaaaccuuugacacugaauaccagaaaacgaaaaacaaugauugggacuauguugucacaacagacauuuccgaaaugggagcaaauuuccgggccgauaggguaauagacccaaggcggugcuugaagccgguaauacuaaaagauggcccagagcgcgucauucuggccggaccaaugccagugaccgcggccagugcugcccagaggagaggaagaauuggaaggaaccaaaacaaggaaggugaccaguauauuuacaugggacagccuuuaaauaaugaugaggaccacgcucauuggacagaagcaaaaaugcuccuugacaauauaaauacgccagaagggauuaucccagcccucuuugagccagagagagaaaagagugcagcaauagacggggaguauagacuggggggagaagcaaggaaaacguucguggagcuaaugaaaagaggggaucuaccaguuuggcuaucuuacaaaguugccucagaaggcuuccaguacuccgacagaagauggugcuuugacggggaaaggaacaaccagguguuggaggagaacauggacguggagaucuggacaaaagaaggagaaagaaagaaauugcgaccucgcugguuagaugccagaaccuacucugauccacuggcccugcgcgaguuuaaggaguucgcagcaggaagaagaagugucucaggugaccuaauauuagaaauagggaaacucccacagcauuugacgcuaagggcccagaaugcuuuggacaacuuggucauguugcacaauuccgaacaagggggaaaagccuauagacaugcuauggaagaacuaccagacaccauagaaacauugaugcuacuagccuugauagcugugcugacugguggaguuacguuguuuuuccuaucaggaaaaggucuagggaaaacauccauuggccuacuuuguguaauggccucaaguguacuguuauggauggccaguguggagccccauuggauagcggccuccaucauacuagaguuuuuucugauggugcugcuuauuccagagccagacagacagcguacuccacaggacaaucaacuagcauauguggugauagguuuguuauucaugauauugacaguggcagccaaugagaugggauuacuggaaaccacaaagaaagaccuggggauuggccauguagucgccgaaaaccaccaccaugccacaaugcuagacauagacuuacauccagcuucagccuggacccucuaugcaguagccacaacaauuaucacucccaugaugagacacacaauugaaaacacaacggcaaacauuucccugacagcuauugcaaaucaggcggcuauauuaaugggacuugacaagggauggccaauaucgaagauggacauaggagugccacuucucgccuuagggugcuauucccaggugaacccauugacacugacagcggcgguguuaauguuaguggcucauuaugccauaauuggaccuggacugcaagcaaaagcuaccagagaagcccaaaaaaggacugcggccggaauaaugaaaaauccaacuguagacgggauuguugcaauagauuuggauccugugguuuaugaugcaaaauuugaaaaacagcuaggccaaauaauguuacuaauacucugcacaucacagauucucuugaugcggacuacaugggccuuaugugaaucuaucacacuggcuacuggacccuugaccacucucugggagggaucuccuggaaaauucuggaauaccacgauagcaguguccauggcaaacaucuucaggggaaguuauuuagcaggggcaggucuggccuucucauuaaugaaaucuuuaggaggagguaggagagguacgggagcucaaggggaaacauugggagaaaaauggaaaagacaacuaaaccaacugagcaagucagaauuuaacacuuacaaaaggaguggaauuauggagguggacagauccgaagccaaggagggacugaaaagaggagaaacaaccaaacaugcagugucgagaggaacagccaaacuuaggugguuuguggagaggaaccuugugaaaccggaagggaaagugauagaccucgguuguggaagagguggcuggucauauuacugcgcugggcugaagaaggucacagaaguaaagggauacacaaaaggaggacccggucaugaggaaccuaucccaauggcgacuuauggauggaacauagugaagcuacacucuggaagggauguauucuuuacaccaccugagaaaugugacacccuuuugugugauauuggugaguccucuccgaauccaacuauagaagaaggaagaacguuacguguucuaaagaugguggaaccauggcucagaggaaaucaguuuugcauaaaaauccuaaauccuuauaugccaagugugguagaaacucuggagcaaaugcaaagaaaacauggagggaugcuagugcgaaacccacucucaagaaauuccacccaugaaauguacugggucucauguggaaccggaaacauugugucggcagugaacaugacauccagaaugcugcugaaucgguucacaauggcucacaggaagccaacguaugaaagagacguggacuugggcgcuggaacaagacauguggcaguggaaccagagauagccaaccuagacauuauuggccagaggauagagaacauaaaaaaugaacauaagucaacauggcauuaugaugaggacaauccauacaaaacaugggccuaucauggaucauaugaggucaagccaucagggucagccucauccauggugaauggcguggugagauugcucaccaagccaugggauguuauccccauggucacacaaauagcuaugacugauaccacacccuucggacaacagaggguuuucaaagagaaaguugacacacgcacaccaagaccaaaacgaggcacagcacaaauuauggaggugacagccaagugguuguggggauuccucucuagaaauaaaaaacccagaaucugcacaagagaggaguucacaagaaaaguuaggucaaacgcagcaauuggagcaguguuuguugaugaaaaccaauggaacucagcaaaagaagcaguggaagacgaaagguuuugggaccucgugcacagagagagggagcuucauaaacagggaaaaugugccacgugugucuacaauaugauggguaaaagagagaaaaaacuaggagaguuuggaaaggcaaaaggaagucgugcaauaugguacaugugguugggagcacgcuuucuagaauuugaagcccuuggcuucaugaaugaagaccacugguucaguagggagaauucacucaguggaguggaaggagaaggacuacauaaacuuggauacauacucagagacauaucaaagauuccagggggaaauauguaugcagacgacacagcuggaugggacacaagaauaacagaggaugaucuccagaaugaggcuaaaaucaccgacaucauggagccugaacaugcucuacuggcuacgucaaucuucaagcugaccuaucaaaauaaggugguaagggugcaaagaccagcaaaaaguggaaccgugauggacgucauauccagacgugaccagagaggaaguggacaggucggaacuuauggccuaaacacuuucaccaacauggagguccaacuaauaagacaaauggaaucugaaggaaucuuuucacccagcgaauuggaaaauucaaaucuagcugagagaguucucgacugguuggaaaaacauggcgucgaaagguugaaaagaauggcaaucagcggagaugacuguguggugaaaccaacugaugacagguucgcaacagcuuuaacagcccugaaugacaugggaaaggugagaaaagacauaccgcaaugggaaccuucaaaaggauggaaugacuggcagcuagugccuuucuguucacaccacuuccaccaacugauuaugaaggaugggagggagauaguggugccaugccgcaaccaagaugaacuugugggcagggccagaguaucacaaggcgccggguggagccugagagaaacugcuugccuaggcaagucauaugcacaaauguggcagcugauguacuuccacaggagagaccugagacuggcggcuaaugcuaucuguucagccguuccaguuaauugggucccaaccagccgcaccaccuggucgauccaugcccaccaucaauggaugacaacagaagacauguugucaguauggaauaggguuuggauagaggaaaacccauggauggaggacaaaacucauguauccagcugggaagauguuccauacuuaggaaaaagggaagaucaaugguguggaucucugauaggcuuaacagcaagagccaccugggccaccaacauacaaguggccauaaaccaagugagaaggcuuauugggaacgagaauuauuuagacuacaugacaucaaugaagagauucaagaaugagagugaucccgaaggagcccucugguaa

SEQ ID NO: 6329 - RNA, 9879 nt, Artificial Sequence
  derived and/or modified CDS sequence (wt) from DENV-1__KR024707__SS-prME
uccgugaccaugcuccucaugcugcugcccacagcccuggcguuccauuugaccacacgagggggagagccacacaugauaguuagcaagcaggaaagaggaaagucacucuuguuuaagaccucugcaggugucaacaugugcacccucauugcaauggauuugggagaguuaugugaggauacaaugaccuacaaaugcccccggaucacugaagcggaaccagaugauguugauugcuggugcaaugccacagacacaugggugaccuaugggacguguucucagacuggcgaacaccgacgggauaaacguucugucgcauuggccccacacguggggcuuggucucgaaacaagaaccgaaacguggauguccucugaaggcgccuggaggcagauacaaaaaguggagacuugggccuugagacacccaggauucacggugauagcccuuuuuuuagcacaugccauaggaacauccauuacccagaaagggaucaucuucauuuugcugaugcuggugacaccaucaauggccaugcgaugcgugggaauaggcaacagagacuucguugaaggacugucaggagcaacauggguggaugugguacuggagcauggaagcugugucaccaccauggcaaagaauaaaccaacauuggacauugaacucuugaagacggaggucacgaacccugccgucuugcgcaaacugugcauugaagcuaaaauaucaaacaccaccaccgauucaagauguccaacacaaggagaagcuacacugguggaagaacaagacgcgaacuuugugugucgacgaacauucguggacagaggcugggguaaugguuguggacuauucgggaagggaagcuuacuaacgugugcuaaguuuaagugugugacaaaacuugaaggaaagauaguucaauaugaaaacuuaaaauauucggugauagucacuguccacacuggggaccagcaccagguaggaaaugagacuacagaacauggaacaauugcaaccauaacaccucaagcucccacgucggaaauacagcugacugacuacggagcccuuacauuggacugcucaccuagaacagggcuggacuuuaaugagauggugcuguugacaaugaaagaaaaaucauggcuuguccacaaacaaugguuucuagacuuaccauuaccuuggaccucgggggcuucaacaucucaagagacuuggaacagacaagaucugcuggucacauuuaagacagcucaugcaaagaagcaggaaguagucguacuggggucacaagaaggagcaaugcacacugcguugacuggggcgacagaaauccagacgucaggaacgacgacaaucuucgcaggacaccugaaauguagacuaaaaauggauaaacugacuuuaaaaggggugucauaugugaugugcacaggcucauuuaagcuagagaaggaaguggcugagacccagcauggaacuguccuagugcagguuaaauaugaaggaacagaugcaccaugcaagauuccaauuucaacccaagaugagaaaggagugacccagaaugggagauugauaacagccaaucccauaguuacugacaaagaaaaaccagucaacauugaaacagaaccacccuuuggugagagcuacaucgugauaggggcgggugaaaaagcuuugaaacuaagcugguuuaagaaaggaagcagcauagggaaaauguucgaagccaccgcccgaggagcacgaaggauggcuauccugggagacacagcaugggacuucgguuccauaggagggguguucacaucugugggaaaauugguacaccagguuuuuggaaccgcauaugggguccuguucagcgguguuucuuggaccaugaaaauaggaauagggauucugcugacauggcuaggauugaauucaaggagcacgucacucucgaugacgugcauugcaguuggcauggucacacuguaccuaggagucaugguucaagcggacucggggugugugaucaacuggaagggcagagaacucaaguguggaaguggcaucuuugucacuaaugaaguccacacuuggacagagcaauacaaauuccaggcugacuccccaaaaagacuaucagcagccauugggaaggcaugggaggaaggcguguguggaauucgaucagccacacgucuugagaacaucauguggaagcaaauaucaaaugaauugaaccacauucuacuugaaaaugacaugaaauucacagugguuguaggagacgccaauggaaucuugacccaaggaaaaaagaugauuaggccacaacccauggaacacaaauacucauggaaaagcuggggaaaagccaaaaucauaggagcagauacacagaauacuaccuucaucaucgauggcccagacacuccagaaugccccgaugaccagagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaacgagaccuggaagcuagcgagagccuccuucauagaagugaagacaugcaucuggccaagaucccacacucuauggagcaauggagucuuggaaagugaaaugauaaucccaaagauauauggaggaccaauaucucagcacaacuacagaccaggguauuucacacaaacagcagggccauggcaccuaggcaaguuggaacuagacuuuaauuugugugaaggcaccacaguuguuguggaugaacauuguggaaaucgagguccaucucuuagaacuacaacagucacaggaaagauaauccaugaauggugcugcagauccugcacgcuaccccccuuacgcuucagaggagaagacggauguugguauggcauggaaaucagaccagucaaggagaaggaagagaaucuagucaggucaauggucucugcagggucaggagaaguggacaguuuuucauugggacuacuaugcguaucaauaaugauugaagaagugaugagauccagauggaguagaaagaugcugaugacuggaacacuggcuguuuucuuccuucuuauaaugggacaacugacauggaaugaucugaucagguuaugcaucaugguuggagccaaugucucagacagaauggggaugggaacaacguaccuagcuuuaauggccacuuuuaaaaugagaccgauguucgcuguugggcuauuauuucgcagacuaacauccagagaggugcuccuucucacaauuggacuaagccugguggcauccguggagcuaccaaauucuuuagaggagcuaggggacggacuugcgaugggcaucaugauguuaaaauuguugacugauuuucagucacaccaguuguggacuaccuuacugucucugacauucaucaaaacaacucuuucacuagauuaugcauggaagacaauggcuaugguauugucaaucguaucucucuuuccucuaugucuauccacgaccucucaaaaaacaacauggcuuccgguguuguuaggauccuuuggauguaaaccacuaaccauguuucuuauaacagaaaacaaaauuuggggaaggaaaaguuggccccucaaugaaggaauuauggcuguuggaauagucagcauuuuacuaaguucacuccucaaaaaugacgugccacuagccggcccacuaauagcuggaggcaugcugauagcauguuacgucauuuccggaagcucagccgauuuaucauuggagagagcggcugaggucuccugggaagaagaagcagaacacucuggugccucacacaacauacuaguggagguccaagaugauggaaccaugaaaauaaaagaugaagagagagaugacacgcucacuauacuccucaaagcaacuuuguuggcaguuucagggguguacccaaugucaauaccagcaacccuuuuugugugguauuuuuggcagaaaaagaaacagagaucaggagucuugugggacacacccagcccuccagaaguagaaagagcaguucuugaugaugguaucuauagaaucuugcaaagaggacuguuggguaggucccagguaggagugggaguuuuucaagacggcguguuccacacaauguggcaugucaccaggggggcuguccucauguaccaagggaagaggcuggaaccaaguugggccagugucaaaaaagacuugaucucuuauggaggagguuggagguuucaaggaucauggaacacgggagaagaaguacaggugauagcuguugaaccagggaaaaacccaaagaauguacagacaacgccgggcaccuucaagaccccugaaggcgaaguuggagccauagcccuagauuucaaaccuggcacaucuggaucucccaucgugaacagagaggggaaaauaguaggucuuuauggaaauggaguggugacaacaaguggaaccuacgucagugccauugcccaagcuaaagcgucacaagaagggccucuaccagagauugaggacgagguguuuaagaaaagaaaccuaacaauaauggaccuacauccaggaucaggaaaaacaagaagauaucuuccagccauaguccgugaggccauaaaaaggaaacugcgcacgcuaaucuuggcucccacaagaguugucgccucugaaauggcagaggcgcuuaaaggaaugccaauaagauaucagacaacagcaguaaagagugaacacacaggaaaggagauagucgaucucaugugccacgccacuuucaccaugcgucuccuaucuccagugagaguucccaauuacaacaugauuaucauggaugaagcacacuuuaccgauccagccagcauagcggccagaggguacaucucaacccgaguggguaugggugaagcagcugcgaucuucaugacagccacucccccaggaucgguagaggccuuuccacagagcaaugcaguuauccaagaugaggaaagagacauuccugagagaucauggaacucaggcuacgacuggaucacugacuucccaggaaaaacagucugguuuguuccaagcaucaaaucaggaaaugacauugccaacugcuuaagaaaaaacgggaaacgggugauccaauugagcagaaaaaccuuugacacugaauaccagaaaacgaaaaacaaugauugggacuauguugucacaacagacauuuccgaaaugggagcaaauuuccgggccgauaggguaauagacccaaggcggugcuugaagccgguaauacuaaaagauggcccagagcgcgucauucuggccggaccaaugccagugaccgcggccagugcugcccagaggagaggaagaauuggaaggaaccaaaacaaggaaggugaccaguauguuuacaugggacagccuuuaaauaaugaugaggaccaugcucauuggacagaagcaaaaaugcuccuugacaauauaaauacgccagaagggauuaucccagcccucuuugagccagagagagaaaagagugcagcaauagacggggaguauagacugcggggagaagcaaggaaaacguucguggagcuaaugagaagaggggaucuaccaguuuggcuaucuuacaaaguugccucagaaggcuuccaguacuccgacagaagauggugcuuugacggggaaaggaacaaccagguguuggaggagaacauggacguggagaucuggacaaaagaaggagaaagaaagaaauugcgaccucgcugguuagaugccagaaccuacucugauccacuggcccugcgcgaguuuaaggaguucgcagcaggaagaagaagugucucaggugaccuaauauuagaaauagggaaacucccacagcauuugacgcuaagggcccagaaugcuuuggacaacuuggucauguugcacaauuccgaacaagggggaaaagccuauagacaugcuauggaagaacuaccagacaccauagaaacauugaugcuacuaaccuugauagcugugcugacugguggaguuacguuguuuuuccuaucaggaaaaggucuagggaaaacauccauuggccuacuuuguguaauggccucaaguguacuguuauggauggccaguguggagccccauuggauagcggccuccaucauacuagaguuuuuucugauggugcugcuuauuccagagccagacagacagcguacuccacaggacaaucaacuagcauauguggugauagguuuguuauucaugauauugacaguggcagccaaugagaugggauuacuggaaaccacaaagaaagaccuggggauuggccauguagucgccgaaaaccaccaccaugccacaaugcuagacauagacuuacauccagcuucagccuggacccucuaugcaguagccacaacaauuaucacucccaugaugagacacacaauugaaaacacaacggcaaacauuucccugacagcuauugcaaaucaggcggcuauauuaaugggacuugacaagggauggccaauaucgaagauggacauaggagugccacuucucgccuuagggugcuauucccaggugaacccauugacacugacagcggcgguguuaauguuaguggcucauuaugccauaauuggaccuggacugcaagcaaaagcuaccagagaagcccaaaaaaggacugcggccggaauaaugaaaaauccaacuguagacgggauuguugcaauagauuuggauccugugguuuaugaugcaaaauuugaaaaacagcuaggccaaauaauguuacuaauacucugcacaucacagauucucuugaugcggacuacaugggccuuaugugaaucuaucacacuggcuacuggacccuugaccacucucugggagggaucuccuggaaaauucuggaauaccacgauagcaguguccauggcaaacaucuucaggggaaguuauuuagcaggggcaggucuggccuucucauuaaugaaaucuuuaggaggagguaggagagguacgggagcucaaggggaaacauugggagaaaaauggaaaagacaacuaaaccaacugagcaagucagaauuuaacacuuacaaaaggaguggaauuauggagguggacagauccgaagccaaggagggacugaaaagaggagaaacaaccaaacaugcagugucgagaggaacagccaaacuuaggugguuuguggagaggaaccuugugaaaccggaagggaaagugauagaccucgguuguggaagagguggcuggucauauuacugcgcugggcugaagaaggucacagaaguaaagggauacacaaaaggaggacccggucaugaggaaccuaucccaauggcgacuuauggauggaacauagugaagcuacacucuggaagggauguauucuuuacaccaccugagaaaugugacacccuuuugugugauauuggugaguccucuccgaauccaacuauagaagaaggaagaacguuacguguucuaaagaugguggaaccauggcucagaggaaaucaguuuugcauaaaaauccuaaauccuuauaugccaagugugguagaaacucuggagcaaaugcaaagaaaacauggagggaugcuagugcgaaacccacucucaagaaauuccacccaugaaauguacugggucucauguggaacaggaaacauugugucggcagugaacaugacauccagaaugcugcugaaucgguucacaauggcucacaggaagccaacguaugaaagagacguggaccugggcgcuggaacaagacauguggcaguggaaccagagauagccaaccuagacauuauuggccagaggauagagaacauaaaaaaugaacauaagucaacauggcauuaugaugaggacaauccauacaaaacaugggccuaucauggaucauaugaggucaagccaucagggucagccucauccauggugaauggcguggugagauugcucaccaagccaugggauguuauccccauggucacacaaauagcuaugacugauaccacacccuucggacaacagaggguuuucaaagagaaaguugacacacgcacaccaagaccaaaacgaggcacagcacaaauuauggaggugacagccaagugguuguggggauuccucucuagaaauaaaaaacccagaaucugcacaagagaggaguucacaagaaaaguuaggucaaacgcagcaauuggagcaguguuuguugaugaaaaccaauggaacucagcaaaagaagcaguggaagacgaaagguuuugggaccucgugcacagagagagggagcuucauaaacagggaaaaugugccacgugugucuacaauaugauggguaaaagagagaaaaaacuaggagaguuuggaaaggcaaaaggaagucgugcaauaugguacaugugguugggagcacgcuuucuagaauuugaagcccuuggcuucaugaaugaagaccacugguucaguagggagaauucacucaguggaguggaaggagaaggacuacauaaacuuggauacauacucagagacauaucaaagauuccagggggaaauauguaugcagacgacacagcuggaugggacacaagaauaacagaggaugaucuccagaaugaggcuaaaaucaccgacaucauggagccugaacaugcucuacuggcuacgucaaucuucaagcugaccuaucaaaauaaggugguaagggugcaaagaccagcaaaaaguggaaccgugauggacgucauauccagacgugaccagagaggaaguggacaggucggaacuuauggccuaaacacuuucaccaacauggagguccaacuaauaagacaaauggaaucugaaggaaucuuuucacccagcgaauuggaaaauucaaaucuagcugagagaguucucgacugguuggaaaaacauggcgucgaaagguugaaaagaauggcaaucagcggagaugacuguguggugaaaccaacugaugacagguucgcaacagcuuuaacagcccugaaugacaugggaaaggugagaaaagacauaccgcaaugggaaccuucaaaaggauggaaugacuggcagcaagugccuuucuguucacaccacuuccaccaacugauuaugaaggaugggagggagauaguggugccaugucgcaaccaagaugaacuugugggcagggccagaguaucacaaggcgccggguggagccugagagaaacugcuugccuaggcaagucauaugcacaaauguggcagcugauguacuuccacaggagagaccugagacuggcggcuaaugcuaucuguucagccguuccaguuaauugggucccaaccagccgcaccaccuggucgauccaugcccaccaucaauggaugacaacagaagacauguugucaguauggaauaggguuuggauagaggaaaacccauggauggaggacaaaacucauguauccagcugggaagauguuccauacuuaggaaaaagggaagaucaaugguguggaucucugauaggcuuaacagcaagagccaccugggccaccaacauacaaguggccauaaaccaagugagaaggcuuauugggaacgagaauuauuuagacuacaugacaucaaugaagagauucaagaaugagagugaucccgaaggagcccucugguaa

SEQ ID NO: 6330 - RNA, 9879 nt, Artificial Sequence
  derived and/or modified CDS sequence (wt) from DENV-1__KC172829__SS-prME
ucugugaccaugcuccuuaugcugaugcccacagccuuggcguuccauuugacuacacgagggggagagccgcacaugauagucagcaagcaggaaagaggaaagucacucuuguuuaagaccucagcaggugucaauaugugcacccuuauagcgauggauuugggagaguugugugaggacacaaugacuuacaaaugcccucgaaucacugaggcggaaccagaugacguugauuguuggugcaacgccacagacacaugggugaccuauggaacauguucccaaacuggcgagcaccgacgagacaaacguuccgucgcacuggccccacacgugggacuugguuuggaaacaagaaccgaaacguggaugucuucugaaggugcuuggaaacagauacaaagaguggaaacuugggcccugagacacccaggauucacggugauagcccuuuuucuagcacaugccauaggaacauccaucacccagaaagggaucauuuucauuuuguuaaugcugguaacaccauccauggccaugcgaugugugggaauaggcagcagggacuucguggaaggacugucaggagcaacuuggguagaugugguacuggaacauggaaguugcguaaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacugguagaagaacaagacgcgaacuuugugugucgacgaacguuuguggacagaggcugggguaauggcugugggcucuucggaaaaggaagccuaauaacgugugccaaguucaagugugugacaaaacuggaaggaaagauaguucaauaugaaaaccugaaauauucaguaauagucaccguccacacuggagaccagcaccaggugggaaaugaaagcacagaacacgggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagaaacuuggaacagacaagauuuguuggugacauuuaagacagcucaugcaaagaagcaggaaguagucguucuaggaucacaagaaggagcaaugcacacugcguugaccggagcgacagaaauccaaacaucuggaacgacaacaauuuuugcaggacacuugaaauguagacuaaagauggacaaacugacucuaaaagggaugucauacgugaugugcacaggcacauucaagcuagagaaagaaguggcugagacccagcauggaacuguucuagugcagauuaaauacgaaggaacagaugcaccaugcaagaucccuuuuuccacccaagaugaaaaaggaguaacccagaaugggagauugauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauauugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaauucaaggagcacgucccuuucgaugacguguauugcaguuggccuaguaacacuauaccuaggagucaugguucaggcggauucaggauguguaguuaauuggaaagguagagaacucaaauguggaaguggcaucuuugucaccaaugaaguucacacuuggacagagcaauacaaauuucaagcugacuccccaaagagauuaucagcagccauugggaaggcaugggaggaggguguguguggaauucgaucagcaacucgucucgagaacaucauguggaagcaaauaucaaaugaacugaaucacaucuuacuugaaaaugacaugaaauucacagugguuguaggagauguugcugggaucuuggcucaaggaaaaaaaaugauuaggccacaacccauggaauacaaauacucguggaaaagcuggggaaaggcuaaaaucauaggggcagauguacagaacaccacuuucaucaucgacgguccaaacaccccagaaugcccugaugaccaaagagcauggaacauuugggaaguugaggacuauggauuuggaauuuucacgacaaacauauggcugagauugcgugacuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuucacacaaacggcagggccauggcaccuaggcaaguuggaacuggauuuugauuugugugaggguaccacaguuguuguggaugaacauuguggaaaccgaggaccaucucuuaggaccacaacagucacaggaaagauaauucaugaaugguguugcagaucuuguacgcuaccacccuuacguuuuagaggagaagaugggugcugguacgguauggaaaucagaccagucaaggaaaaggaagagaaucuagucaaaucaauggucucugcaggaucaggggaaguggacagcuuuucacuaggacugcuaugcauaucaauaaugaucgaagaggugaugagauccagauggaguagaaaaaugcugaugacuggaacacuggcuguguucuuccuucucauaauaggacaauugacauggaaugaucugaucagauuauccaucaugguuggagccaacgcuuccgacaagauggggaugggaacgacguaccuagcucugauggccacuuuuaaaaugagaccaauguuugcuguagggcuauuauuccgcagacuaacauccagagagguucuucuucuaacaauuggauugagcuuaguggcaucuguggaguuaccaaauuccuuggaggagcugggggauggacuugcaaugggcauuaugauuuuaaaauuauugacugacuuucaaucacaucagcugugggcuaccuugcuguccuugacauucaucaaaacaacguuuuccuugcacuaugcauggaagacaauggcuaugguacugucaauuguaucccucuuccccuuaugccuguccacgaccucccaaaaaacaacauggcuuccggugcuauugggaucucuuggaugcaaaccacuaaccauguuucuuauaacagaaaacaaaaucuggggaaggaaaaguuggccccucaaugaaggaaucauggcuguuggaauagucagcauccuacuaagcucacuccucaaaaaugaugugccgcuagcugggccacuaauagcuggaggcaugcuaauagcauguuauguuauaucuggaagcucagccgaucuaucgcuagagaaagcggcugaggucuccugggaagaagaagcagaacacucuggugccucacauaacauauuaguggagguccaagaugauggaaccaugaagauaaaggaugaagagagagaugacacgcuaaccauucuccuuaaagcaacucuguuagcaguuucagggguguacccauuaucaauaccugcgacccucuuugugugguacuuuuggcagaaaaagaaacagagaucuggaguguuaugggacacacccagcccuccagaaguggaaagagcaguucuugaugaugguaucuauagaaucaugcagagaggacuguugggcaggucccagguagggguaggaguuuuccaagaaaacguguuccacacaauguggcaugucaccaggggagcuguacucauguaucaagggaagagacuggaaccgagcugggccagugucaaaaaggaccugaucucauauggaggagguuggaggcuucaaggauccuggaacacgggagaagaagugcaggugauugcuguugaaccagggaaaaaccccaaaaauguacaaacagcgccgggcaccuuuaagaccacugaaggugaaguuggagccauugcccuagauuuuaaacccggcacaucuggaucucccaucgugaacagagaaggaaaaauaguaggucuuuauggaaaugggguagugacaacaaguggaaccuacgucagcgccauagcucaagcaaaagcaucacaagaagggccccuaccagagauugaagacgaaguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccagcauagcggccagaggguacauuucaacccgagugggcaugggugaagcagcugcgaucuucaugacagccacucccccaggaucaguggaggccuuuccacagagcaacgcaguuauccaagaugaggaaagagacauuccugagagaucauggaacucaggcuaugaguggaucacugacuucucagguaaaacaguuugguuuguuccaagcauuaaaucaggaaaugacauugccaacuguuuaagaaagaaugggaaacgggugauucaauugagcaggaaaaccuuugacacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcucagaggagaggaagaauuggaaggaaccacaauaaggaaggugaucaguacaucuacaugggacagccuuuaaacaacgaugaagaucacgcucacuggacggaagcaaaaaugcuccuugauaauauaaacacaccagaagggauuaucccagcccucuucgagccggagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaauaaccagguguuggaggagaacauggauguggagaucuggacaaaagaaggagaaagaaagaaacuacgaccccgcuggcuggaugccagaacauacucagacccacuggcccugcgcgaguuuaaagaguuugcagcaggaagaagaagcguuucaggugauuuaauauuagaaauagggaaacuuccacaacacuugacgcaaagggcccagaaugccuuggacaaccugguuauguugcacaacuccgaacaaggaggaagagcauauagacaugcaauggaagaacuaccagacaccauagaaacguugaugcuccuagcuuugauagcuguguugacugguggagugacgcuguucuuccuaucaggaaggggccuagggaaaacaucuaucggccuacucugcgugauggcuucaagcgugcugcuauggauggccaguguggagccccauuggauagcggccuccaucauacuggaguuuuuccugauggugcugcuuauuccagagccagacagacaacgcacuccgcaggacaaccagcuggcauauguggugauagguuuguuauuuaugauacugacaguagcagccaaugagaugggacugcuagaaaccacaaagaaagacuuagggauuggccauguggcugaugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaucaagcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcagccggaauaaugaagaauccaaccguugauggaauuguugcaauagauuuggacccugugguuuaugaugcaaaauuugagaaacaacuaggccaaauaauguuguugauacuaugcacaucacagauccucuugaugcggaccacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacaccuauaaaaggagugggauuauggaaguggacagauccgaagccaaagagggacugaaaagaggagaaacaaccaaacaugcagugucgagaggaaccgcuaaacugaggugguuuguggagaggaaccuugugaaaccagaaggaaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacuccgggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaagauucugaaucccuacaugccaagugugguggaaacucuggagcaaaugcaaagaaaacauggaggaaugcuagugcgaaacccacuuucaagaaacucuacccaugaaauguauuggguuucauguggaacaggaaacauugugucagcaguaaacaugacauccagaauguugcuaaaucgauucacgaugguucacaggaaaccaacauaugaaagagacguggaucuaggcgcuggaacaagacauguggcaguggaaccagagguggccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucauccccauggucacacaaauagccaugacugacacuacacccuuuggacaacagaggguguuuaaagagaaaguugacacacgcacaccaaaagcaaaacgaggcacagcacaaaucauggaggugacagccaggugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaagcuaggagaguucggaaaggcaaaaggaagucgugcaauaugguacaugugguugggagcacgcuuucuagaguuugaagcucuugguuucaugaacgaagaccacugguucaguagagagaauucacuuagcggaguggaaggagaaggacuccacaaacuuggauauauacucagagacauaucaaagaucccagggggaaacauguaugcagaugacacagccggaugggauacaaggauaacagaggaugaucuucagaaugaggccaaaauuacugacaucauggaauccgaacaugcccuacuggcuaagucaaucuucaagcuaaccuaccaaaauaaagugguaaggguacagagaccagcaaaaaauggaacugugauggaugucauauccagacgugaccagagaggaaguggccaggucggaacuuauggcuuaaacacuuucaccaacauggaagcccagcugauaagacaaauggagucugagggaaucuuuucacccagcgaauuagagaccccaaauuuagccgagagagcucucgacuggcuggaaaaacauggcgucgaaaggcugaaaagaauggcaaucagcggagaugacugcguagugaaaccaauugaugauagguuugcaacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacagggugccggauggagccugagagaaacugcaugccuaggcaagucauaugcacaaauguggcagcugauguacuuccacaggagagaccugagacuagccgcuaaugcuaucuguucagccguuccaguugauugggucccaaccagccgcaccaccuggucgauccaugcccaccaccaauggaugacaacagaagacaugcugucaguguggaauaggguuuggauagaggaaaacccauggauggaggacaaaacccauauauccaguugggaagacguuccauauuuagggaaaagggaagaucaaugguguggaucccugauaggcuuaacagcaagggccacuugggccaccaacauacaaguggccauaagccaagugagaagacuaauugggaaugagaauuaucuagauuacaugacaucaaugaagagauucaagaacgagagugaucccgaaggggcacucugguga

SEQ ID NO: 6331 - RNA, 9879 nt, Artificial Sequence
  derived and/or modified CDS sequence (wt) from DENV-1__EU359008__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuaugugaggacacacugacuuacaaaugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccuccgaaggcgcuuggaaacagauacaaagaguggagacuugggcccugagacacccaggauucacggugauagcccuuuuucuagcacaugccauaggaacauccaucacccagaaagggauuaucuucauuuuguuaaugcugguuacaccauccauggccaugcgaugcgugggaauaggcagcagggacuucguggaaggacugucaggagcaacuuggguagauguggugcuggaacauggaaguugcgucacuaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuuauaacgugugcuaaguucaagugugugacaaaacuggaaggaaaaauaguucaauaugaaaacuugaaauauucaguaauagucaccguccacacuggagaccagcaucaggugggaaaugaaagcacagaacaugggacaacugcaacuauaacaccucaagcucccacgacagaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaacacaagaaacuuggaacagacaagauuugcuggugacauuuaagacagcucaugcaaagaagcaggaaguagucguacuaggaucacaagaaggagcaaugcacacugcgcugaccggagcgacggaaauccaaacgucuggaacgacaacaauuuuugcaggacacuugaaauguagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuuugacccaagaugaaaaaggaguaacccagaaugggagauugauaacagccaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagaucuuuggaacugcauauggaguuuuguucagcgguguuuccuggaccaugaaaauaggaauaggggcucugcugacauggcuaggauuaaacucaaggagcacgucccuuucgaugacgugcauugcaguuggcuuaguaacgcuauacuuaggagucaugguucaagcggauucaggauguguaauuaauuggaaagguagagaacucaaauguggaaguggcauuuuugucaccaaugaaguucacacuuggacagagcaauacaaauuucaagcugauuccccaaagagacuaucagcagccauugggaaggcaugggaggaggguguguguggaauucgaucagcaacucgucucgagaacaucauguggaagcaaauaucaaaugaauugaaccacaucuuacuugaaaaugacaugaaauucacagugguuguaggagacguugcugggaucuuggcucaagggaaaaaaaugauuaggccacaacccauggaacacaaauacucguggaaaagcuggggaaaggcuaaaaucauaggggcagauguacagaacaccaccuuuaucaucgacggcccaaauaccccagaaugcccugaugaucaaagagcauggaacauuugggaaguugaggauuauggauuuggaauuuucacgacaaacauauggcugaaauugcgugacuccuacacccaggugugugaccaccggcuaaugucagcugccaucaaggacagcaaggcaguucacgcugacaugggguacuggauagaaagugaaaagaacgagaccuggaagcuggcaagagccucuuucauagaagucaaaacauguaucuggccaaaaucucacacucuauggagcaauggaguucuggaaagugaaaugauaauuccaaagaucuauggaggaccaauaucucagcacaacuacagaccaggauauuucacacaaacggcagggccguggcaccuaggcaagcuggaacuggauuuugauuugugugaggguaccacgguuguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuucuucucauaaugggacaagugacauggaaugaucugaucagauuaugcaucaugguuggagccaacgcuuccgacaggauggggaugggaacgacguaccuagcucugauggccacuuuuaaaaugagaccaauguuugcuguagggcuacuauuccgcagacuaacauccagagaaguucuucuucuaacaauuggauugagucuaguggcaucuguggaguuacccaauuccuuggaggagcugggggauggacuugcaaugggcauuaugauuuuaaaauuauugacugacuuccaaucacaucagcugugggcuaccuugcuguccuugacauuuaucaaaacaacguuuuccuugcacuaugcauggaagacaauggcuaugguacugucaauuguaucucucuuccccuuaugccuguccacgaccucccaaaaaacaacauggcuuccggugcuauugggaucucuuggaugcaaaccacuaaccauguuucucauagcagaaaacaaaaucuggggaaggaaaaguuggccccucaaugaaggaaucauggcuguuggaauugucaguaucuuacuaaguucacuccucaaaaaugaugugccgcuagcuggaccacuaauagcuggaggcaugcuaauagcauguuauguuauaucuggaagcucagccgaccuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguugugggacacaccuagcccuccagaaguggaaagagcaguucuugaugaugguaucuauagaaucaugcagagaggacuguugggcaggucccaaguagggguaggaguuuuucaggaaaacguguuucacacaauguggcaugucaccaggggagcuguacucauguaucaagggaagagacuggaaccgagcugggccagugucaaaaaagaccugaucucauauggaggagguuggaggcuucaaggauccuggaacacgggagaagaagugcaggugauugcuguugaaccagggaaaaaccccaaaaauguacaaacagccccgggcaccuuuaagaccccugaaggcgaaguuggagccauugcccuagauuuuaaacccggcacaucuggaucucccaucgugaacagagaagggaaaauaguaggucuuuauggaaauggaguagugacaacaaguggaaccuacgucagugccauagcucaagcuaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcgcacacuaauucuggcucccacaaggguugucgcuuccgaaauggcagaggcgcuuaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccagcauagcggcuagaggguacaucucaacccgagugggcaugggugaagcagcugcgaucuucaugacagccacucccccaggaucaguggaggccuuuccacagagcaacgcagcuauccaagaugaggaaagagacauuccugagagaucauggaacucaggcuaugaguggaucacugacuucccaggcaaaacaguuugguuuguuccaagcaucaaaucaggaaaugauauugccaacugcuuaagaaagaaugggaaacgggugauucaauugagcagaaaaaccuuugacacagaguaccaaaaaacaaaaaauaacgacugggacuacgucgucacaacagacaucucugaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaacaaggaaggugaucaguacaucuacaugggacagccuuuaaacaacgaugaagaucacgcucacuggacggaagcaaaaaugcuccuugauaauauaaacacaccagaagggauuaucccagcccucuucgagccggagagagaaaagagugcagcaauagacggggaauacagacugcggggugaagcaaggaaaacguuuguggagcucaugagaagaggagaucuaccugucuggcuauccuacaaaguugccucagaaggcuuccaguacucugauagaagauggugcuuugacggggaaaggaacaaccagguguuggaggagaacauggacguggagaucuggacaaaagaaggagaaagaaagaaacuacgaccccgcuggcuggaugccagaacauacucagacccacuggcccugcgcgaguucaaagaguuugcagcaggaagaagaagcgucucaggugaucuaauauuagaaauagggaaacuuccacaacacuuaacgcaaagggcccagaaugccuuggacaaccugguuauguugcacaauuccgaacaaggaggaagagccuauagacaugcaauggaagaacugccagacaccauagaaacguugaugcuccuagcuuugauagcuguguugacugguggagugacgcuguucuuccuaucaggaaggggcuuagggaaaacaucuaucggccuacucugcgugauggcuucaagcguacugcuauggauggccaguguagagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacugccauugcaaaccaggcagcuaucuugaugggacuugacaaaggauggccaauaucgaagauggacauaggaguuccacuucucgccuuggggugcuauucccaagugaauccacugacgcugacagcggcgguauugaugcuaguggcucauuacgcuauaauuggaccuggacugcaagcgaaagcuacuagagaagcucaaaaaaggacagcggccggaauaaugaaaaauccaacuguugauggaaucguugcaauagauuuggacccugugguuuaugaugcgaaauuugagaaacaacuaggccaaauaauguuguugauacuaugcacaucacagauccuuuugaugcggacuacaugggccuugugcgaauccaucacacuggccacuggaccucugaccacgcucugggagggaucuccaggaaaauuuuggaacaccacgauagcgguuuccauggcaaacauuuucagaggaaguuaucuagcaggagcaggucuggccuucucauugaugaaaucccuaggaggagguaggagaggcacgggagcccaaggggaaacacugggagagaaauggaaaagacagcugaaccaacugagcaagucagaauucaacaccuauaaaaggagugggauuauggaaguggacagauccgaagccaaagagggacugaaaagaggagaaacaaccaaacaugcagugucgagaggaaccgcuaaauugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaagaaccaaucccaauggcgaccuauggauggaaccuaguaaagcugcacuccgggaaagacguauucuuuauaccaccugagaaaugugacacccucuugugugauauuggugaguccucuccaaacccaacuauagaggaaggaagaacgcuacgcguccuaaagaugguggaaccauggcucagaggaaaccaauucugcauaaaaauucugaaucccuacaugccaagugugguggaaacuuuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacauaugaaagagacguggaccuaggcgccggaacaagacauguggcaguggaaccagagguagccaaccuagauauuauuggccagaggauagagaacauaaaacaugaacacaagucaacauggcauuaugaugaggacaauccauauaaaacaugggccuaucauggaucauaugaggucaagccaucaggaucagccucauccauggucaaugguguggugaaacugcucaccaaaccaugggaugucauccccauggucacacaaauagccaugacugacaccacacccuuuggacaacagaggguguuuaaagagaaaguugacacacgcacaccaaaagcaaaacgaggcacagcacaaaucauggaggugacagccaggugguuaugggguuuucuuucuagaaacaagaagccaagaauuuguacaagagaggaguuuacaagaaaaguuaggucaaacgcagccaucggagcaguguucguugacgaaaaucaauggaacucagcaaaagaagcaguggaagaugagcgguucugggaccuugugcacagagagagggagcuucacaaacagggaaaaugugcuacguguguuuacaacaugauggggaagagagagaaaaagcuaggagaauuuggaaaggcaaaaggaagucgcgcaauaugguacaugugguugggagcacgcuuucuagaguucgaagcucuugguuucaugaacgaagaccauugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccaaaauuacugacaucauggaacccgaacaugcccuacuggcuaaggcaaucuucaagcuaaccuaccaaaauaaagugguaaggguacagagaccagcaaaaaauggaaccgugauggaugucauauccagacgugaccagagaggaaguggccaggucggaacuuauggcuuaaacacuuucaccaacauggaagcccagcugauaagacaaauggagucugagggaaucuuuucacccagugaacuagagaccccaaauuuagccgagagaguucucgacuggcuggaaaaauauggcgucgaaaggcuaaaaagaauggcaaucaguggagaugacugcguagugaaaccaauugaugauagguuugcaacagccuuaacagcucugaaugacaugggaaaaguaagaaaagauauaccgcaaugggaacccucaaaaggauggaaugauuggcaacaagugccuuuuuguucacaccacuuccaccagcugaucaugaaggaugggagggaaauaguggugccaugccgcaaccaagaugaacuuguggguagggcuagaguaucacaaggugcuggauggagccugagagaaaccgcaugccuaggcaaaucauaugcacaaauguggcagcugauguacuuccacaggagagaccugagacuagcugcuaaugcuaucuguucagccguuccaguugauugggucccaaccagccguaccaccuggucgauccaugcccaccaccaauggaugacaacagaagacaugcugucaguguggaauagggucuggauagaggaaaacccauggauggaggacaaaacccauauauccaguugggaagauguuccauauuuagggaaaagggaagaucaaugguguggaucccugauaggcuuaacagcaagagccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 6332 - RNA, 9879 nt, Artificial Sequence
  derived and/or modified CDS sequence (wt) from DENV-1__AY835999__SS-prME
ucugugaccaugcuccuuaugcugaugccuacagccuuggcguuccauuugacuacacgagggggagagccgcacaugauagucagcaagcaggaaagaggaaagucacuuuuguucaagaccucagcaggugucaacaugugcacccuuauagcgauggauuugggagaguuaugugaggacacaaugacuuacaaaugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaacugaaacguggauguccucugaaggcgcuuggaaacagauacaaagaguggagacuugggcccugagacacccaggauucacggugauagcccuuuuucuagcacaugccauaggaacauccaucacccagaaagggaucauuuucauuuuguuaaugcugguaacaccauccauggccaugcgaugcgugggaauaggcagcagggacuucguggaaggacugucaggagcaaccuggguagaugugguacuggaacauggaaguugcgucaccaccauggcaaaagacaaaccaacauuggacauugaacucuuaaagacggaagucacaaacccugccguccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuacuaacgugugcuaaguucaagugugugacaaaacuggaaggaaagauaguucaauaugaaaacuugaaauauucaguaauagucaccguccacacuggagaccagcaucaggugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuucuagacuuaccacugccuuggacuucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggacaaacugacucuaaaagggaugucauaugugaugugcacaggcucauuuaagcuagagaaagaaguggcugagacccagcauggaaccguucuagugcagauuaaauaugaaggaacagaugcaccaugcaagaucccuuuuuugacccaagaugaaaaaggaguaacccagaaugggagauugauaacagccaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguucuguaggaggaguguucacgucuguuggaaaauuaguacaccagauuuuuggaacugcauauggaguuuuguucagcgguguuuccuggaccaugaaauuaggaauagggguucugcugacauggcuaggauuaaacucaaggagcacgucccucucgaugacgugcauugcaguuggccuaguaacacuauaccuaggagucaugguucaggcggauucaggaugcguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaccacaucuuacuugaaaaugacaugaaauucacagugguuguaggagauguugcugggaucuugguucaagggaaaaaaaugauuaggccacaacccauggaauacaaauacucguggaaaagcuggggaaaggcuaaaaucauaggggcagauguacagaacuccaccuucaucauugacggcccaaacaccccagaaugcccugaugaccaaagagcauggaacauuugggaaguugaggauuauggauuuggaauuuucacgacaaacauauggcugaaauugcgugacuccuacacccaagugugugaucaccggcuaaugucagcugccaucaaggacagcaaggcaguucacgcugacaugggguacuggauagaaagugaaaagaacgagaccuggaagcuggcaagagccucuuucauagaaguuaaaacauguauuuggccaaaaucccacacucuauggagcaauggaguucuggaaagugaaaugauaauuccaaagaucuauggaggaccaauaucucaacauaacuacagaccaggauauuucacacaaacggcagggccguggcaccuaggcaaauuggaacuggauuuugauuugugugaggguaccacagucguuguggaugaacauuguggaaaucgaggaccaucucuuaggaccacaacagucacaggaaagauaauucaugaaugguguugcagaucuuguacgcuaccacccuuacguuucagaggagaaaaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugaccggaauacuggcuguguucuuccuucucauaaugggacaauugacauggaaugaucugaucagauuaugcaucaugguuggagccaacgcuuccgacagaauggggaugggaacgacguaccuagcucugauggccacuuuuaaaaugagaccaauguuugcuguagggcuauuauuccgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggcuaugguacugucaauuguaucucucuuccccuuaugccuguccacgaccucccagaaaacaacauggcuuccggugcuauugggaucucuuggaugcaaaccacuaaccauguuucuuauagcagaaaacaaaauuuggggaaggaaaaguuggccccucaaugaagggaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacgggagaagaagugcaggugauugcuguugaaccagggaaaaaccccaaaaauguacaaacagcgccgggcaccuuuaagaccccugaaggugaaguuggagccauugcccuagauuuuaaacccggcacaucuggaucucccaucgugaacagagaaggaaaaauaguaggucuuuauggaaauggaguagugacaacaaguggaaccuacgucagugccauagcucaaaccaaagcaucacaagaagggccccuaccagagauugaagacgaaguguuuaggaaaagaaacuuaacaauaauggaccuacauccaggaucgggaaaaacaagaagauaucuuccagccauaguccgugaggccauaaaaaggaagcugcgcacacuaauucuggcucccacaaggguugucgcuuccgaaauggcggaagcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccagcauagcggccagaggguacaucucaacccgagugggcaugggugaagcagcugcaaucuucaugacagccacucccccaggaucaauggaggccuuuccacagagcaacgcaguuauccaagaugaggaaagagacauuccugagagaucauggaacucaggcuaugaguggaucacugacuucccagguaaaacagucugguuuguuccaagcauuaaagcagggaaugacauugccaacugcuuaagaaagaauggaaaacgagugauucaauugagcaggaaaaccuuugauacagaguaccaaaaaacaaaaaauaacgacugggacuacgucgucacaacagacaucuccgaaaugggagcaaauuuucgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauacuagaaauagggaaacuuccacaacacuugacgcaaagggcccagaaugccuuggacaaccuggucauguugcacaacuccgaacaaggaggaagagccuauagacaugcaauggaagaacugccagacaccauagaaacauugaugcuccuggcuuugauagcuguguuaacugguggagugacgcuguucuuccuaucaggaaagggccuagggaaaacaucuaucggccuacucugcgugauggcuucaagcguacugcuauggauggccaguguggagccccauuggauagcggccuccaucauacuggaguucuuccugaugguguugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguggacuuacauccagcuucagccuggacccucuaugcaguggccacaacaauuaucacucccaugaugaggcacacaaucgaaaacacaacggcaaacauuucccugacagccauugcaaaccaggcagccauauugaugggacuugacaaaggauggccaauaucgaagauggacauaggaguuccacuucucgccuuggggugcuauucccaggugaauccacugacgcugacagcggcguuguugaugcuaguggcucauuacgccauaauuggaccuggacugcaagcaaaagcuacuagagaagcucaaaaaaggacagcggccggaauaaugaaaaauccaaccauugauggaauuguugcaauagauuuggacccugugguuuaugaugcaaaauuugagaaacaacuaggccaaauaauguuguugauacuaugcacaucacagauccucuugaugcggacuacaugggcccugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacaccuauaaaaggagugggauuauggaaguggacagauccgaagccaaagagggacugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacuaaaggaggaccuggacaugaggaaccaaucccaauggcgaccuauggauggaaccuaguaaaacugcacuccgggaaagacguauucuuuauaccaccugagaaaugugauacccuuuugugugauauuggugaguccucuccaaacccaacuauagaggaaggaagaacgcuacgcguucuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucauccccauggucacacaaauagccaugacugacacuacacccuuuggacaacagaggguguuuaaagagaaaguugacacacgcacaccaaaagcaaaacgaggcacagcacaaaucauggaggugacagccaggugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugaccgguucugggaccuugugcacagagagagggagcuucacaaacagggaaaaugugccacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuucacaaacuuggauauauacucagagacauaucaaagauuccagggggaaacauguaugcagaugacacagccggaugggauacaaggauaacagaggaugaccuccagaaugaggccaaaauuacugacaucauggaacccgaacaugcccaauuggcuaagucaaucuucaagcuaaccuaccaaaauaaggugguaaggguacagagaccagcaaaaaauggaaccgugauggaugucauauccagacgugaccagagaggaaguggccagguuggaaccuauggcuuaaacacuuucaccaacauggaagcccagcugauaagacaaauggagucugagggaaucuuuucacccaacgaauuagagaccccaaauuuagccgagagaguucucgacuggcuggaaaaauauggcgucgaaaggcugaaaagaauggcaaucagcggagaugacugcguagugaaaccaauugaugauagguucgcgacagccuuaacagcucugaaugauaugggaaaaguaagaaaagacauaccacaaugggaaccuucaaaaggauggaaugauuggcaacaagugccuuuuuguucacaccacuuccaccagcugauuaugaaggaugggagggaaauaguggugccaugccgcaaccaagaugaacuugugggaagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccguauauccaguugggaagauguuccauaucuaggaaaaagggaagaucaaugguguggaucucugauaggcuuaacagcaagggccaccugggccaccaacauacaaguggccauaaaccaagugagaagacuaauugggaaugagaauuauucagauuacaugacaucaaugaagagauucaagaacgagagugaaccagaaggggcacucugguga

SEQ ID NO: 6333 - RNA, 9879 nt, Artificial Sequence
  derived and/or modified CDS sequence (wt) from DENV-1__KP686070__SS-prME
uccgugaccaugcuccucaugcugcugcccacagcccuggcguuccauuugaccacacgagggggagagccacacaugauaguuagcaagcaggaaagaggaaagucacucuuguuuaagaccucugcaggugucaacaugugcacccucauugcaauggauuugggagaguuaugugaggauacaaugaccuacaaaugcccccggaucacugaagcggaaccagaugauguugauugcuggugcaaugccacagacacaugggugaccuaugggacguguucucagacuggcgaacaccgacgggauaaacguucugucgcauuggccccacacguggggcuuggucucgaaacaagaaccgaaacguggauguccucugaaggcgccuggaggcagauacaaaaaguggagacuugggccuugagacacccaggauucacggugauagcccuuuuuuuagcacaugccauaggaacauccauuacccagaaagggaucaucuucauuuugcugaugcuggugacaccaucaauggccaugcgaugcgugggaauaggcaacagagacuucguugaaggacugucaggagcaacauggguggaugugguacuggagcauggaagcugugucaccaccauggcaaagaauaaaccaacauuggacauugaacucuugaagacggaggucacgaacccugccgucuugcgcaaacugugcauugaagcuaaaauaucaaacaccaccaccgauucaagauguccaacacaaggagaagcuacacugguggaagaacaagacgcgaacuuugugugucgacgaacauucguggacagaggcugggguaaugguuguggacuauucgggaagggaagcuuacuaacgugugcuaaguuuaagugugugacaaaacuugaaggaaagauaguucaauaugaaaacuuaaaauauucggugauagucacuguccacacuggggaccagcaccagguaggaaaugagacuacagaacauggaacaauugcaaccauaacaccucaagcucccacgucggaaauacagcugacugacuacggagcccuuacauuggacugcucaccuagaacagggcuggacuuuaaugagauggugcuguugacaaugaaagaaaaaucauggcuuguccacaaacaaugguuucuagacuuaccauuaccuuggaccucgggggcuucaacaucucaagagacuuggaacagacaagaucugcuggucacauuuaagacagcucaugcaaagaagcaggaaguagucguacuggggucacaagaaggagcaaugcacacugcguugacuggggcgacagaaauccagacgucaggaacgacgacaaucuucgcaggacaccugaaauguagacuaaaaauggauaaacugacuuuaaaaggggugucauaugugaugugcacaggcucauuuaagcuagagaaggaaguggcugagacccagcauggaacuguccuagugcagguuaaauaugaaggaacagaugcaccaugcaagauuccaauuucaacccaagaugagaaaggagugacccagaaugggagauugauaacagccaaucccauaguuacugacaaagaaaaaccagucaacauugaaacagaaccacccuuuggugagagcuacaucgugauaggggcgggugaaaaagcuuugaaacuaagcugguuuaagaaaggaagcagcauagggaaaauguucgaagccaccgcccgaggagcacgaaggauggcuauccugggagacacagcaugggacuucgguuccauaggagggguguucacaucugugggaaaauugguacaccagguuuuuggaaccgcauaugggguccuguucagcgguguuucuuggaccaugaaaauaggaauagggauucugcugacauggcuaggauugaauucaaggagcacgucacucucgaugacgugcauugcaguuggcauggucacacuguaccuaggagucaugguucaagcggacucggggugugugaucaacuggaagggcagagaacucaaguguggaaguggcaucuuugucacuaaugaaguccacacuuggacagagcaauacaaauuccaggcugacuccccaaaaagacuaucagcagccauugggaaggcaugggaggaaggcguguguggaauucgaucagccacacgucuugagaacaucauguggaagcaaauaucaaaugaauugaaccacauucuacuugaaaaugacaugaaauucacagugguuguaggagacgccaauggaaucuugacccaaggaaaaaagaugauuaggccacaacccauggaacacaaauacucauggaaaagcuggggaaaagccaaaaucauaggagcagauacacagaauacuaccuucaucaucgauggcccagacacuccagaaugccccgaugaccagagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaacgagaccuggaagcuagcgagagccuccuucauagaagugaagacaugcaucuggccaagaucccacacucuauggagcaauggagucuuggaaagugaaaugauaaucccaaagauauauggaggaccaauaucucagcacaacuacagaccaggguauuucacacaaacagcagggccauggcaccuaggcaaguuggaacuagacuuuaauuugugugaaggcaccacaguuguuguggaugaacauuguggaaaucgagguccaucucuuagaacuacaacagucacaggaaagauaauccaugaauggugcugcagauccugcacgcuaccccccuuacgcuucagaggagaagacggauguugguauggcauggaaaucagaccagucaaggagaaggaagagaaucuagucaggucaauggucucugcagggucaggagaaguggacaguuuuucauugggacuacuaugcguaucaauaaugauugaagaagugaugagauccagauggaguagaaagaugcugaugacuggaacacuggcuguuuucuuccuucuuauaaugggacaacugacauggaaugaucugaucagguuaugcaucaugguuggagccaaugucucagacagaauggggaugggaacaacguaccuagcuuuaauggccacuuuuaaaaugagaccgauguucgcuguugggcuauuauuucgcagacuaacauccagagaggugcuccuucucacaauuggacuaagccugguggcauccguggagcuaccaaauucuuuagaggagcuaggggacggacuugcgaugggcaucaugauguuaaaauuguugacugauuuucagucacaccaguuguggacuaccuuacugucucugacauucaucaaaacaacucuuucacuagauuaugcauggaagacaauggcuaugguauugucaaucguaucucucuuuccucuaugucuauccacgaccucucaaaaaacaacauggcuuccgguguuguuaggauccuuuggauguaaaccacuaaccauguuucuuauaacagaaaacaaaauuuggggaaggaaaaguuggccccucaaugaaggaauuauggcuguuggaauagucagcauuuuacuaaguucacuccucaaaaaugacgugccacuagccggcccacuaauagcuggaggcaugcugauagcauguuacgucauuuccggaagcucagccgauuuaucauuggagagagcggcugaggucuccugggaagaagaagcagaacacucuggugccucacacaacauacuaguggagguccaagaugauggaaccaugaaaauaaaagaugaagagagagaugacacgcucacuauacuccucaaagcaacuuuguuggcaguuucagggguguacccaaugucaauaccagcaacccuuuuugugugguauuuuuggcagaaaaagaaacagagaucaggagucuugugggacacacccagcccuccagaaguagaaagagcaguucuugaugaugguaucuauagaaucuugcaaagaggacuguuggguaggucccagguaggagugggaguuuuucaagacggcguguuccacacaauguggcaugucaccaggggggcuguccucauguaccaagggaagaggcuggaaccaaguugggccagugucaaaaaagacuugaucucauauggaggagguuggagguuucaaggaucauggaacacgggagaagaaguacaggugauagcuguugaaccagggaaaaacccaaagaauguacagacaacgccgggcaccuucaagaccccugaaggcgaaguuggagccauagcccuagauuucaaaccuggcacaucuggaucucccaucgugaacagagaggggaaaauaguaggucuuuauggaaauggaguggugacaacaaguggaaccuacgucagugccauugcccaagcuaaagcgucacaagaagggccucuaccagagauugaggacgagguguuuaagaaaagaaaccuaacaauaauggaccuacauccaggaucaggaaaaacaagaagauaucuuccagccauaguccgugaggccauaaaaaggaaacugcgcacgcuaaucuuggcucccacaagaguugucgccucugaaauggcagaggcgcuuaaaggaaugccaauaagauaucagacaacagcaguaaagagugaacacacaggaaaggagauagucgaucucaugugccacgccacuuucaccaugcgucuccuaucuccagugagaguucccaauuacaacaugauuaucauggaugaagcacacuuuaccgauccagccagcauagcggccagaggguacaucucaacccgaguggguaugggugaagcagcugcgaucuucaugacagccacucccccaggaucgguagaggccuuuccacagagcaaugcaguuauccaagaugaggaaagagacauuccugagagaucauggaacucaggcuacgacuggaucacugacuucccaggaaaaacagucugguuuguuccaagcaucaaaucaggaaaugacauugccaacugcuuaagaaaaaacgggaaacgggugauccaauugagcagaaaaaccuuugacacugaauaccagaaaacgaaaaacaaugauugggacuauguugucacaacagacauuuccgaaaugggagcaaauuuccgggccgauaggguaauagacccaaggcggugcuugaagccgguaauacuaaaagauggcccagagcgcgucauucuggccggaccaaugccagugaccgcggccagugcugcccagaggagaggaagaauuggaaggaaccaaaacaaggaaggugaccaguauauuuacaugggacagccuuuaaauaaugaugaggaccacgcucauuggacagaagcaaaaaugcuccuugacaauauaaauacgccagaagggauuaucccagcccucuuugagccagagagagaaaagagugcagcaauagacggggaguauagacugcggggagaagcaaggaaaacguucguggagcuaaugagaagaggggaucuaccaguuuggcuaucuuacaaaguugccucagaaggcuuccaguacuccgacagaagauggugcuuugacggggaaaggaacaaccagguguuggaggagaacauggacguggagaucuggacaaaagaaggagaaagaaagaaauugcgaccucgcugguuagaugccagaaccuacucugauccacuggcccugcgcgaguuuaaggaguucgcagcaggaagaagaagugucucaggugaccuaauauuagaaauagggaaacucccacagcauuugacgcuaagggcccagaaugcuuuggacaacuuggucauguugcacaauuccgaacaagggggaaaagccuauagacaugcuauggaagaacuaccagacaccauagaaacauugaugcuacuagccuugauagcugugcugacugguggaguuacguuguuuuuccuaucaggaaaaggucuagggaaaacauccauuggccuacuuuguguaauggccucaaguguacuguuauggauggccaguguggagccccauuggauagcggccuccaucauacuagaguuuuuucugauggugcugcuuauuccagagccagacagacagcguacuccacaggacaaucaacuagcauauguggugauagguuuguuauucaugauauugacaguggcagccaaugagaugggauuacuggaaaccacaaagaaagaccuggggauuggccauguagucgccgaaaaccaccaccaugccacaaugcuagacauagacuuacauccagcuucagccuggacccucuaugcaguagccacaacaauuaucacucccaugaugagacacacaauugaaaacacaacggcaaacauuucccugacagcuauugcaaaucaggcggcuauauuaaugggacuugacaagggauggccaauaucgaagauggacauaggagugccacuucucgccuuagggugcuauucccaggugaacccauugacacugacagcggcggugucaauguuaguggcucauuaugccauaauuggaccuggacugcaagcaaaagcuaccagagaagcccaaaaaaggacugcggccggaauaaugaaaaauccaacuguagacgggauuguugcaauagauuuggauccugugguuuaugaugcaaaauuugaaaaacagcuaggccaaauaauguuacuaauacucugcacaucacagauucucuugaugcggacuacaugggccuuaugugaaucuaucacacuggcuacuggacccuugaccacucucugggagggaucuccuggaaaauucuggaauaccacgauagcaguguccauggcaaacaucuucaggggaaguuauuuagcaggggcaggucuggccuucucauuaaugaaaucuuuaggaggagguaggagagguacgggagcucaaggggaaacauugggagaaaaauggaaaagacaacuaaaccaacugagcaagucagaauuuaacacuuacaaaaggaguggaauuauggagguggacagauccgaagccaaggagggacugaaaagaggagaaacaaccaaacaugcagugucgagaggaacagccaaacuuaggugguuuguggagaggaaccuugugaaaccggaagggaaagugauagaccucgguuguggaagagguggcuggucauauuacugcgcugggcugaagaaggucacagaaguaaagggauacacaaaaggaggacccggucaugaggaaccuaucccaauggcgacuuauggauggaacauagugaagcuacacucuggaagggauguauucuuuacaccaccugagaaaugugacacccuuuugugugauauuggugaguccucuccgaauccaacuauagaagaaggaagaacguuacguguucuaaagaugguggaaccauggcucagaggaaaucaguuuugcauaaaaauccuaaauccuuauaugccaagugugguagaaacucuggagcaaaugcaaagaaaacauggagggaugcuagugcgaaacccacucucaagaaauuccacccaugaaauguacugggucucauguggaacaggaaacauugugucggcagugaacaugacauccagaaugcugcugaaucgguucacaauggcucacaggaagccaacguaugaaagagacguggacuugggcgcuggaacaagacauguggcaguggaaccagagauagccaaccuagacauuauuggccagaggauagagaacauaaaaaaugaacauaagucaacauggcauuaugaugaggacaauccauacaaaacaugggccuaucauggaucauaugaggucaagccaucagggucagccucauccauggugaauggcguggugagauugcucaccaagccaugggauguuauccccauggucacacaaauagcuaugacugauaccacacccuucggacaacagaggguuuucaaagagaaaguugacacacgcacaccaagaccaaaacgaggcacagcacaaauuauggaggugacagccaagugguuguggggauuccucucuagaaauaaaaaacccagaaucugcacaagagaggaguucacaagaaaaguuaggucaaacgcagcaauuggagcaguguuuguugaugaaaaccaauggaacucagcaaaagaagcaguggaagacgaaagguuuugggaccucgugcacagagagagggagcuucauaaacagggaaaaugugccacgugugucuacaauaugauggguaaaagagagaaaaaacuaggagaguuuggaaaggcaaaaggaagucgugcaauaugguacaugugguugggagcacgcuuucuagaauuugaagcccuuggcuucaugaaugaagaccacugguucaguagggagaauucacucaguggaguggaaggagaaggacuacauaaacuuggauacauacucagagacauaucaaagauuccagggggaaauauguaugcagacgacacagcuggaugggacacaagaauaacagaggaugaucuccagaaugaggcuaaaaucaccgacaucauggagccugaacaugcucuacuggcuacgucaaucuucaagcugaccuaucaaaauaaggugguaagggugcaaagaccagcaaaaaguggaaccgugauggacgucauauccagacgugaccagagaggaaguggacaggucggaacuuauggccuaaacacuuucaccaacauggagguccaacuaauaagacaaauggaaucugaaggaaucuuuucacccagcgaauuggaaaauucaaaucuagcugagagaguucucgacugguuggaaaaacauggcgucgaaagguugaaaagaauggcaaucagcggagaugacuguguggugaaaccaacugaugacagguucgcaacagcuuuaacagcccugaaugacaugggaaaggugagaaaagacauaccgcaaugggaaccuucaaaaggauggaaugacuggcagcaagugccuuucuguucacaccacuuccaccaacugauuaugaaggaugggagggagauaguggugccaugccgcaaccaagaugaacuugugggcagggccagaguaucacaaggcgccggguggagccugagagaaacugcuugccuaggcaagucauaugcacaaauguggcagcugauguacuuccacaggagagaccugagacuggcggcuaaugcuaucuguucagccguuccaguuaauugggucccaaccagccgcaccaccuggucgauccaugcccaccaucaauggaugacaacagaagacauguugucaguauggaauaggguuuggauagaggaaaacccauggauggaggacaaaacucauguauccagcugggaagauguuccauacuuaggaaaaagggaagaucaaugguguggaucucugauaggcuuaacagcaagagccaccugggccaccaacauacaaguggccauaaaccaagugagaaggcuuauugggaacgagaauuauuuagacuacaugacaucaaugaagagauucaagaaugagagugaucccgaaggagcccucugguaa

SEQ ID NO: 6334 - RNA, 9876 nt, Artificial Sequence
  derived and/or modified CDS sequence (wt) from DENV-1__KF672760__SS-prME
uccgugaccaugcuccucaugcugcugcccacagcccuggcguuucauuugaccacacgagggggagagccacacaugauaguuaguaagcaggaaagaggaaagucacucuuguuuaagaccucugcgggcgucaauaugugcacccucauugcgauggacuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagagaaacguuccguggcacuggccccacacgugggacuuggucuagaaacaagaaccgaaacauggauguccucugaaggcgccuggaaacaaauacaaagaguggaaacuugggcuuugagacacccaggauucacggugauagcuuuuuuuuuagcgcaugcuauaggaacauccaucacucaaaaagggaucauuuucaucuugcugaugcuggugacaccaucaauggccaugcgaugcgugggaauaggcaacagagacuucguugaaggacugucaggagcaacguggguggacgugguauuggagcauggaagcugcgucaccaccauggcaaaaaauaaaccaacauuggacauugaacucuugaagacggaggucacgaacccugccgucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcugggguaauggcuguggacuauucggaaagggaagucuauugacgugugccaaguucaagugugugacaaaacuagagggaaagauaguucaauaugaaaacuuaaaauauucagugauagucacuguccacacuggggaccagcaccaggugggaaacgagaccacagaacauggaacaauugcaaccauaacaccucaagcucccacgucggaaauacagcugacugacuacggagcccucacacuggacugcucaccuagaacagggcuggacuuuaaugagauggugcuauugacaaugaaagaaaaaucauggcuuguccacaaacaaugguuucuagacuuaccacugccauggacuucgggggcuucaacaucucaagagaccuggaacagacaagauuugcuggucacauucaagacagcucaugcaaagaaacaggaaguagucguacugggaucacaggaaggagcaaugcacacagcguugacuggggcgacagaaauccagacgucaggaacgacaacaaucuucgcaggacaccugaaaugcagacuaaaaauggauaaacugaccuuaaaggggaugucauaugugaugugcacaggcucauuuaagcuagagaaggaaguggcugagacccagcauggaacuguccuagugcaggucaaauaugaaggaacagacgcgccaugcaagaucccuuucucgacccaagaugagaaaggagugacccagaaugggagauugauaacagccaaucccauaguuacugacaaagaaaaaccagucaacauugagacagaaccaccuuuuggugagagcuacaucgugguaggggcaggcgaaaaagcuuugaaacuaagcugguucaagagaggaagcagcauagggaaaauguucgaagcaaccgcccgaggagcacgaaggauggcuauccugggagacaccgcaugggacuucgguucuauaggaggaguguuuacaucugugggaaaauugguacaucagguuuuuggaaccgcauaugggguucuguuuagcgguguuucuuggaccaugaaaauaggaauagggauucugcugacaugguugggauuaaauucaaggagcacgucacuuucgaugacgugcauugcaguuggcauggucacacuguaccuaggagucaugguucaagcggauucgggauguguaaucaacuggaagggcagagaacuuaaauguggaaguggcauuuuugucacuaaugaaguccacacuuggacagagcaauacaaauuccaggcugacuccccaaaaagacugucagcagccauuggaaaggcaugggaggagggcguaugugggauucgaucagccacgcgucuugagaacaucauguggaagcaaauaucaaaugaauugaaccacauucuacuugagaaugacaugaaauucacagugguuguaggagaugccaacggaauuuuggcccaagggaaaaaaaugauuaggccacaaccuauggaacacaaauauucauggaaaagcuggggaaaagcuaaaaucauaggagcagacauacaaaauaccaccuucaucaucgacggcccagacaccccagaaugucccgauggccaaagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaaugaaaccuggaagcuggcgagagccuccuucauagaagucaagacaugcaccuggccgaaaucucacacucuauggagcaauggagucuuggaaagugaaaugauaaucccaaagauauuuggaggaccaauaucucagcacaacuacagaccaggguauuucacacaaacagcagggccauggcaccuagguaaguuggaacuggauuuugauuugugugaagguaccacaguuguuguggaugaacauuguggaaaucgagguccaucucucagaaccacaacagucacaggaaagauaauccaugaaugguguugcagauccugcacgcuaccccccuuacguuucagaggagaagacggguguugguauggcauggaaaucagaccaguaaaggagaaggaggagaaucuagucaggucaauggucucugcagggucaggagaaguggauaguuuuucauuaggaauacuaugcgugucaaugaugauugaagaagugaugagauccagauggaguagaaagaugcugaugacuggaacacuggcuguuuuccuccuucuuauaaugggacaacugacauggaaugaucugauuagguuaugcaucaugguuggagcuaacgcuucagacaggauggggaugggaacaacguaccuagccuugauggcuacuuuuaaaaugagaccaauguucgcuguugggcuauuauuccgcagacuaacauccagagaaguucuucuccucacgauuggauuaagccugguggcaugcguggagcuaccaaauucuuuggaggagcuaggggauggacuugcaauggguaucaugauguuaaaauuguugacugaauuucagccacaccaguuauggaccaccuuauugucucugacauuugucaaaacaacucucucacuggauuaugcauggaaaacaacggcuaugguacugucuaucguaucucucuuuccuuuaugccugucuacaaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaagcucacuccucaaaaaugaugugccguuggccgggccacuaauagcuggaggcaugcuaauagcauguuaugucauauccggaagcucagccgauuuaucauuggagaaagcggcugaaguauccugggaacaagaagcagaacacuccggugccucacacaacauauuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguacuuuuggcagaaaaagaaacagagaucaggaguguuaugggacacacccagcccuccggaaguggaaagagcaguucuugaugauggcaucuauagaaucuugcaaagaggacuguuggggaggucccaaguaggagugggagucuuccaagacggcguguuucacacaauguggcacguuaccaggggagcuguccuuauguaccaagggaagagacuggaaccaagcugggccagugucaaaaaggacuugaucucauauggaggagguuggagguuccaaggaucauggaacacaggagaagaagugcaggugauagcuguugaaccaggaaaaaaccccaaaaauguacagacaacgccgggcaccuucaagacuccugaaggcgaaguuggagccauagcucuagauuucaaacccggcacaucuggaucucccauugugaacagagagggaaaaauagugggucuguauggaaauggaguggugacaacaaguggaaccuacguuagugccauugcccaagcuaaagcaucacaggaagggccucuaccagagauugaggacgagguguuuaagaaaagaaacuuaacaauaauggaccugcacccaggaucagggaaaacaagaagauaccuuccagccauaguccgugaggccauaaaaaggaaacugcguacguuaaucuuggcucccacaagaguugucgccucugaaauggcagaggcacucaagggaaugccaauaagauaucagacaacagcagugaagagugaacacacaggaagggagauaguugaccucaugugccacgcuacuuuuaccaugcgucucuuauccccagugagaguucccaauuacaacaugauuauuauggaugaagcacauuuuaccgauccagcuagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggauuacugacuuuccagguaaaacagucugguuuguuccaagcauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuucugaaaugggggcaaauuuccgggccgacaggguaauagacccaaggcggugcuugaaaccgguaauacuaaaagauggcccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccuuuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcgaccucgcugguuggacgccagaacauacucugauccauuggcccugcgcgaguuuaaagaguucgcagcaggaagaagaagugucucaggugaccuaauauuggaaauagggaaacuuccacaacauuugacgcuaagagcccagaaugcucuggacaacuuggucauguugcacaauuccgaacaaggaggaaaagccuacagacaugcuauggaggaacuaccagacaccauagaaacauugaugcuucuagcuuugauagcuguguugacugguggagugacgcuguucuuccuaucaggaaaaggucuagggaaaacauccauuggcuugcucugugugacggccucaagcgcacuguuauggauggccaguguagagccccauuggauagcggccuccaucauacuagaguucuuuuugauggugcugcucauuccagaaccagacagacagcgcacuccacaggacaaccagcuagcauauguggugauagguuuguuauucaugauacugacaguggcagccaaugagaugggauuauuggaaaccacaaagaaagaccuggggauuggcuauguagccgccgaaaaccaccaacaugcuacgaugcuggacguagaccuacacccagcuucagccuggacccucuaugcaguagccacaacaguuaucacucccaugaugagacacacaauugaaaauacaacggcaaacauuucccugacagccauugcaaaucaggcagccauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacauuggcuacuggaccccugaccacucucugggagggaucuccaggaaaauucuggaauaccacaauagcaguguccauggcaaacaucuucaggggaaguuauuuagcaggagcaggucuggcuuucucauuaaugaaaucuuuaggaggagguaggagagguacgggagcucaaggggaaacauugggagagaaauggaaaagacaguuaaaccaacugagcaagucagaauucaacaccuacaaaaggagugggauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaaguuacugaagugaagggauacacaaaaggaggaccuggacaugaggaaccuaucccaauggcgaccuauggauggaaccuaguaaagcuacacucuggaaaggauguauuuuuuaugccaccugagaaaugugacacccuucugugugauauuggugaguccucuccgaauccaacuauagaagaaggaagaacguuacguguucuaaaaaugguggaaccauggcucagaggaaaccaauucugcauaaaaauccuaaauccuuacaugccaagugugguagaaacucuggagcgaaugcaaagaaaacauggagggaugcuagugcgaaacccacucucaagaaauucuacccaugaaauguauuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugacugauaccacacccuuuggacaacagagaguguuuaaagagaaaguugacacgcgcacaccaagagcaaaacgaggcacaacacagauuauggaggugacagccaagugguuaugggguuuccuuuccagaaacaaaaaacccagaaucugcacaagagaggaguucacaagaaagguuaggucaaacgcggcaauaggagcaguguucguugaugaaaaccaauggaacucagcaaaagaagcaguggaagacgaaagguuuugggaucuugugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaagcccuugguuuuaugaaugaagaucacugguuuaguagagagaauucacucaguggaguggaaggagaaggacugcacaaacuuggauacauacucagagacauaucaaagauuccggggggaaauauguaugcagaugauacggccggaugggacacaagaauaacagaggaugaucuucagaaugaggcuaaaaucacugacaucauggagccugaacaugcucuauuggcuacgucaauuuuuaagcugacuuaucaaaacaagguggugagggugcaaagaccagcaaaaaauggaaccgugauggauguuauauccagacgugaucagagaggaaguggacaggucggaacuuauggcuuaaauacuuucaccaauauggagguccaacuaauaagacaaauggaaucugaaggaaucuuuuuacccagcgaauuggaaacccccaaccuagcugagagggcucuugacugguuagaaaaacauggcgccgaaaggcugaaacgaauggcaaucagcggagaugauugcguggugaaaccaauugacgacagguucgcaacagccuuaacagcucugaaugacaugggaaaaguaagaaaagacauaccgcagugggaaccuucgaaaggauggaaugauuggcagcaagugccuuuuuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuagcggcuaacgcuaucugcucagccgucccaguugauugggucccagccagccgcacaaccuggucaauccaugcccaccaccaauggaugacaacagaagacauguuaucaguguggaauagaguuuggauagaggaaaacccauggauggaggacaaaacucauguauccaguugggaagaaguuccauaccuaggaaaaagggaagaccaaugguguggaucccugauaggcuugacagcgagggccaccugggccaccaacauacaaguagccauaaaccaagugagaaggcucaucgggaaugagaauuauuuagauuacaugacaucaaugaagagauucaagaaugagagugaucccgaaggagcacucugg

SEQ ID NO: 6335 - RNA, 9876 nt, Artificial Sequence
  derived and/or modified CDS sequence (wt) from DENV-1__KF672759__SS-prME
uccgugaccaugcuccucaugcugcugcccacagcccuggccuuccauuugacuacacgagggggagagccacacaugauagucagcaagcaggaaagaggaaagucacucuuguuuaagaccucuguaggugucaacaugugcacucucauugcgauggauuugggagaguuaugugaggacacaaugaccuacaaaugcccccggaucacugaggcggaaccagaugauguugacugcuggugcaaugccacagacacaugggugaccuaugggacguguucucaaaccggcgaacaccgacgagacaaacguuccgucgcacuggccccacacgugggacuuggucuagaaacaagaacugaaacguggaugucaucugaaggcgccuggaaacaaauacaaaaaguggagacuugggcuuugcgacacccaggauucacggugauagcccuuuucuuggcacaugccauaggaacauccaucacccagaaagggaucauuuucauuuugcugaugcugguaacaccaucaauggccaugcgaugcgugggaauaggcaauagagacuucguugaaggacugucaggagcaacguggguggacgugguacuggagcauggaagcugcgucaccaccauggcaaaaaacaaaccaacauuggacauugaacucuugaaaacggaggucacgaacccugccguccugcgcaaacugugcauugaagccaaaauaucaaacaccaccaccgauucaagauguccaacacaaggagaagccacacugguggaagaacaagacgcgaacuuugugugucgacggacguucguggacagaggcugggguaauggcugcggacuauuuggaaaaggaagucuacugacaugugcuaaguucaagugugugacaaaacuagaaggaaagauaguucaauaugaaaacuuaaaauauucagugauagucacuguccacacuggggaccagcaccagguaggaaacgagacuacagaacauggaacaauugcaaccauaacaccucaagcuccuacgucggaaauacagcugaccgacuacggagcccucacauuggacugcucaccuagaacugggcuggacuuuaaugagauggugcuacugacaaugaaagaaaaaucauggcuuguccacaaacaaugguuucuagacuuaccacugccuuggacuucgggagcuucaacaucccaagagacuuggaacagacaagauuugcuggucacauucaagacagcucaugcaaagaaacaggaaguagucgugcugggaucacaggaaggagcaaugcacacugcgcugacuggggcgacagaaauccagacgucaggaacgacaacaauuuuugcgggacaccugaaauguagacuaaaaauggacaaacugacuuuaaaagggaugucauaugugaugugcacaggcucauuuaagcuagagaaggaaguggcugagacccagcauggaacuguuuuagugcagguuaaauacgaaggaacagaugcaccaugcaagaucccuuuuuugacccaagaugagaaaggagugacccagaaugggagauugauaacagcuaauccuauaguuacugauaaagaaaaaccagucaacauugagacagaaccaccuuuuggugagagcuacaucgugguaggggcaggugaaaaagcuuugaaacuaagcugguucaagaaaggaagcagcauagggaaaauguucgaagcaaccgcccgaggagcacgaaggauggccauccugggagacacugcaugggacuucggcucuauaggaggauuguucacgucugugggaaaauugauacaccagguuuuuggaacugcauaugggguucuguucagcgguguuucuuggaccaugaaaauaggaauagggauucugcugacaugguugggauuaaauucaaggagcacgucacuuucaaugacgugcauugcaguuggcauggucacacuguaccuaggagucaugguucaagcggacucgggaugugugaucaacuggaagggcagagaacucaaauguggaaguggcaucuuugucacuaaugaaguccacacuuggacagagcaauauaaauuccaggcugacuccccaaaaagacugucagcagccauugggaaggcaugggaggaaggcguguguggaauucgaucagccacgcgucuugagaacaucauguggaagcaaauaucaaaugaauugaacuacauccuacuugaaaaugacaugaaauucacagugguuguaggagacguuaauggaauuuuggcccaagggaaaaaaaugauuagaccacaacccauggaacacaaauacucauggaaaaguuggggaaaagccaagaucauaggagcagacauacagaacaccaccuuuaucauugacggcccagauacuccagaaugccccgaugaccaaagagcauggaacauuugggaaguugaggacuacggguucggaauuuucacgacaaacauauggcugaaauugcgugacucccacacccaaaugugugaccaucggcuaaugucagcugccaucaaggacagcaaagcaguccaugcugauaugggguacuggauagaaagugaaaagaacgagaccuggaagcuagcgagagccuccuuuauagaagucaagacaugcaucuggccgaaaucccacacucuauggaguaauggaguuuuggaaagugaaaugguaaucccaaagauauauggaggaccaauaucucagcacaacuacagaccaggguauuucacacaaacagcagggccauggcaccuaggcaaguuggaauuggauuuugacuugugugaagguaccacaguuguuguagaugaacauuguggauaucgaggcccaucucucagaacuacaacaguuacaggaaagauaauccaugaaugguguugcagauccugcacguuaccccccuuacgcuucagaggagaagacggauguugguauggcauggaaaucagaccaguuaaggagaaggaggagaaccuaguuaggucaauggucucugcagggucaggagaaguggacaguuuuucauuaggaauacuaugcguaucaauauugauugaagaaguaaugagauccagauggaguagaaagaugcugaugacuggaacacuggcuguuuuccuccuucucauaaugggacaacugacauggaaugaucugaucagguuaugcaucaugguuggagccaaugcuucagacaggauggggauggggacaacguaccuagccuugauggccacuuucaaaaugagaccaauguucgcuguugggcuauuauuucgcagacuaacaugcagagaaguucuucuucucacgguuggauuaagccugguggcauccguggagcuaccaaauucuuuagaggagcuaggggauggacuugcaaugggcaucaugauguuaaaauuauugacugacuuccagccacaccaguuauggaccacccuauugucucuaacauuuaucagaacaucucuuucauuggauuaugcauggaagacaauggcuauggcacugucaaucguaucucucuuuccuuugugucugucuacgaccucccaaaaaacaacauggcuuccggugcuguuaggaucuuuuggauguaaaccauuaaccauguuucucauaacagaaaacaaaaucuggggaaggaaaagcuggcccaucaaugaaggaauuauggcuguuggaauagucagcauccuacuaaguucacuccucaaaaaugaugugccgcuagccggcccacuaauagcuggaggcaugcuaauagcauguuaugucauaucuggaagcucagcugauuuaucauuggaaaaagcggcugagguauccugggaagaagaagcagaacacuccggcaccucacacaacauauuaguggagguccaagaugauggaacuaugaaaauaaaagaugaagagagggaugauacacucaccauacuccucaaagcaacucugcuggcagucucaggaguguacccaaugucaauaccggcaacucuuuuugugugguauuuuuggcagaaaaagaaacagagaucaggaguguuaugggacacacccagcccuccgaaaguggagagggcaguucuugaugauggcauuuauagaaucuugcaaagaggacuguuggguaggucccaaguaggagugggaguuuuccaagacggcguguuccacacaauguggcacgucaccaggggagcuguccuuauguaccaagggaagaggcuggaaccaagcugggccagugucaaaaaagacuugaucucauacggaggagguuggagguuucaaggaucauggaacacgggagaagaagugcaggugauagcuguugaaccaggaaaaaaccccaaaaauguacagacaacgccggguaccuucaagacuccugaaggcgaaguuggagccauagcucuagauuuuaaacccggcacauccggaucucccaucgugaacagagagggaaaaauaguaggucuuuauggaaauggaguggugacaacaaguggaaccuacgucagugccaucgcucaagcuaaagcaacacaagaagggccucuaccagagauugaggacgagguguuuaagaaaagaaacuuaacaauaauggaccugcauccaggaucagggaaaacaagaagauaucuuccagccauaguccgugaggccauaaaaaggaagcugcgcacgcuaaucuuggcucccacaagaguugucgccucugaaauggcagaggcgcucaagggaaugccaauaagauaccagacaacagcagugaagagugaacauacaggaagggagauaguugaccucaugugccaugccacuuuuaccaugcgucucuuaucuccagugagaguucccaauuacaacaugauuaucauggaugaagcacacuuuacugauccagccagcauagcagccagaggguacaucucaacccgagugggcaugggugaagcagcugcgaucuucaugacagccacucccccaggaucgguggaggccuuuccacagagcaaugcaguuauccaagaugaggaaagagacauuccugagagaucauggaacucaggcuacgacuggaucacugauuuuccagguaaaacaguuugguuuguuccaagcaucaaaucaggaaaugacauugcuaacuguuuaagaaagaacggaaaacgggugauucaacugagcaggaaaaccuuugacacugaguaccagaaaacaaaaaacaaugacugggacuacguugucacaacagacauuuccgaaaugggagcaaauuuccgggccgacaggguaauagauccaaggcggugcuugaaaccgguaauacuaaaggaagguccagagcgcguuauucuagccggaccgaugccagugacuguggccagugccgcccagaggagaggaagaauuggaaggaaccaaaacaaagaaggugaucaguacauuuacaugggacagccuuuaaauaaugaugaggaucacgcucauuggacagaagcaaaaaugcuccuugacaauauaaacacaccagaagggaucaucccagcccucuuugagccagagagagaaaaaagugcagcaauagacggggaguacagacugcggggagaagcaaggaaaacguucguggagcucaugagaagaggagauuuaccaguuuggcuauccuacaaaguugccucagaagguuuccaauacuccgacagaagauggugcuuugauggggaaaggaauaaccagguguuggaggagaacauggacguggagaucuggacaaaggaaggagaaagaaagaaauugcgaccccgcugguuggaugcuagaacauacucugacccacuggcccugcgcgaguuuaaagaguuugcagcaggaagaagaagugucucaggugaccuaauauuggaaauaggaaaacuuccacaacauuugacgcuaagagcccagaaugcucuggacaacuuggucauguugcacaauuccgaacaaggaggaaaagccuacagacaugcuauggaagaacuaccagacaccauagaaacauugaugcuccuagcuuugauagcugugcugacugguggagugacgcuguucuuccuaucaggaaaaggucuagggaaaacauccauuggccuacucugugugauggccucaagcgcacuguuauggauggccaguguggagccccauuggauagcggcuuccaucauauuagaguucuuucugauggugcugcucauuccagagccagacagacagcgcacuccacaggacaaccaguuagcauauguggugauagguuuguuauucaugauacugacaguggcagcuaaugagaugggauuguuggaaaccacaaagaaagaccuagggauuggccauguagccgucgaaaaccaccaccaugccacaaugcuggacguagaccuacguccagcuucagccuggacccucuaugcaguagccacaacaguuaucacccccaugaugagacacacaauugaaaauacaacggcaaauauuucccugacagccaucgcaaaccaggcugcuauauugauggggcuugauaagggauggccaauaucgaagauggauauaggaguuccacuucucgccuuagggugcuauucccaggugaacccauugacacuaacagcggcgguguugauguuaguggcucauuaugccauaauuggaccaggacugcaagcaaaggccacuagagaagcucaaaaaaggacagcggccggaauaaugaaaaauccaaccguagacgggauugucacaauagacuuggauccugugguuuaugaugcaaaauuugaaaaacagcuaggucaaauaauguuacugauacuuuguacaucacagauucucuugaugcggaccacaugggccuugugugaauccaucacacuggcuacuggacccuugaccacucuuugggagggaucuccaggaaaauucuggaacaccacgauagcaguguccauggcaaacaucuucaggggaaguuaucuagcaggagcaggucuggccuucucguugaugaagucuuuaggaggagguaggagaggaacgggagcucaaggggaaacacugggagaaaaauggaaaagacagcuaaaucaacugagcaagucagaauuuaacaccuacaaaaagagugggauuauggagguggacagauccgaagcuaaagagggauugaaaagaggagaaacaaccaaacaugcagugucgagaggaacagccaaacugaggugguuuguggagagaaaccucgugaaaccagaagggaaagucauagaccucgguugugggagaggugguuggucauauuacugcgcugggcugaagaaagucacugaagugaagggauacacaaaaggaggaccuggacaugaggaacccaucccaauggcgaccuauggauggaacuugguaaagcuacacucugggaaagauguauucuucacaccaccugagaaaugugacacccuuuugugugacauuggugaguccucuccaaauccaacuauagaagaaggaagaacauuacguguucuaaagaugguggaaccauggcuuagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguagccaaccuagauaucauuggccagaggauagagaacauaaaaaaugaacauaagucaacauggcauuaugaugaagacaauccauacaaaacaugggccuaucauggaucauaugaggucaaaccaucaggaucagccucauccauggugaauggcguggugagauugcucaccaaaccaugggauguuauccccauggucacacaaauagcuaugacugauaccacacccuucggacaacagaggguguuuaaagagaaaguugacacgcgcacaccaagagcaaaaagaggcacagcacaaaucauggaggugacagccaagugguuaugggguuuccuauccagaaacaaaaaacccagaaucugcacaagagaggaguucacaagaaaaguuaggucaaacgcagcaauaggagcaguguuuguugaugaaaaccaauggaacucagcaaaagaagcaguggaagacgaaagguuuugggaucucgugcacagagagagggagcuucauaaacagggaaaaugugccacguguguuuacaauaugauggggaagagagaaaaaaaauuaggagaguucggaaaagcaaaaggaagucgugcaauaugguacauguggcugggagcacgcuuucuagaguuugaagcccuugguuucaugaaugaagaucacugguucaguagagagaauucacucaguggaguggaaggagaaggacugcacaaacuuggauacauacucagagacauaucaaagauuccggggggaaauauguaugcagaugacacagccggaugggacacaagaauaacagaggaugaucuucagaaugaggcuaaaaucacugacaucauggagccugaacaugcucuauuggccacgucaauuuuuaaacugaccuaccaaaauaagguggugagggugcaaagaccagcaaaaagugggaccgugauggaugucauauccagacgugaccagagaggaaguggacaggucggaacuuauggcuuaaauacuuucaccaauauggagguccaauuaauaagacaaauggagucugaaggaauuuucucacccagcgaauuggaaacccccaaucuagcuaagaaaguucuugacuggcuggaaaaacauggcgcugaaaggcugaaaagaauggcaauuagcggagaugauuguguggugaaaccaauugaugacagguucgcaacagccuuaacagcuuugaaugauaugggaaaaguaagaaaagacauaccgcagugggaaccuucaaaaggauggaaugacuggcagcaagucccuuucuguucacaccacuuccaucagcugaucaugaaagauggaagagaaauaguggugccaugccgcaaccaagaugaacuugugggcagggcuagaguaucacaaggcgcuggauggagccugagagaaacugcuugccuaggcaagucauaugcacaaauguggcagcugauguacuuucacaggagagaccugagacuagcggcuaaugcuaucuguucagccgucccaguugauugggucccaaccagccgcaccaccuggucgauccaugcccaccaccaauggaugacaacagaagacauguuaucaguguggaauaggguuuggauagaggaaaacccauggauggaagacaaaacucauguauccaguugggaagaaguuccauaccuagggaaaagggaagaucaaugguguggauccuugauagguuugacagcaagggccaccugggccacuaauauacaaguagccauaaaccaagugagaaggcuuaucgggaaugagaauuaucuagauuauaugacaucaaugaagagauucaagaaugagagugaucccgaaggggcacucugg

SEQ ID NO: 6336 - RNA, 9876 nt, Artificial Sequence
  derived and/or modified CDS sequence (wt) from DENV-1__KF672761__SS-prME
uccgugaccaugcucuucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggauuugggagaguuaugugaggacacaaugaccuacaaaugcccccggaucacugaggcggaaccagaugacguugacugcuggugcaaugccacagacacaugggugaccuaugggacguguucucaaaccggcggacaccgacgagacaaacguuccguggcacuggccccacacgugggacucggucuagaaacaagaaccgaaacauggauguccucugaaggcgccuggaaacaaauacaaaaaguggagacuugggcuuugagacacccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucaccaccauggcaaaaaauaaaccaacauuggacauugaacucuugaagacggaggucacgaacccugccgucuugcgcaaacugugcauugaagcuaaaauaucaaacaccaccaccgauucaagauguccaacacaaggagaggcuacacugguggaagaacaagacgcgaacuuugugugucgucgaacguuuguggacagaggcugggguaacggcugcggacuauucggaaaaggaagccuauugacgugugccaaguucaagugugugacaaaacuagaaggaaagauaguucaauaugaaaacuuaaaauauucagugauagucacuguccacacuggggaccagcaccaggugggaaacgagacuacagaacauggaacaauugcaaccauaacaccucaagcuccuacgucggaaauacagcugacugacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagacuuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaccugaaaugcagauuaaaaauggauaaacugacuuuaaaggggacgucauaugugaugugcacaggcucauuuaagcuagagaaggaaguggcugagacccagcauggaacuguucuagugcaggucaaauacgaaggaacagaugcgccaugcaagauccccuuuucgacccaagaugagaaaggagugacccagaaugggagauugauaacagccaaucccauaguuacugacaaagaaaaaccaguuaacauugagacagaaccaccuuuuggugagagcuacaucgugguaggggcaggugaaaaagcuuugaaacuaagcugguucaagaaaggaagcagcauagggaaaauguucgaagcaaccgcccgaggagcacgaaggauggcuauccugggagacaccgcaugggacuucggcucuauaggaggaguguucacaucuguaggaaaauugguacaccagguuuuuggaaccgcguaugguguucuguucagcgguguuucuuggaccaugaaaauaggaauagggauucugcugacaugguugggauuaaauucaaggagcacgucacuuucgaugacgugcauugcaguuggcaugguuacacuguaccuaggagucaugguucaagcggauucgggauguguaaucaacuggaagggcagagaacucaaauguggaaguggcauuuuugucacuaaugagguccacacuuggacagagcaauacaaauuccaggcugacuccccaaaaagacugucagcagccauuggaaaggcaugggaggagggcguguguggaauucgaucagccacgcgucuugagaacaucauguggaagcaaauaucaaaugaauugaaccacauucuacuugaaaaugacaugaaauucacaguggucguaggagaugcuaauggaauuuuggcccaaggaaaaaaaaugauuaggccacaacccauggaacacaaauacucauggaaaagcuggggaaaagcuaaaaucauaggagcagacauacaaaauaccaccuucaucaucgacggcccagauacuccagaaugccccgaugaacaaagagcguggaacauuugggaaguugaggacuauggguuuggaauuuucacgacaaacauauggcugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaucuggccgaaaucccacacucuauggaguaauggaguuuuggaaagugaaaugauaaucccaaagauauauggaggaccaauaucucagcacaacuacagaccaggguauuucacacaaacagcagggccauggcaccuaggcaaguuggaauuggauuuugacuugugugaagguaccacaguuguuguggaugaacauuguggaaaucgagguccaucucucagaacuacaacagucacaggaaagauaauccaugaaugguguugcagauccugcacguuaccccccuuacguuucagaggagaagacggauguugguauggcauggaaaucagaccaguuaaggagaaggaggagaaccuaguuaggucaauggucucugcagggucaggagaaguggacaguuuuucauuaggaauacuaugcguaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaagauggggaugggaacaacguaccuagccuugauggcuacuuucaaaaugagaccaauguucgcuguugggcuauuauuucgcagacugacauccagagaaguucuucuucucacgauuggauuaagccugguggcauccguggagcuaccaaauucuuuggaggagcuaggggauggacuugcaauggguaucaugauguuaaaauuauugacugaauuucagccacaccaguuauggaccaccuuacugucucugacauuuaucaaaacaacucuuucauuggauuaugcauggaagacaacggcuaugguacugucaaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaaguucacuccucaaaaaugaugugccguuggccggcccacuaauagcuggaggcaugcuaauagcauguuaugucauauccggaagcucagccgauuuaucacuggagaaagcggcugagguauccugggaagaagaagcagaacacuccgguaccucacacaacauauuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcgguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggacuugaucucauauggaggagguuggagguuucaaggaucauggaacacgggagaagaagugcaggugauagcuguugaaccaggaaaaaaccccaaaaauguacagacaacgccggguaccuucaagacuccugaaggcgaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgccucugaaauggcagaggcgcucaagggaaugccaauaagauaucagacaacagcagugaagagugagcacacaggaagggagauaguugaccucaugugccacgccacuuuuaccaugcgucucuuauccccagugagaguucccaauuacaacaugauuauuauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagauccuggaauucaggcuacgacuggaucacugauuuuccagguaaaacagucugguuuguuccaagcauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuuccgaaaugggagcaaauuuccgggccgacaggguaauagacccaagacggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucauuccagcccucuuugagccagagagagaaaagagugcagcaauagacggggaguacagacugcggggagaagcaaggaaaacguucguggagcucaugagaagaggagaucuaccaguuuggcuauccuacaaaguugccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccacuggcccugcgcgaguuuaaagaguuugcagcaggaagaagaagugucucaggugaccuaauauuggaaauagggaaacuuccacaacauuuaacgcuaagagcccagaaugcucuggauaacuuggucauguugcacaauuccgaacaaggaggaaaagccuauagacaugcuauggaggaacuaccagacaccauagaaacauugaugcuccuagcuuugauagcuguguugacugguggagugacgcuguucuuccuaucaggaaaaggucuagggaaaacauccauuggcuugcucugugugacggccucaagcgcacuguuauggauggccaguguggagccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacccucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaaucuaucacacuggcuacuggaccccugaccacucucugggagggaucuccaggaaaauucuggaauaccacgauagcaguguccauggcaaacaucuuuaggggaaguuaucuagcaggagcaggucuggccuucucauuaaugaaaucuuuaggaggagguaggagagguacgggagcucaaggggaaacacugggagagaaauggaaaagacaguuaaaccaacugagcaagucagaauucaacaccuacaaaaggagugggauuauggagguggacagauccgaagccaaagaaggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaauccaacuauagaagaagguagaacguuacguguucuaaagaugguggaaccauggcucagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucaugugggacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaggacaauccauacaaaacaugggccuaucauggaucauaugaggucaagccaucaggaucagccucaucuauggugaauggaguggugagauugcucacaaaaccaugggauguuaucccuauggucacacaaauagcuaugacugauaccacacccuuuggacaacagagaguguuuaaagagaaaguugacacgcgcacaccaagagcaaaacgaggcacagcacagauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaagcccuugguuucaugaacgaagaucacugguuuaguagagagaauucacucaguggaguggaaggagaaggacugcacaaacuuggauacauacucagagacauaucaaagauuccggggggaaauauguaugcagaugauacagccggaugggacacaagaauaacagaggaugaucuucagaaugaggcuaaaaucacugacaucauggagccugaacaugcucuauuggcuacgucaauuuuuaagcugacuuaccaaaacaagguggugagggugcaaagaccagcaaaaaauggaaccgugauggauguuauauccagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguuggaaaaacauggugccgaaaggcugaaaagaauggcaaucagcggagaugauuguguagugaaaccaauugaugacagguucgcaacagccuuaauagcucugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuagcggcuaaugcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccaccaacauacaaguggccauaaaccaagugagaaggcucaucgggaaugagaauuaucuagauuacaugacaucaaugaagagauucaagaaugagagugaucccgaaggggcacucugg

SEQ ID NO: 6337 - RNA, 9876 nt, Artificial Sequence
  derived and/or modified CDS sequence (wt) from DENV-1__KF672762__SS-prME
uccgugaccaugcuccucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggauuugggagaguuaugugaggacacaaugaccuacaaaugcccucggaucacugaggcggaaccagaugacguugacugcuggugcaaugccacagacacaugggugaccuaugggacguguucucaaaccggcgaacaccgacgagacaaacguuccguggcacuggccccacaugugggacuuggucuagaaacaagaaccgaaacauggauguccucugaaggcgccuggaaacaaauacaaaaaguggagacuugggcuuugagacacccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucaccaccauggcaaaaaauaaaccaacauuggacauugaacucuugaagacggaggucacgaacccugccgucuugcgcaaacuaugcauugaagcuaaaauaucaaacaccaccaccgauucaagauguccaacacaaggagaggcuacacugguggaagaacaagacgcgaacuuugugugucgucgaacguuuguggacagaggcugggguaauggcugcggacuauucggaaaaggaagccuauugacgugugccaaguucaagugugugacaaaacuagaaggaaagauaguucaauaugaaaacuuaaaauauucagugauagucacuguccacacuggggaccagcaccaggugggaaacgagacuacagaacauggaacaauugcaaccauaacaccucaagcuccuacgucggaaauacagcugacugacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagacuuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaccugaaaugcagacuaaaaauggauaaacugacuuuaaaggggacgucauaugugaugugcacaggcucauuuaagcuagagaaggaaguggcugagacccagcauggaacuguucuagugcaggucaaauacgaaggaauagaugcgccaugcaagauccccuuuucgacccaagaugagaaaggagugacccagaaugggagauugauaacagccaaucccauaguuacugacaaagaaaaaccagucaacauugagacagaaccaccuuuuggugagagcuacaucgugguaggagcaggugaaaaagcuuugaaacuaagcugguucaagaaaggaagcagcauagggaaaauguucgaagcaaccgcccgaggagcacgaaggauggcuauccugggagacaccgcaugggacuucggcucuauaggaggaguguucacaucugugggaaaauugguacaccagguucuuggaaccgcauaugggguucuguucagcgguguaucuuggaccaugaaaauaggaauagggauucugcugacaugguugggauuaaauucaaggagcacgucacuuucgaugacgugcauugcaguuggcaugguuacacuguaccuaggagucaugguucaagcggacucgggauguguaaucaacuggaagggcagagaacucaaauguggaaguggcauuuuugucacuaaugaaguccacacuuggacagagcaauacaaauuccaggcugacuccccaaaaagacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaaggaaaaaaaaugauuaggccacaacccauggaacacaaauacucauggaaaagcuggggaaaagcuaaaaucauaggagcagacauacaaaauaccaccuucaucaucgacggcccagauacuccagaaugccccgaugaacaaagagcguggaacauuugggaaguugaggacuauggguuuggaauuuucacgacaaacauauggcugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaucuggccgaaaucccacacucuauggaguaauggaguuuuggaaagugaaaugauaaucccaaagauauauggaggaccaauaucucagcacaacuacagaccaggguauuucacacaaacagcagggccauggcaccuaggcaaguuggaauuggauuuugacuugugugaagguaccacaguuguuguggaugaacauuguggaaaucgagguccaucucucagaacuacaacagucacaggaaagauaauccaugaaugguguugcagauccugcacguuaccccccuuacgguucagaggagaagacggauguugguauggcauggaaauuagaccaguuaaggagaaggaggagaaccuaguuaggucaauggucucugcagggucaggagaaguggacaguuuuucauuaggaauacuaugcguaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaagauggggaugggaacaacguaccuagccuugauggcuacuuucaaaaugagaccaauguucgcuguugggcuauuauuucgcagacuaacauccagagaaguucuucuucucacgauuggauuaagccugguagcauccguggagcuaccaaauucuuuggaggagcuaggggauggacuugcaauggguaucaugauguuaaaauuauugacugaauuucagccacaccaguuauggaccaccuuacugucuuugacauuuaucaaaacaacucuuucauuggauuaugcauggaagacaacggcuaugguacugucaaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaaguucacuccucaaaaaugaugugccguuggccggcccacuaauagcuggaggcaugcuaauagcauguuaugucauauccggaagcucagccgauuuaucauuggagaaagcggcugagguauccugggaagaagaagcagaacacuccgguaccucacacaacauauuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcgguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggacuugaucucauauggaggagguuggagguuucaaggaucauggaacacgggagaagaagugcaggugauagcuguugaaccaggaaaaaaccccaaaaauguacagacaacgccggguaccuucaagacuccugaaggcgaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaagcaucacaggaaggaccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgccucugaaauggcagaggcgcucaagggaaugccaauaagauaucagacaacagcagugaagagugagcacacaggaagggagauaguugaccucaugugccacgccacuuuuaccaugcgucucuuauccccagugagaguucccaauuacaacaugauuauuauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaauucaggcuacgacuggaucacugauuuuccagguagaacagucugguuuguuccaagcauuaaaucaggaaaugacauugccaacuguuuaagaaagaacggaaaacggguaauccaauuaagcagaaaaaccuuugacacugaguaccagaaaacaaaaaacaaugacugggacuauguugucacaacagacaucuccgaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuauccuacaaaguugccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccacuggcccugcgcgaguuuaaagaguuugcagcaggaagaagaagugucucaggugaccuaauauuggaaauagggaaacuuccacaacauuugacgcuaagagcccagaaugcucuggauaacuuggucauguugcacaauuccgaacaaggaggaaaagccuauagacaugcuauggaggaacuaccagacaccauagaaacauugaugcuccuagcuuugauagcuguguugacugguggagugacgcuguucuuccuaucaggaaaaggucuagggaaaacauccauuggcuugcucugugugacggccucaagcgcacuguuauggauggccaguguggagccccauuggauagcggccuccaucauccuagaguucuuuuugauggugcugcucauuccagagccagacagacagcgcacuccacaggacaaccagcuagcauauguggugauagguuuguuauucaugauacugacaguggcggccaaugagaugggauuauuggaaaccacaaagaaagaccuggggauuggccauguagccgccgaaaaccaccaacaugcuacaaugcuggacguagaccuacguccagcuucagccuggacccucuaugcaguagccacaacaguuaucacucccaugaugagacacacaauugaaaauacaacggcaaacauuuccuugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuuaaugcggaccacaugggccuugugugaaucuaucacacuggcuacuggaccccugaccacucucugggagggaucuccaggaaaauucuggaauaccacgauagcaguguccauggcaaacaucuucaggggaaguuaucuagcaggagcaggucuggccuucucauuaaugaaaucuuuaggaggagguaggagagguacgggagcucaaggggaaacacugggagagaaauggaaaagacaguuaaaccaacugagcaagucagaauucaacaccuacaaaaggagugguauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaauccaacuauagaagaagguagaacguuacguguucuaaagaugguggaaccauggcucagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucaugugggacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaggacaauccauacaaaacaugggccuaucauggaucauaugaggucaagccaucaggaucagccucaucuauggugaauggaguugugagauugcucacaaaaccaugggauguuauccccauggucacacaaauagcuaugacugauaccacacccuuuggacaacagaggguguuuaaagagaaaguugacacgcgcacaccaagagcaaaacgaggcacagcacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaauuaggagaguuuggaaaggcaaaaggaagucgugcaauaugguauauguggcugggagcacguuuucuggaguucgaagcccuuggcuucaugaaugaagaucacugguuuaguagagagaauucacucaguggaguggaaggagaaggacugcacaaacuuggauacauacucagagacauaucaaagauuccggggggaaauauguaugcagaugauacagccggaugggacacaagaauaacagaggaugaucuucagaaugaggcuaaaaucacugacaucauggagccugaacaugcucuauuggcuacgucaauuuuuaagcugacuuaccaaaauaagguggugagggugcaaagaccagcaaaaaauggaaccgugauggauguuauaucuagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauuguguagugaaaccaauugaugacagguucgcaacagccuuaauagcucugaaugacaugggaaaaguaagaaaagacauaccgcagugggaaccuucaaaaggauggaaugauuggcagcaagugccuuucuguucacaccauuuucaccaauugaucaugaaggaugggagggaaauaguggugccaugucgcaaccaagaugaacuugugggcagggcuagaguaucacaaggcgccggauggagccugagagaaacugcuugccuaggcaagucauaugcacaaauguggcagcugauguacuuccacaggagagaccugagacuagcggcuaaugcuaucuguucagcagucccaauugauugggucccaaccagccgcacaaccuggucaauccaugcccaccaccaauggaugacaacagaagacauguuaucaguguggaauaggguuuggauagaggaaaacccauggauggaggacaaagcucauguauccaguugggaagaaguuccauaccuagggaagagggaagaccaaugguguggaucccugauaggcuugacagcgagggccaccugggccaccaacauacaaguagccauaaaccaagugagaaggcucaucgggaaugagaauuaucuagauuacaugacaucaaugaagagauucaagaaugagagugaucccgaaggggcacucugg

SEQ ID NO: 6338 - RNA, 9879 nt, Artificial Sequence
  derived and/or modified CDS sequence (wt) from DENV-1__JF459993__SS-prME
ucugugaccaugcucuucaugcugcugcccacaucccuggcauuccaucugaccacccgagggggagagccgcacaugauaguuagcaagcaggaaagaggaaagucacuuuuguuuaagaccucugcaggugucaacauguguacccuuauugcaauggauuugggagaguugugugaggacacaaugaccuacaaaugcccccggaucacugaaacggaaccagaugacguugacuguuggugcaacgccacggagacaugggugacuuauggaacauguucucaaacuggugaacaccgacgagacaaacguucuguugcacuggcaccacacguagggcuuggucuagaaacaagaaccgaaacguggauguccucugaaggcgcuuggaaacaaauacaaaaaguggagaccugggcucugggacacccaggauucacggugauagcucuuuuucuagcacaugccauaggaacauccaucacccagaaaggaauuauuuuuauuuugcugaugcugguaacuccauccauggccaugcggugcgugggaauagguaacagggacuucguggaaggacugucaggagcuacguggguggaugugguacuggagcauggaaguugugucacuacuauggcaaaagacaaaccaacacuggauauugaacucuuaaagacggaggucacaaacccagccauccugcgcaaacugugcauugaagccaaaauaucaaauacuaccaccgauucgagauguccaacacaaggagaagccacgcugguggaagaacaagacacgaacuuugugugucgacgaacguucguggacagaggcuggggcaaugguugugggcuauuuggaaaagguagcuuaauaacgugugcuaaguuuaagugugugacaaaacuggaaggaaagauaguucaauaugaaaauuuaaaauauucagugauagucaccguccacacuggagaccagcaccaaguugggaaugaaacuacagaacauggaacaacugcaaccauaacaccucaagcuccuacgucggaaauacagcugacagacuacggagcuuuaacacuggacuguucaccuagaacagggcuagacuucaaugagaugguguuguugacaaugaaagaaaaaucauggcucguccacaaacaaugguuucuagacuuaccgcugccuuggaccucgggggcuucaacaucccaagagacuuggaauagacaagacuugcuggucacauuuaagacggcucaugcaaagaagcaggaaguaguuguacuaggaucacaagaaggagcgaugcacacugcgcugacuggagcaacagaaauccaaacgucuggaacgacaacaauuuucgcaggacaccugaaaugcagacugaaaauggauaaacugacuuuaaaagggguaucauauguaaugugcacaggcucauucaagcuagaaaaggaaguggcugagacccagcauggaacuguucuagugcagguuaaguacgaaggaacagaugcaccauguaagauccccuucucaucccaagaugagaagggaguaauccagaaugggagauugauaacagccaaccccauagucacugacaaagaaaaaccagucaacauugaggcggagccaccuuuuggugagagcuacaucgugguaggagcaggugagaaagcuuugaaacuaagcugguucaagaagggaagcaguauagggaaaauguuugaagcaacugcccguggagcacgaaggauggccauucugggagacacugcaugggacuucgguucuauaggaggaguguucacguccgugggaaaacugguacaccagaucuuuggaacugcguacggaguuuuguucagcgguguuucuuggaccaugaaaauaggaauagggauucugcugacauggcuaggauuaaauucaaggagcacgucccuuucaaugacguguaucgcaguuggcauggucacacuguaccuaggagucaugguucaggcggacucgggauguguaauuaacuggaaaggcagagaacucaaauguggaagcggcauuuuugucacuaaugaaguucacaccuggacagagcaauacaaauuccaggccgacuccccaaaaagacuaucagcagccauugggaaggcaugggaggaggguguguguggaauucgaucagccacucgucucgagaacaucauguggaagcaaauaucaaaugaacugaaccacaucuuacuugaaaaugacaugaaauucacagugguuguaggagauguugcugggauuuuggcucaagggaaaaagaugauuaggccacaacccauggaauacaaauacucguggaaaagcuggggaaaggcuaaaaucauaggggcagauguacagaacgccaccuucaucaucgacggcccaaacaccccugaauguccugaugaccaaagagcauggaacauuugggaaguugaggacuauggauuuggaauuuucacgacaaacauauggcugaaauugcgugacuccuacacccaagugugugaccaccggcuaaugucagcugccaucaaggacagcaaggcaguucacgcugacaugggauacuggauagaaagugaaaagaacgagaccuggaagcuggcaagagccucuuucauagaaguuaaaacaugugucuggccaaaaucccacacucuauggagcaauggaguucuggaaagugaaaugauaauuccaaagaucuauggaggaccaauaucccagcacaaccacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccagucaaggaaaaggaagagaaccuagucaaaucaauggucucugcagggucaggggaaguggacagcuuuucacuagggcugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguagggcuauuauuccgcagacuaacauccagagaaguucuucuucuaacaauuggacugagucuaguggcaucuguggagcuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuaugcauggaagacaauggcuaugguacugucaauugucucucucuuccccuuaugccuguccacgaccucccaaaaaacaacauggcuuccggugcuauugggaucucuuggaugcaaaccacuaaccauguuucuuauagcagaaaacaaaaucuggggaaggaaaaguuggccucucaaugaaggaaucauggcuguuggaauagucagcauccuacuaaguucacuccuaaaaaaugaugugccgcuagcugggccacuaauagcuggaggcaugcuaauagcauguuauguuauaucuggaagcucagccgaucuaucacuagagaaagcggccgaggucucuugggaagaagaagcagaacacucuggugccucacacaacauauuaguggagguccaagaugauggaaccaugaagauaaaggaugaagagagagaugacacgcuaaccauucuccucaaagcaacucugcuagcaguuucagggguguacccauuaucaauaccagcgacccuuuuugugugguacuuuuggcagaaaaagaagcagagaucugggguguuaugggacacaccuagcccuccagaaguggaaagagcaguucuugaugaugguauuuauagaauuaugcagagaggacuguugggcaggucccaaguagggguaggaguuuuucaagaaaacguguuccacacaauguggcaugucaccaggggagcuguacucauguaucaagggaagagacuggagccgagcugggccagugucaaaaaagaccugaucucauauggaggaggcuggaggcuucaaggauccuggaacacaggagaagaagugcaggugauugcuguugaaccagggaaaaaccccaaaaauguacaaacagcgccaggcaccuuuaagaccccugaaggcgaaguuggagcuauugcccuagauuuuaaacccggcacaucuggaucucccaucgugaacagagaaggaaaaauaguaggucuuuauggaaauggaguagugacaacaaguggaaccuacgucagcgccauagcucaagcuaaagcaucacaagaagggccccuaccagagauugaagacgagguguuuaggaagagaaacuuaacaauaauggaccuacauccaggaucggggaaaacaagaagauaccuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaauggaaaacgggugauucaauugagcaggaaaaccuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcguguuauuuuagcaggaccgaugccagugacuguggccagugccgcccagaggagaggaagaauuggaaggaaccacaauaaggaaggugaucaguacaucuacaugggacagccuuuaaacaacgaugaagaucacgcucacuggacggaagcaaaaaugcuccuugauaauauaaacacaccagaagggauuaucccagcccucuucgagccggagagagaaaagagugcagcaauagacggggaauacagacugcggggugaagcaaggaaaacuuuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucugauauuagaaauagggaaacuuccacaacauuugacgcaaagggcccagaaugccuuggacaaccugguuauguugcacaacuccgaacaaggaggaagagccuauagacaugcacuggaagaacugccagacaccauagaaacguugaugcuccuagcuuugauagcuguguuaacugguggagugacgcuguucuuccuaucaggaaggggccuagggaaaacaucuauuggccuacucugcgugauggcuucaagcgcacugcuauggauggccaguguggagccccauuggauagcggccuccaucauacuggaguucuuccugauggugcugcucauuccagagccagacagacaacgcacuccgcaggacaaccagcuggcauauguggugauaggucuguuauucaugauacugacaguagcagccaaugagaugggacugcuggaaaccacaaagaaagacuuagggauuggccauguggcuguugaaaaucaccaccaugccucaaugcuggacguagacuuacacccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccauugacgcugacagcggcgguauugaugcuaguggcucauuacgccauaauuggaccuggacugcaagcgaaagcuacuagagaagcucaaaaaaggacagcggccggaauaaugaaaaauccaaccguugauggaauuguugcaauagauuuggacccugugguuuaugaugcaaaauuugagaaacaacuaggccaaauaauguuguugauacuaugcacaucacagauccucuugaugcggacuacaugggccuugugcgaauccaucacacuggcuacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacaccuauaaaaggagugggauuauggaaguggacagauccgaagccaaagagggacuaaaaagaggagaaacaaccaaacaugcagugucgagaggaaccgcuaaauugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaagaaccaaucccaauggcgaccuauggauggaaccuaguaaagcugcacuccgggaaagacguauucuuuauaccaccugagaaaugugacacccuuuuaugugauauuggugaguccucuccaaacccaacuauagaggaaggaagaacgcuacgcguccuaaagaugguggaaccauggcuuagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguacuggguuucauguggaacaggaaacauugugucagcaguaaacaugacauccagaauguuguuaaaucgauucacaauggcucacaggaaaccaacauaugaaagagauguggaccuaggcgccggaacaagacauguggcaguggaaccagagguagccaaccuagauaucauuggucagaggauagagaacauaaaacaugaacauaagucaacauggcauuaugaugaggacaauccauauaaaacaugggccuaucauggaucauaugaggucaagccaucaggaucagcuucauccauggucaauggcguggugaaacugcucaccaaaccaugggaugucauccccauggucacacaaauagccaugacugacacuacacccuuuggacaacagaggguguuuaaagagaaaguugacacacgcacaccaaaagcaaaacgaggcacagcacaaaucauggaggugacagccaggugguuaugggguuuucuuucuagaaacaagaaaccaagaauuuguacaagagaggaguucacaagaaaaguuaggucaaacgcagccauuggagcaguguucguugaugaaaaccaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacaugugguugggagcacgcuuucuagaguucgaagcucuugguuucaugaacgaagaccacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccaaaauuacugacaucauggaacccgaacaugcccuacuggcuaagucaaucuucaagcuaaccuaccaaaauaaagugguaaggguacagagaccagcaaaaaauggaaccgugauggaugucauauccagacgugaccagagaggaaguggccaggucggaacuuauggcuuaaacacuuucaccaacauggaagcccagcugauaagacaaauggagucugaggaaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuuaacagcucugaaugauaugggaaaaguaagaaaagauauaccacaaugggaaccuucaaaaggauggaaugauuggcaacaagugccuuuuugcucacaccacuuccaccagcugauuaugaaggaugggagggaaguaguggugccaugccgcaaccaagaugaacuuguggguagggcuagaguaucacaaggcgcuggauggagccugagagaaacugcaugccuaggcaagucauaugcacaaauguggcagcugauguacuuccacaggagagacuugagacuagccgcuaaugcuaucuguucagccguuccaguugauugggucccaaccagccgcaccaccuggucgauccaugcccaccaccaguggaugacaacagaagacaugcugucaguguggaauaggguuuggauagaggaaaacccauggauggaggacaaaacccauguauccaguugggaagauguuccauauuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaaaaacgagagugaucccgaaggggcacucugguga

SEQ ID NO: 6339 - RNA, 9876 nt, Artificial Sequence
  derived and/or modified CDS sequence (wt) from DENV-1__KF672763__SS-prME
uccgugaccaugcuccucaugcugcugcccacagcccuggcauuccauuugaccacacgagggggagagccacacaugauaguuaguaagcaggaaagaggaaagucacucuuguucaagaccucugcagguguuaauaugugcacucucauugcgauggauuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagacaaacguuccguggcacuggccccacacgugggacucggucuagaaacaagaaccgaaacauggaugucuucugaaggcgccuggaaacaaauacaaaaaguggagacuugggcuuugagacauccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucgucgaaggacugucaggagcaacguggguagacgugguauuggagcauggaagcugcgucaccaccauggcaaaaaacaaaccaacauuggacauugaacucuugaagacggaggucacgaacccugccgucuugcgcaaacugugcauugaagccaaaauaucaaacaccaccaccgauucaagauguccaacacaaggagaggcuacacugguggaagaacaagacgcgaacuuugugugucgccgaacguuuguggacagaggcugggguaauggcugcggauuauucggaaaaggaagccuauugacgugugccaaguuuaagugugugacaaaacuagaaggaaagauaguucaauaugaaaacuugaaauauucagugauagucaccguccacacuggggaucagcaccaggugggaaacgagacuacagaacauggaacaauugcaaccauaacaccccaagcuccuacgucggaaauacagcugacugacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagacuuggaacagacaagauuugcuggucacauucaagacagcucaugcaaagaaacaggaaguagucguacugggaucacaagaaggagcaaugcacaccgcguugacuggggcgacagaaauccagacgucaggaacgacaacaaucuuugcaggacaccugaaaugcagacuaaaaauggauaaacugacuuuaaaagggacgucauaugugaugugcacaggcucauuuaagcuagagaaggaaguggcugagacccagcauggaacuguucuagugcaggucaaauacgaaggaacagaugcgccaugcaagauccccuuuucgacccaagaugagaaaggagugacccagaaugggagauugauaacagccaaucccauaguuacugacaaagaaaaaccagucaacauugagacagaaccaccuuuuggugagagcuacaucgugguagggguaggugaaaaagcuuugaaacuaagcugguucaagaaaggaagcagcauagggaaaauguucgaagcaaccgcccgaggagcacgaaggauggcuauccugggagacaccgcaugggacuucggcucuauaggaggaguguucacaucugugggaaaauugguacaccagguuuuuggaaccgcauaugguguucuguucagcgguguuucuuggaccaugaaaauaggaauagggauucugcugacaugguugggauuaaauucaaggagcacgucacuuucgaugacgugcauugcaguuggcaugguuacacuguaccuaggagucaugguucaagcggacucgggauguguaaucaacuggaagggcagagaacucaaauguggaaguggcauuuuugucacuaaugaaguccacacuuggacagagcaauacaaauuccaggcugacuccccaaaaagacugucagcagccauuggaagggcaugggaggagggcguguguggaauucgaucagccacgcgucuugagaacaucauguggaagcaaauaucaaaugaauugaaccacauucuacuagaaaaugacauaaaauucacagugguuguaggaaaugcugauggaauuuuggcccaaggaaaaaaaaugauuaggccacaacccauggaacacaaauacucauggaaaagcuggggaaaagcuaaaaucauaggagcagacauacaaaauaccaccuucaucaucgacggcccagauacuccagaaugccccgaugaacaaagagcguggaacauuugggaaguugaggacuauggguuuggaauuuucacgacaaacauauggcugaaauugcgugacuccuacacccaaaugugugaccaccggcuaaugucagcugccaucaaggacagcaaggcaguccaugcugacaugggguacuggauagaaagcgaaaagaacgaaaccuggaagcuggcgagagccucguucauagaagucaagacaugcaucuggccgaaaucccacacucuauggaguaauggaguuuuggaaagugaaaugauaaucccaaagauguauggaggaccaauaucucagcacaacuacagaccaggguauuuuacacaaacagcagggccauggcaucuaggcaaguuggaauuggauuuugacuugugugaaggaaccacaguuguuguggaugaacauuguggaagucgagguccaucucucagaacuacaacagucacaggaaagauaauccaugaaugguguugcagauccugcacguuaccccccuuacguuucagaggagaagacggauguugguaugguauggaaaucagaccaguuaaggagaaggaggagaaccuaguuaggucaauggucucugcagggucaggagaaguggacaguuuuucauuaggaauacuaugcguaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaagauggggaugggaacaacguaccuagccuugauggcuacuuucaaaaugagaccaauguucgcuguugggcuauuguuucgcagacuaacauccagagaaguucuucuucucacgauuggauuaagccugauggcauccguggagcuaccaaauucuuuggaggagcuaggggauggacuugcaauggguaucaugauguuaaaauuauugacugaauuucagccacaucaguuauggaccaccuuacugucucugacauuuaucaaaacaacucuuucauuggauuacgcauggaagacaacggcuaugguacugucaaucguaucucucuuuccuuuaugccugucuacgaccucucaaaaaacaacauggcuuccggugcuguuaggaucuuuuggaugcaaaccauuaaccauguuucucauaacagaaaacgaaaucuggggaagaaaaaguuggccccucaaugaaggaauuauggcuauuggaauagucagcauucuacuaagcucacuccucaaaaaugaugugccguuggccggcccacuaauagcuggaggcaugcuaauagcauguuaugucauauccgggagcucagccgaucuaucauuggagaaagcggcugagguauccugggaagaagaagcagaacacuccgguaccucacacaacauauuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguauuuuuggcagaaaaagaaacaaagaucaggaguguuaugggacacacccagcccuccggaaguggaaagagcgguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggacuugaucucauauggaggagguuggagguuucaaggaucauggaacacgggagaagaagugcaggugauagcuguugaaccgggaaaaaaccccaaaaauguacagacaacgccggguaccuucaagacuccugaaggcgaaguuggagccauagcucuagauuuuaaacccggcacaucuggaucucccaucgugaacagagagggaaaaauaguaggucuuuauggaaauggaguggugacaacaaguggaaccuacgucagugccauagcccaagcuaaagcaucacaggaagggccucuaccagagauugaggacgagguguucaagaaaagaaacuuaacaauaauggaccuccauccaggaucaggaaaaacaagaagauaucuuccagccauaguccgugaggccauaaaaaggaaacugcguacguugaucuuggcucccacaagaguugucgccucugaaauggcagaggcgcucaagggaaugccaauaagauaucagacaacagcagugaagagugagcacacaggaagggagauaguugaccucaugugccacgccacuuuuaccaugcgucucuuauccccagugagaguucccaauuacaacaugauuaucauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaauucaggcuacgacuggaucacugauuuuccagguaaaacagucugguuuguuccaagcauuaaaucaggaaaugacauugccaacugcuuaagaaagaacggaaaacggguaauccaauugagcagaaaaaccuuugacacugaguaccagaaaacaaaaaacaaugacugggacuauguugucacaacagacauuuccgaaaugggggcaaauuuccgggcugacaggguaauagacccaaggcggugcuugaaaccaguaauacuaaaagaugguccagagcguguuauucuagccggaccgaugccagugacuguggccagugcugcccaaaggagaggaagaauuggaaggaaccagaacaaggaaggugaucaguauguuuacaugggacaaccuuuaaauaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuauccuacaaaguugccucagaagguuuccaguacuccgacagaagguggugcuuugauggagaaaggaacaaccagguguuggaggagaacauggacguggagaucuggacaaaggaaggagaaagaaagaaauugcgaccccgcugguuggaugccagaacauacucugauccacuggcccugcgcgaguuuaaagaguuugcagcaggaagaagaagugucucaggugaccuaauauuggaaauagggaaacuuccacaacauuugacgcuaagagcccagaaugcucuggauaacuuggucauguugcauaauuccgaacaaggaggaaaagccuauagacaugccauggaggaacuaccagacaccauagaaacauugaugcuccuagcuuugauagcuguguugacugguggagugacgcuguucuuccuaucaggaaaaggucuagggaaaacauccauuggcuugcucugugugacggccucaagcgcacuguuauggauggccaguguggagccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacauccagcuucagccuggacucucuaugcaguagccacaacagucaucacucccaugaugagacacacaauugaaaauacaacggcaaacauuucccugacagccauugcaaaucaggcagcuauauugaugggacuugacaagggauggccaauaucgaagauggaccuaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccauagacgggauuguugcaauagacuuggauccugugguuuaugaugcaaaauuugaaaaacagcuaggccaaauaauguuacugauacuuuguacaucacagauccucuugaugcggaccacaugggccuugugugaaucuaucacacuggcuacuggaccccugaccacucuuugggagggaucuccaggaaaauucuggaauaccacgauagcaguguccauggcaaacaucuucaggggaaguuaucuagcaggagcaggucuggccuucucauuaaugaaaucuuuaggaggagguaggagagguacgggagcucaaggggaaacacuaggagagaaauggaaaagacaguuaaaccaacugagcaagucagaauucaacacuuacaaaaggagugggauuauggagguggacagaucugaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacgaaaggaggaccuggacaugaggaacccaucccaauggcgaccuauggauggaaccuagugaagcugcacucuggaaaagauguauuuuuuaugccaccugagaaaugugacacccuucugugugauauuggugaguccucuccgaauccaacuauagaagaagguagaacguuacguguucuaaagaugguggaaccauggcucagaggcaaccaauucugcauaaaaauccuaaauccuuacaugccaagugugguagaaacucuggagcaaaugcaaagaaaacauggcgggaugcuagugcgaaacccacucucaagaaauuccacccaugaaauguacuggguuucaugugggacaggaaacauugugucggcagugaacaugacauccagaauguugcugaaucgauucacaauggcucauaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaagacaauccauacaaaacaugggccuaucauggaucauaugagguuaagccaucaggaucagccucaucuauggugaauggaguggugagauugcucacaaaaccaugggauguuauccccauggucacacaaauagcuaugacugauaccacacccuuuggacaacagagaguguuuaaagagaagguugacacgcgcacaccaagagcaaaacgaggcacagcacaaauuauggaagugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaggcccuugguuucaugaaugaagaucacugguuuaguagagagaauucacucaguggaguggaaggagaaggacugcacaaacuuggauacauacucagagacauaucaaagauuccggggggaaauauguaugcagaugauacagccggaugggacacaagaauaacagaggaugaucuucggaaugaggcuaaaaucacugacaucauggagccugaacaugcucuauuggcuacgucaauuuuuaagcugaccuaccaaaacaagguggugagggugcaaagaccagcaaaaaauggaaccgugauggauguuauauccagacgugaccagagaggaaguggacaggucggaacuuauggcuuaaauacuuucacuaauauggagguccaacuaauaagacaaauggagucugaaggaaucuuuuuucccagcgaauuggaaagccccaaucuagcugaaagaguucuugacugguuggaaaaacauggcgccgaaaggcugaaaagaauggcaaucagcggagaugauuguguagugaaaccaauugaugacagauucgcaacagccuuaauagcucugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuagcggcuaaugcuaucuguucagcugucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccaccaacauacaaguagccauaaaccaagugagaaggcucaucgggaaugagaauuaucuagauuacaugacaucaaugaagagauucaagaaugagagugaucccgaaggggcacucugg

SEQ ID NO: 6340 - RNA, 9876 nt, Artificial Sequence
  derived and/or modified CDS sequence (wt) from DENV-1__KF672764__SS-prME
uccgugaccaugcuccucaugcugcugcccacagcccuggcguuccauuugaccacacgagggggagagccacacaugauaguuaguaagcaggaaagaggaaagucacucuuguucaagaccucugcagguguuaauaugugcacucucauugcgauggauuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagacaaacguuccguggcacuggccccacacgugggacucggucuagaaacaagaaccgaaacauggaugucuucugaaggcgccuggaaacaaauacaaaaaguggagacuugggcuuugagacauccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucgucgaaggacugucaggagcaacguggguagacgugguauuggagcauggaagcugcgucaccaccauggcaaaaaauaaaccaacauuggacauugaacucuugaagacggaggucacgaacccugccgucuugcgcaaacugugcauugaagccaaaauaucaaacaccaccaccgauucaagauguccaacacaaggagaggcuacacugguggaagaacaagacgcgaacuuugugugucgccgaacguuuguggacagaggcugggguaaugguugcggauuauucggaaaaggaagccuauugacgugugccaaguucaagugugugacaaaacuagaaggaaagauaguucaauaugaaaacuugaaauauucagugauagucaccguccacacuggggaucagcaccaggugggaaacgagacuacagaacauggaacaauugcaaccauaacaccucaagcuccuacgucggaaauacagcugacugacuauggagcccucacguuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagacuuggaacagacaggauuugcuggucacauucaagacagcucaugcaaagaaacaggaaguagucguacugggaucacaagaaggagcaaugcacaccgcguugacuggggcgacagaaauccagacgucaggaacgacaacaaucuuugcagggcaccugaaaugcagacuaaaaauggauaaacugacuuuaaaggggacgucauaugugaugugcacaggcucauuuaagcuagagaaggaaguggcugagacccagcauggaacuguucuagugcaggucaaauacgaaggaacagaugcgccaugcaagaucccuuuuucgacccaagaugagaaaggagugacccagaaugggagauugauaacagccaaucccauaguuacugacaaagaaaaaccagucaacauugagacagaaccaccuuuuggugagagcuacaucgugguaggggcaggugaaaaagcuuugaaacuaagcugguucaagaaaggaagcagcauagggaaaauguucgaagcaaccgcccgaggagcacgaaggauggcuauccugggagacaccgcaugggacuucggcucuauaggaggaguguucacaucugugggaaaauugguacaccagguuuuuggaaccgcauaugguguucuguucagcgguguuucuuggaccaugaaaauaggaauagggauucugcugacaugguugggauuaaauucaaggagcacgucacuuucgaugacgugcauugcaguuggcaugguuacacuguaccuaggagucaugguucaagcggacucgggauguguaaucaacuggaagggcagagaacucaaauguggaaguggcauuuuugucacuaaugaaguccacacuuggacagagcaauacaaauuccaggcugacuccccaaaaagacugucagcagccauuggaagggcaugggaggagggcguguguggaauccgaucagccacgcgucuagagaacaucauguggaagcaaauaucaaaugaauugaaccacauucuacuagaaaaugacauaaaauucacagugguuguaggaaaugcuaauggaauuuugacccaagggaaaaaaaugauuaggccacaacccauggaacacaaauacucauggaaaagcuggggaaaagcuaaaaucauaggagcagacauacaaaauaccaccuucaucaucgacggcccagauacuccagaaugcccugaugaacaaagagcguggaacauuugggaaguugaggacuauggguuuggaauuuucacgacaaacauauggcugaaauugcgugacuccuacacccaaaugugugaccaccggcuaaugucagcugccaucaaggacagcaaggcaguccaugcugacaugggguacuggauagaaagugaaaagaaugaaaccuggaagcuggcgagagccucguucauagaagucaagacaugcauuuggccgaaaucccacacacuauggaguaauggaguuuuggaaagugaaaugauaaucccaaagauguauggaggaccaauaucucagcacaacuacagaccaggguauuucacacaaacagcagggccauggcaucuaggcaaguuggaauuggauuuugacuugugugaaggaaccacaguuguuguggaugaacauuguggaagucgagguccaucucucagaacuacaacagucacaggaaagauaauccaugaaugguguugcagauccugcacguuaccccccuuacguuucagaggagaagacggauguugguaugguauggaaaucagaccaguuaaggagaaggaggagaaccuaguuaagucaauggucucugcagggucaggagaaguggacaguuuuucauuaggaauacuaugcguaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaagauggggaugggaacaacguaccuagccuugauggcuacuuucaaaaugagaccaauguucgcuguugggcuauuauuucgcagacuaacauccagagaaguucuucuucucacgauuggauuaagccugguggcauccguggagcuaccaaauucuuuggaggagcuaggggauggacuugcaauggguaucaugauguuaaaauuauugacugaauuucagccacaccaguuauggaccaccuuauugucucugacauuuaucaaaacaacucuuucauuggauuacgcauggaagacaacggcuaugguacugucaaucguaucucucuuuccuuuaugccugucuacgaccucucaaaaaacaacauggcuuccggugcuguuaggaucuuuuggaugcaaaccauuaaccauguuucucauaacagaaaacaaaaucuggggaagaaaaaguuggccccucaaugaaggaauuauggcuauuggaauagucagcauucuacuaaguucacuccucaaaaaugaugugccguuggccggcccacuaauagcuggaggcaugcuaauagcauguuaugucauauccggaagcucagcugaucuaucauuggagaaagcggcugagguauccugggaagaagaagcagaacacuccgguaccucacacaacauauuaguagagguccaagaugauggaacuaugaaaauaaaagaugaagagagggaugacacacucacuauacuccucaaagcaacuuugcuggcagucucgggaguguauccaaugucaauaccagcaacucuuuuugugugguauuuuuggcagaaaaagaaacagagaucaggaguguuaugggacacacccagcccuccggaaguggaaagagcgguucuugaugauggcaucuacagaaucuugcaaagaggacuguugggcaggucccaaguaggagugggaguuuuccaagacggcguguuccacacaauguggcacguuaccaggggagcuguccuuauguaccaagggaagaggcuggaaccaagcugggccagugucaaaaaggacuugaucucauauggaggagguuggagguuccaaggaucauggaacacgggagaagaagugcagguaauagcuguugaaccaggaaaaaaccccaaaaauguacagacaacgccggguaccuucaagacuccugaaggcgaaguuggagcuauagcucuagauuuuaaacccggcacaucugggucucccaucgugaacagagagggaaaaauagugggucuuuauggaaauggaguggugacaacaaguggaaccuacgucagugccauagcccaagcuaaagcaucacaggaagggccucuaccagaaauugaggacgagguguuuaagaaaagaaacuuaacaauaauggaccuccauccaggaucaggaaaaacaagaagauaucuuccagccauaguccgugaggccauaaaaaggaaacugcguacguuaaucuuggcccccacaagaguugucgccucugaaauggcagaggcgcucaagggaaugccaauaagauaucagacaacagcagugaagagugagcacacaggaagggagauaguugaccucaugugccacgccacuuuuaccaugcgucucuuauccccagugagaguucccaauuacaacaugauuauuauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaauucaggcuacgacuggaucacugauuuuccagguaaaacagucugguuuguuccaagcauuaaaucaggaaaugacauugccaacugcuuaagaaagaacggaaaacggguaauccaauugagcagaaaaaccuuugacacugaguaccagaaaacaaaaaacaaugacugggacuacguugucacaacagacauuuccgaaaugggggcaaauuuccgggcugacaggguaauagacccaaggcggugcuugaaaccgguaauacuaaaagaugguccagagcguguuauucuagccggaccgaugccagugacuguggccagugcugcccaaaggagaggaagaauuggaaggaaccagaacaaggaaggugaucaguauguuuacaugggacagccuuuaaauaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuauccuacaaaguugccucagaagguuuccaguacuccgacagaagguggugcuuugauggagaaaggaacaaccagguguuggaggagaacauggacguggagaucuggacaaaggaaggagaaagaaagaaauugcgaccccgcugguuggaugccagaacauacucugauccacuggcccugcgcgaguuuaaagaguuugcagcaggaagaagaagugucucaggugaccuaauauuggaaauagggaaacuuccacaacauuugacgcuaagagcccagaaugcucuggauaacuuggucauguugcacaauuccgaacaaggaggaaaagccuauagacaugcuauggaggaacuaccagacaccauagaaacacugaugcuccuagcuuugauagcuguguugacugguggagugacgcuguucuuccuaucaggaaaaggucuagggaaaacauccauuggcuugcucugugugacggccucaagcgcacuguuauggauggccaguguggagccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacauccagcuucagccuggacucucuaugcaguagccacaacagucaucacucccaugaugagacacacaauugaaaauacaacggcaaacauuucccugacagccauugcaaaucaggcagcuauauugaugggacuugacaagggauggccaauaucgaagauggaccugggaguuccacuucucgccuuagggugcuauucccaggugaacccauugacacugacagcggcgguguugauguugguggcucauuaugccauaauuggaccaggacugcaagcaaaggccacuagagaagcucaaaaaaggacagcggccggaauaaugaaaaauccaacuguagacgggauuguugcaauagacuuggauccugugguuuaugaugcaaaauuugaaaaacagcuaggccaaauaauguuacugauacuuuguacaucacagauccucuugaugcggaccacaugggccuugugugaaucuaucacacuggcuacuggaccccugaccacucuuugggagggaucuccaggaaaauucuggaauaccacgauagcaguguccauggcaaacaucuucaggggaaguuaucuagcaggagcaggucuggccuucucauuaaugaaaucuuuaggaggagguaggagagguacgggagcucaaggggaaacacuaggagagaaauggaaaagacaguuaaaccaacugagcaagucagaauucaacaccuacaaaaggagugggauuauggagguggacagaacugaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaacccaucccaauggcgaccuauggauggaaccuagugaagcugcacucuggaaaagauguauuuuuuaugccaccugagaaaugugacacccuucugugugauauuggugaguccucuccgaauccaacuauagaagaaggcagaacguuacguguucuaaagaugguggaaccauggcucagaggcaaccaauucugcauaaaaauccuaaauccuuacaugccaagugugguagaaacucuggagcaaaugcaaagaaaacauggcgggaugcuagugcgaaacccacucucaagaaauuccacccaugaaauguacuggguuucaugugggacaggaaacauugugucggcagugaacaugacauccagaauguugcugaaucgauucacaauggcucauaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaagacaauccauacaaaacaugggccuaucauggaucauaugagguuaagccaucaggaucagccucaucuauggugaauggaguggugagauugcucacaaaaccaugggauguuauccccauggucacacaaauagcuaugacugauaccacacccuuuggacaacagagaguguuuaaagagaagguugacacgcgcacaccaagagcaaaacgaggcacagcacaaauuauggaagugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaggcacuugguuucaugaaugaagaucacugguuuaguagagagaauucacucaguggaguggaaggagaaggacugcacaaacuuggauacauacucagagacauaucaaagauuccggggggaaauauguaugcagaugacacagccggaugggacacaagaauaacagaggaugaucuucagaaugaggcuaaaaucacugacaucauggagccugaacaugcucuauuggcuacgucaauuuuuaagcugaccuaccaaaacaagguggugagggugcaaagaccagcaaaaaauggaaccgugauggauguuauauccagacgugaccagagaggaaguggacaggucggaacuuauggcuuaaauacuuucacuaauauggagguccaauuaauaagacaaauggagucugaaggaaucuuuuuucccagcgaauuggaaagccccaaucuagcugaaagaguucuugacugguuggaaaaacauggcgccgaaaggcugaaaagaauggcaaucagcggagaugauuguguagugaaaccaauugaugacagauucgcaacagccuuaauagcucugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuagcggcuaaugccaucuguucagccgucccaguugauugggucccaaccagccgcacaaccuggucaauccaugcccaccaccaauggaugacaacagaagacauguuaucaguguggaauaggguuuggauagaggaaaacccauggauggaggauaaaacucauguauccaguugggaagaaguuccauaccuagggaaaagggaagaucaauggugugggucccugauaggcuugacagcgagggccaccugggccaccaacauacaaguagccauaaaccaagugagaaggcucaucgggaaugagaauuaucuagauuacaugacaucaaugaagagauucaagaaugagagugauccugaaggggcacucugg

SEQ ID NO: 6341 - RNA, 9879 nt, Artificial Sequence
  derived and/or modified CDS sequence (wt) from DENV-1__EU863650__SS-prME
ucugugaccaugcuccucaugcugcugcccacagucuugacguuccauuugaccacccgagggggagagccucacaugauaguuagcaaacaggaaagaggaaagucacuuuuguuuaagaccucugcaggugucaacaugugcacccuuauugcaauggaccugggagaguuaugugaugacacgaugaccuacaaauguccccggaucacugagacggaaccagaugacguugacuguuggugcaaugccacggagacaugggugaccuauggaacauguucucaaacuggugaacaccgacgagacaaacguuccguugcacuggcaccacacguagggcuuggucuagaaacaagaaccgaaacguggauguccucugaaggcgcuuggagacaaauacaaaaaguggagacaugggcucugagacacccaggauuuacggugauagcccuuuuucuagcacaugccauaggaacauccaucacccagaaagggauuauuuucauuuugcugaugcuggugacuccauccauggccaugcgaugcgugggaauaggcaacagagacuucguggaaggacugucaggagcuacguggguggauguaguucuggagcauggaaguugcgucacuaccauggcaaaagacaaaccaacacuggacauugaacuccugaagacggaggucacaaacccugccguccugcgcaaacuguguauagaagcuaaaauaucaaauaccaccacugacucgagauguccgacacaaggagaagccacgcugguggaagaacaagacacgaacuuugugugucgacgaacauucguggacagaggcuggggcaaugguuguggacuauucggaaaagguagcuuaauaacgugugcuaaguuuaagugugugacaaaauuggaaggaaagauaguccaauaugaaaacuuaaaauauucugugaucguuaccguccacacuggagaccagcaccaaguuggaaaugagacuacagaacauggaacaauugcaaccauaacaccucaagcuccuacgucggaaauacaacugaccgacuacggagcucuaacacuggauuguucaccuagaacagggcuagacuuuaaugagaugguguugcugacaaugaaagaaaaaucauggcucguccacaaacaaugguuucuagacuuaccacugccuuggaccucaggggccucaacgucccaagagacuuggaacagacaagacuugcuggucacguuuaagacagcucaugcaaagaagcaggaaguagucguacuaggaucacaagaaggagcaaugcacacugcguugacuggagcgacagaaauccaaacgucuggaacgacaacaauuuuugcaggccaccugaaaugcagauuaaaaauggacaaacuaacucuaaaaggaauaucauauguaaugugcacaggcuuauucaaguuagagaaggaaguggcugagacccagcauggaacuguucuaguacaggucaaauacgaaggaacagaugcaccaugcaagauucccuuuucgucccaagaugagaaaggagcaacccagaaugggagauugguaacagccaaccccauagucacugacaaagaaaaaccagucaacauugaagcggagccacccuuuggugagagcuacaucgugguaggagcaggugaaaaagcuuugaaacuaagcugguucaagaagggaagcaguauagggaaaauguuugaagcaacugcccguggagcacgaaggauggccauccugggagacaccgcaugggacuucggcucuauaggaggaguguucacgucugugggaaaacugguacaccagaucuuuggaacugcguauggaguuuuguucagcgguguuucuuggaccaugaaaauaggaauagggauucugcugacauggcugggauuaaacucaaggagcacgucccuuucaaugacguguaucgcaguuggcauggucacacuguaccuaggagucaugguccaggcggacucgggauguguaaucaacuggaaaggcagagaacucaaauguggaagcggcauuuuugugacuaaugaaguucacaccuggacagagcaauacaaauuccaggcugacuccccaaagagacuaucagcagccauugggaaggcaugggaggaggguguguguggaauucgaucagccacucgucucgagaacaucauguggaagcaaauaucaaaugaauuaaaccacaucuuacuugaaaaugacaugaaauuuacagugguaguaggagacguuaguggaaucuuggcccaaggaaagaaaacgauuaggccacaacccauggaacacaaauacucguggaaaaguuggggaaaagccaaaaucauuggagcagauguucagaacacuaccuucaucaucgacggcccaaacaccccagaaugccccgaugaccaaagagcauggaacaucugggaaguugaagacuauggauuuggaauuuucacgacaaacauaugguugaaauugcgugauuccuacacccaagugugugaccaucgacuaaugucggcugccaucaaggauagcaaagcaguccaugcugacaugggguacuggauagaaagugaaaagaacgagacuuggaaguuggcaagagccuccuucauagaagucaagacaugcgucuggccaaaaucucacacucuauggagccauggaguccuggaaagugagaugauaaucccaaagauauauggaggaccaauaucucagcacaauuacagaccaggauauuucacacaaacagcagggccguggcacuuaggcaaguuggaacuagauuuugauuugugugaagguaccacagugguuguggaugaacauuguggaaaucgcggaccaucucuuagaaccacaacagucacaggaaagauaauccaugaauggugcugcagaucuugcacguuacccccucuacguuucaaaggagaagacgggugcugguacggcauggaaauuagaccagucaaggagaaggaagagaaccuaguuaagucaauggucucugcagggucaggagaaguggacaguuuuucacuaggacugcuaugcauaucaauaaugaucgaagagguaaugagauccagauggagcaggaaaaugcugaugacuggaacauugguuguguuccuccuucucacauugggacaauugacauggaacgaucugaucaggcuaugcaucaugguuggagccaaugcuucagacaauauggggaugggaacaacguacuuagcuuugauggccacuuucagaaugagaccaauguucgcagucgggcuauuauuucgcagauuaacaucuagagaaguucuucuucucacgguuggauugagucugguggcaucuguagaacuaccaaauucccuagacgagcuaggggauggacuugcaaugggcaucaugauauugaaauuacugacugauuuucaaucacaucagcuaugggccacuuugcugucucuaacauuugucaaaacaacucuuucacugcacuaugcauggaagacaauggccaugauacugucaauuguaucccuccucccuuuaugccuguccacgacuucucaaaaaacgacauggcuuccagugcuucugggaucucuuggaugcaaaccacuaaccauguuucucauaacagaaaacaaaaucuggggaaggaaaaguuggccucucaaugaaggaaucauggcuguuggaauaguuagcauucuacuaagcucacuucucaaaaaugaugugccacuagcuggcccauuaauagcuggaggcaugcuaauagcauguuaugucauauccggaagcucggccgauuuaucacuggagaaagcagcuaaggucuccugggaagaagaagcagaacacucuggcgccucacacaauauacuagucgagauccaagaugauggaaccaugaagauaaaggaugaagagagagaugacacgaucaccauccuccucaaagcaacccugcuggcaaucucagggguguauccaaugucaauaccggcgacucucuuuguguggcauuuuuggcagaaaaagaaacagagaucaggaguguuaugggacacacccagcccuccagaaguggaaaaagcaguccuugaugauggcauuuauagaauucuccaaagaggauuguugggcaggucucagguaggaguaggaguuuuccaagaaggcguauuccacacaauguggcacgucaccaggggagcuguucucauguaccaagggaagagauuggaaccaagcugggccagugucaaaaaagacuugaucucauauggaggagguuggagguuucaaggauccuggaacacgggagaagaagugcaggugauugcuguugaaccggggaagaacccaaaaaauguacagacagcgccagguaccuucaagacuucugaaggcgaaguuggagccauagcucuagacuucaaacccggcacaucuggaucuccuaucgugaacagagagggaaaaauaguaggucuuuauggaaauggaguggugacaacaaguggaaccuaugucagugcuauagcucaagcuaaagcaucacaagaagggccuuugccagagauugaggacgagguguuuaggaaaagaaacuuaacaauaauggaccuacauccaggaucgggaaaaacaagaagauaccuuccagccauaguccgugaggccauaaaaagaaagcugcgcacgcuaguucuagcucccacaagaguugucgccucugaaauggcagaggcgcucaagggaaugccaauaagguaucagacaacagcagugaagagugaacacacgggaaaggagauaguugaccuuaugugucacgccacuuucacuaugcgucuccuuucuccugugagaguucccaauuauaacaugauaauuauggaugaagcacauuuuaccgauccagccagcauagcagccagaggguacaucucaacccgaguggguaugggugaagcagcugcgauuuucaugacagccacccccccgggaucgguggaggccuuuccacagagcaaugcaguuauccaagaugaggaaaaagacauuccugaaagaucauggaacucaggcuaugacuggaucacugacuucccaggcaaaacagucugguuuguuccaagcaucaaaucaggaaaugacauugccaacuguuuaagaaagaaugguaaacgggugauccaauuaagcaggaaaacuuuugacacugaguaucagaaaacaaaaaauaacgacugggacuauguugucacaacagacauauccgaaaugggagcaaacuuucgagcugacaggguaauagacccaaggcggugccugaaaccgguuauacugaaagaugguccagagcgugucauucuagccggaccgaugccagugacuguggcuagugccgcccagaggagaggaagaauuggaaggaaccaaaauaaggaaggugaucaguauauuuacaugggacagccucuaaauaaugaugaggaccacgcccauuggacagaagcaaaaaugcuccuugacaauauaaacacaccagaagggaucaucccagcccucuuugagccggaaagagaaaagagugcugcaauagacggggaguacagacuacggggugaagcgaggaaaacguuuguggagcucaugagaagaggagaucuaccugucuggcuaucuuacaaagucgccucagaaggcuuccaauacuccgacagaagguggugcuuugauggggaaaggaacaaccagguguuggaggagaacauggacguggagaucuggacaaaagaaggagaaagaaagaaacugcgaccccgcuggcuggaugccagaacauacucugacccacuggcucugcgcgaauucaaagaguucgcagcaggaagaagaagcgucucaggugaccuaauauuagaaauagggaaacuuccacaacaucuaacgcaaagggcccagaaggccuuggauaaucugguuaugcugcacaacucugaacaaggaggaaaagcuuauagacacgccauggaagaauugccagacaccauagagacaauaaugcuccuagcuuugauagcugugcugacugguggagugacgcuguucuuccuaucaggaagaggcuuagggaaaacauccauaggccuacucugcgugacguccucaagugcacuguuauggauggccaguguggagccccauuggauagcggccucuauuauacuagaguucuuucugaugguguugcuuauuccagagccagauagacagcgcacuccacaagacaaccaguuagcauauguggugauagguuugcuauucaugauauugacaguggcagccacugagaugggauuauuggaaaccacaaagaaagaccuggggauuggucaugcagcugcugaaaaccaccaccacgccgcaaugcuggacguagaccuacauccagcuucagccuggacccucuacgcaguggccacaacgauuaucacucccaugaugagacacacaauugaaaacacaacggcaaauauuucccugacagccauugcaaaccaggcagcuauauugaugggacuugauaagggauggccaauaucaaagauggacauaggaguuccacuucucgccuuggggugcuacucucaagugaacccgcugacgcugacagcagcgguacugaugcuaguagcccauuaugccauaauuggaccaggacugcaagcaaaagccacuagagaagcucaaaaaagaacagcggcuggaauaaugaaaaacccaacugucgacgggaucguugcaauagauuuagacccugugguuuaugaugcaaaauuugaaaaacagcuaggccaaauaauguuguugauacuuugcacaucucagauucucuugaugcggaccacaugggccuugugugaauccaucacacuggccacaggaccucugaccacgcuuugggagggaucuccaggaaaauucuggaacaccacgauagcgguguccauggcaaacauuuuuagggguaguuaucuagcaggagcgggucuggccuuuucauuaaugaaaucucugggaggagguaggagagggacgggagcccaaggggaaacauugggagaaaaguggaaaagacagcugaaccaauugagcaagucagaauuuaaaacuuacaagaggagugggauuauagaaguggauagaucugaagccaaggagggguugaaaagaggagaaacaaccaaacacgcagugucgagaggaacggccaaacugaggugguuuguggagaggaaccuugugaaaccagaagggaaagucauagaccucgguuguggaagagguggcuggucauauuauugcgcugggcugaagaaagucacagaagugaaaggauccacaaaaggaggaccuggacaugaggaaccgaucccaauggcaaccuauggauggaaccuaguaaagcuacacuccggaaaagauguauucuuuauaccaccugagaaaugugacacucuuuugugugauauuggugaguccucuccgaacccgacuauagaagaaggaagaacguuacguguucuaaagaugguagaaccauggcucagaggaaaccaauuuugcauaaaaauucuaaaucccuauaugccgagugugguagaaacucuggagcaaaugcaaagaaaacauggaggaauguuagugcgaaauccacucucaagaaauuccacucaugaaauguacuggguuucauguggaacaggaaacauugugucagcaguaaauaugacaucuagaaugcugcuaaaccgguucacaauggcucacaggaagccaacauaugaaagagauguggacuugggcgcuggaacgagacauguggcaguagaaccagagguggccaaccuagacaucauuggccagaggauagagaacauaaaaaaugaacacaaaucaacauggcauuaugaugaggauaauccguacaaaacaugggccuaucauggaucauaugaggucaagccaucaggaucagccucauccauggucaaugguguggugagacugcuaaccaaaccaugggaugucauucccauggucacacaaauagccaugacugacaccacacccuuuggacaacaaaggguguuuaaagagaaaguugauacgcgcacaccaaaagcgaaacgaggcacagcacaaaucauggaggugacggccaagugguuaugggguuuccucucuagaaacaaaaaacccagaaucugcacaagagaagaguuuacaagaaaaguuaggucaaaugcagcuauuggagcaguguucguugaugaaaaucaauggaacucaccaaaagaagcaguggaagaugaacgguucugggaccuugugcacagagagagggagcuucauaaacaaggaaaaugugccacgugugucuacaacaugaugggaaagagagagaaaaaauuaggagaguucggaaaggcaaaaggaagucgcgcaauaugguacaugugguugggagcgcgcuucuuagaguuugaagcccuuggcuucaugaaugaagaucacugguucagcagagagaauucacucaguggaguggagggagaaggacuccacaaacuuggauacauacucagagauauaucaaagauuccagggggaaauauguaugcagaugacacagccggaugggacacaagaauaacagaggaugaucuucagaaugaggccaaaaucacugacaucauggaaccugaacaugcccuacuggccacgucaaucuuuaagcuaaccuaccaaaauaagguuguaaggguacagagaccagcaaaaaauggaaccgugauggaugucauauccaggcgugaccagagaggaaguggacagguuggaacuuauggcuuaaacaccuucaccaacauggaggcccaacuaauaagacaaauggagucugaaggaaucuuuuuacccagcgaauuggaacccccaaauuuagccggaagaguuccugacugguuggaaaaacauggcaccgagaggcugagaagaauggcaaucaguggagaugacuguguggugaaaccaauugaugacagauuugcaacagccuuaacagccuugaaugacaugggaaagguaagaaaagacauaccgcagugggaaccuucaaaaggauggaaugauuggcaacaagugcccuucugcucacaccacuuccaccagcugauuaugaaggaugggagggagauaguggugccaugccgcaaccaagaugaacuuguggguagggccagagugucacaaggcgccggauggagcuugagagaaacugcaugucuaggcaagucguaugcacaaauguggcagcugauguacuuccacaggagagacuugagacuagcggcuaaugcuaucuguucagccguuccaguugauugggucccaaccagucgcaccaccuggucgauccaugcccaccaucaauggaugacaacagaagacauguugucaguguggaauagggucuggauagaggaaaacccauggauggaggauaaaacucauguguccagcugggaagacguuccauaccuagggaaaagggaagaucaaugguguggaucccuaauaggcuuaacagcacgagccaccugggccaccaacauacaaguggccauaaaccaagugagaaggcucauugggaaugagaauuaucuagacuacaugacaucgaugaagagauucaaaaacgagagugaucccgaaggggcacucugguaa

SEQ ID NO: 6342 - RNA, 9879 nt, Artificial Sequence
  derived and/or modified CDS sequence (wt) from DENV-1__KU365900__SS-prME
ucugugaccaugcuccuuaugcugaugccuacagccuuggcauuccauuugacuacacgagggggagagccgcacaugauagucagcaagcaggaaagaggaaagucacuuuuguuuaagaccucagcaggugucaacaugugcacccucauagcgauggauuugggagaguuaugugaggacacaaugacuuacaaaugcccucgaaucacugaggcggaaccagaugacguugauuguuggugcaaugccacagacacaugggugaccuauggaacauguucccaaacuggcgagcaccgacgagacaaacguuccguugcacuggccccacacgugggacuugguuuggaaacaagaaccgaaacguggauguccuccgaaggcgcuuggaaacagauacaaagaguggagacuugggcccugagacacccaggauucacggugauagcccuuuuucuagcacaugccauaggaacauccaucacccagaaagggauuaucuucauuuuguuaaugcugguuacaccauccauggccaugcgaugcgugggaauaggcagcagggacuucguggaaggacugucaggagcaacuuggguagaugugguguuggaacauggaaguugcgucacuaccauggcaaaagacaaaccaacauuggacauugaacucuugaagacggaagucacaaacccugcuguccugcgcaaacugugcauugaagcuaaaauaucaaacaccaccaccgauucaagauguccaacacaaggagaagccacacugguggaagaacaagacgcgaacuuugugugucgacgaacguuuguggacagaggcuggggcaauggcugugggcucuuuggaaaaggaagccuuauaacgugugcaaaguucaagugugugacaaaacuggaaggaaaaauagugcaauaugaaaacuugaaauauucaguaauagucaccguccacacuggagaccagcaccaggugggaaaugaaagcacagaacaugggacaacugcaaccauaacaccucaagcuccuacgacagaaauacagcugaccgacuacggagcucuuacauuggauuguucacccagaacaggacuggacuucaaugaaaugguguuguugacaaugaaagaaaaaucauggcuaguccacaaacaaugguuucuagaccuaccacugccuuggaccucgggagcuucaacaucacaagaaacuuggaacagacaagauuugcuggugacauuuaagacagcucaugcaaagaagcaggaaguagucguacuaggaucacaagaaggagcaaugcacacugcguugaccggagcgacggaaauccaaacgucuggaacgacaacaauuuuugcaggacacuugaaguguagacuaaagauggacaaacugacucuaaaagggaugucauaugugaugugcacgggcucauucaagcuagagaaagaaguggcugagacccagcauggaacaguucuagugcagauuaaauacgaaggaacagaugcaccaugcaagaucccuuuuucgacccaagaugaaaaaggaguaacccagaaugggagauugauaacagccaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuucggaacugcauauggaguuuuguucagcgguguuuccuggaccaugaaaauaggaauagggguucugcugacauggcuaggauuaaacucaaggagcacgucccuuucgaugacgugcauugcagucggccuaguaacgcuauacuuaggagucaugguucaggcggauucaggauguguaauuaauuggaaagguagagaacucaaauguggaaguggcauuuuugucacuaaugaaguucacacuuggacagagcaauacaaauuucaagcugauuccccaaagagacuaucagcagccauugggaaggcaugggaggaggguguguguggaauucgaucagcaacucgucucgagaacaucauguggaagcaaauaucaaaugaauugaaccacaucuugcuugaaaaugacaugaaauucacagugguuguaggagauguugcugggauccuggcucaaggaaaaaaaaugauuaggccacaacccauggaacacaaauacucguggaaaagcuggggaaaagcuaaaaucauaggggcagauguacagaacaccaccuuuaucaucgacggcccaaacaccccagaaugcccugaugaucaaagagcauggaacauuugggaaguugaggauuauggauuuggaauuuucacgacaaacauauggcugaaauugcgugacuccuacacccaagugugugaccaccggcuaaugucagcugccaucaaagacagcaaggcaguucacgcugacaugggguacuggauagaaagugaaaagaacgagaccuggaagcuggcaagagccucuuucauagaagucaaaacguguaucuggccaaaaucucacacucuauggagcaauggaguucuggaaagugaaaugauaauuccaaagaucuauggaggaccaauaucucagcacaacuacagaccaggauauuucacacaaacggcagggccguggcaucuaggcaaguuggaacuggauuuugauuugugugaggguaccacgguuguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccagucaaggaaaaggaagagaaucuagucaaaucaauggucucugcagggccaggggaaguggacagcuuuucacuaggacuguuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgaccuaccuagcucugauggccacuuuuaaaaugagaccaauguuugccguagggcuacuacuccgcagacuaacauccagagaaguucuucuucuaacaauuggacugagucuaguggcaucuguggaguuaccaaauuccuuggaggagcugggggauggacuugcaaugggcauuaugaucuuaaaauuauugacugauuuucaaucacaucagcugugggcuaccuugcuguccuugacauuuaucaaaacaacguuuuccuugcacuaugcauggaagacaauggcuaugguacugucaauuguaucucucuuccccuuaugccuguccacgaccucccaaaaaacaacauggcuuccggugcuguugggaucucuuggaugcaaaccacuaaccauguuucuuauagcagaaaacaaaaucuggggaagaaaaaguuggccccucaaugaaggaaucauggcuguuggaauagucagcauccuacuaaguucacuccucaaaaaugaugugccgcuagcugggccauugauagcuggaggcaugcuaauagcauguuaugucauaucuggaagcucagccgaucuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugauggcaucuauagaaucaugcagagaggacuguugggcaggucccaaguggggguaggaguguuucaagaaaacguguuccacacaauguggcaugucaccaggggagcuguacucauguaccaagggaagagacuggaaccgagcugggccagugucaaaaaagaccugaucucauauggaggagguuggaggcuucaaggauccuggaacacgggagaagaagugcaggugauugcuguugaaccagggaaaaaucccaaaaauguacaaacagcgccgggcaccuuuaagaccccugaaggcgaaguuggagccauugcccuagauuuuaaacccggcacaucuggaucucccaucgugaacagagaagggaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucgggaaaaacaagaagauaccuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuauuauggaugaagcacauuucaccgauccauccagcauagcggcuagaggguacaucucaacccgagugggcaugggugaagcagcugcgaucuucaugacagccacucccccaggaucaguggaggccuuuccacagagcaacgcaguuauccaagaugaggaaagagauauuccugagagaucauggaacucagguuaugaguggaucacugacuucccaggcaaaacaguuugguuuguuccaagcauuaaaucaggaaaugauauugccaacugcuuaagaaagaaugggaaacgggugauucaauugagcagaaaaaccuuugacacagaguaccaaaaaacaaaaaauaacgacugggacuacgucgucacaacagacaucuccgaaaugggagcaaauuuccgggccgacagggugauagacccaagacggugucuaaaaccgguaauacuaaaagaugguccagagcgugucauuuuagcaggaccgaugccagugacuguggccagugccgcccagaggagaggaagaauuggaaggaaccacaacaaggaaggugaucaguacaucuauaugggacagccuuuaaacaacgaugaagaucacgcucacuggacggaagcaaaaaugcuccuugauaauauaaacacaccagaaggaauuaucccagcccucuucgagccggagagagaaaagagugcggcaauagacggggaauacagacugcggggugaagcaaggaaaacguuuguggagcucaugagaagaggagaucuaccugucuggcuauccuacaaaguugccucagaaggcuuccaguacucugacagaaaauggugcuuugacggggaaaggaacaaccagguguuggaagagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuggaaauagggaaacuuccacaacacuugacgcaaagggcccagaaugccuuggacaaccugguuauguugcacaacuccgaacaaggaggaagagccuauagacaugcaauggaagaacugccagacaccauagaaacguuaaugcuccuagcuuugauagcuguguuaacugguggagugacgcuguucuuccuaucaggaagggguuuagggaaaacaucuaucggccuacucugcgugauggcuucaagcguauugcuauggauggccaguguagagccccauuggauagcggccuccaucauacuggaguucuuccugauggugcugcucauuccagagccagacagacaacgcacuccgcaggacaaucagcuggcauauguggugauagguuuguuauucaugauacugacaguagcagccaaugagaugggacugcuggaaaccacaaagaaagacuuagggauuggccacguggcuguugaaaaucaccaccaugccacaaugcuggacguagacuuacauccagcuucagccuggacccucuaugcaguggccacaacaaucauuacucccaugaugaggcacacaaucgaaaacacaacggcaaacauuucccugacagccauugcaaaucaggcagcuauauugaugggacuugacaaaggauggccaauaucgaagauggauauaggaguuccacuucucgccuuggggugcuauucccaagugaauccacugacgcugacagcggcgguauugaugcuaguggcccauuacgcuauaauuggaccuggacugcaagcaaaagcuacuagagaagcucaaaaaaggacagcggccggaauaaugaaaaauccaacuguugauggaaucguugcaauagauuuggacccugugguuuaugaugcgaaauuugagaaacaacuaggccaaauaauguuguugauacuaugcacaucacagauccucuugaugcggaccacaugggccuugugcgaauccaucacacuggccacuggaccucugaccacgcucugggagggaucuccaggaaaauuuuggaacaccacgauagcaguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacaccuauaaaaggagugggaucauggaaguggacagauccgaagccaaagagggacugaaaagaggagaaacaaccaaacaugcagugucgagaggaaccgcuaaauugaggugguuuguggagaggaaccuugugaaaccagaagggaaagucauagaccucgguuguggaagagguggcuggucauacuauugcgcugggcugaagaaagucacagaggugaagggauacacaaaaggaggaccuggacacgaagaaccaaucccaauggcgaccuauggauggaaccuaguaaagcuguacuccgggaaagacguauucuuuauaccaccugagaaaugugacacccucuugugugauauuggugaguccucuccaaacccaacuauagaggaaggaagaacgcuacgcguccuaaagaugguggaaccauggcucagaggaaaccaauuuugcauaaaaauuuugaaucccuacaugccaagugugguggaaacucuggagcaaaugcaaagaaaacauggaggaaugcuagugcgaaauccacuuucaagaaauucuacucacgaaauguacuggguuucauguggaacaggaaacauugugucagcaguaaacaugacauccagaauguugcuaaaucgauucacaauggcucauaggaaaccaacauaugaaaaagacguggaccuaggcgccggaacaagacauguggcaguagaaccagagguagcuaaccuagauaucauuggccagaggauagagaacauaaaacaugaacacaagucaacauggcauuaugaugaggacaauccauauaaaacaugggccuaucauggaucauaugaggucaaaccaucaggaucagccucauccauggucaaugguguggugaaacugcucaccaaaccaugggaugucauccccauggucacacaaauagccaugacugacacuacacccuuuggacaacagaggguauuuaaagagaaaguugacacacgcacaccaaaagcaaaacgaggcacagcacaaaucauggaggugacagccaggugguuaugggguuuucuuucuaggaacaagaagccaagaauuuguacaagagaggaguucacaagaaaaguuaggucaaacgcagccaucggagcaguguucauugacgaaaaucaauggaacucagcaaaagaagcaguggaagaugagcgguuuugggaccuugugcacagagagagggagcuucacaaacagggaaaaugugccacguguguuuacaacaugauggggaagagagagaaaaagcuaggagaauuuggaaaggcaaaaggaagucgugcaauaugguacaugugguugggagcacgcuuucuagaguucgaagcucuugguuucaugaacgaagaccacugguucagcagagagaauucacucagcggaguggaaggagaaggacuccacaaacuuggauauauacucagagacauaucaaagauuucagggggaaacauguacgcugaugacacagccggaugggauacaaggauaacagaggaugaccuucagaaugaggccaaaauuacugacaucauggaacccgaacaugcccuacuggcuaaggcaaucuucaagcuaaccuaccaaaauaaagugguaaggguacagagaccagcaaaaaauggaaccgugauggaugucauauccagacgugaccagagaggaaguggccaggucggaacuuauggcuuaaacacuuucaccaacauggaagcccagcugauaagacaaauggagucugagggaaucuuuucacccagugaauuagagaccccaaauuuagccgagagaguucucgacugguugggaaaauauggcgucgaaaggcuaaaaagaauggcaaucaguggagaugacugcguagugaaaccaauugaugauagguuugcaacagccuuaacagcucugaaugauaugggaaaaguaagaaaagauauaccacaaugggaacccucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaaccgcaugccuaggcaaaucauaugcacaaauguggcagcugauguacuuccacaggagagaccugagacuagcugcuaaugcuaucuguucagccguuccaguugauugggucccaacuagccgcaccaccuggucuauccaugcccaucaccaauggaugacaacagaagacaugcugucaguguggaauagaguuuggauagaggaaaacccauggauggaggacaaaacccauauauccaguugggaagauguuccauauuuagggaaaagggaagaucaaugguguggaucccugauaggcuuaacagcaagggccaccugggccaccaacauacaaguggccauaaaccaagugagaagacuaauugggaaugagaacuaucuagauuacaugacaucaaugaagagauucaagaacgagagugaucccgaaggggcacucugguga

SEQ ID NO: 6343 - RNA, 9879 nt, Artificial Sequence
  derived and/or modified CDS sequence (wt) from DENV-1__FJ176779__SS-prME
ucugugaccaugcuccuuaugcugaugccuacagccuuggcguuccauuugacuacacgagggggagagccgcacaugauagucagcaagcaggaaagaggaaagucacuuuuguucaagaccucagcaggugucaacaugugcacccuuguagcgauggauuugggagaguuaugugaggacacaaugacuuacaaaugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaacugaaacguggauguccucugaaggcgcuuggaaacagauacaaagaguggagacuugggcccugagacacccaggauucacggugauagcccuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacacuggacauugaacucuugaagacggaagucacaaacccugccguccugcgcaaacugugcauugaagcuaaaauaucaaacaccaccacugacucaagauguccaacacaaggagaagccacacugguggaagaacaagacgcgaacuuugugugucgacgaacguuuguggacagaggcuggggcaauggcugugggcucuucggaaaaggaagccuacuaacgugugcuaaguucaagugugugacaaaacuggaaggaaagauaguucaauaugaaaacuugaaauauucaguaauagucaccguccacacuggagaccagcaucaggugggaaaugaaagcacagaacaugggacaacugcaacuauaacaccucaagcuccuacgacggaaauacagcugaccgacuacggagcucuuacauuggauuguucaccuagaacaggauuagacuuuaaugaaaugguguuguugacaaugaaagaaaaaucauggcuaguccacaaacaaugguuucuagacuuaccacugccuuggaccucgggagcuucaacaucacaagagaccuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagccaaccccauagucacugacaaagaaaaaccagucaacauugaggcagaaccgccuuuuggugagaguuacaucgugauaggaguaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacaugguuaggauuaaacucaaggagcacgucccucucgaugacgugcauugcaguuggccuaguaacacuauaccuaggagucaugguucaggcggauucaggaugcguaauuaauuggaaggguagagaacucaaauguggaaguggcauuuuugucaccaaugaaguucacacuuggacagagcaauacaaauuucaagcugacuccccaaaaagacuaucagcagccaucgggaaggcaugggaggaggguguguguggaauucgaucagcaacucgucucgagaacaucauguggaagcaaauaucaaaugaacugaaccacaucuuacuugaaaaugacaugaaauucacagugguuguaggagauguugcugggaucuuggcucaaggaaaaaaaaugauuaggccacaacccauggaacacaaauacucguggaaaaauuggggaaaggcuaaaaucauaggggcagauguacagaacuccaccuucaucauugacggcccaaacaccccagaaugcucugaugaccaaagagcauggaacauuugggaaguugaggacuauggauuuggaauuuucacgacaaacauauggcugaaauugcgugacuccuacacccaagugugugaccaccggcuaaugucagcagccaucaaggacagcaaggcaguucacgcugacaugggguacuggauagaaagugaaaagaacgagaccuggaagcuggcaagagccucuuucauagaaguuaaaacauguauuuggccaaaaucccacacucuauggagcaauggaguucuggaaagugaaaugauaauuccaaagaucuauggaggaccaauaucucagcauaacuacagaccaggauauuucacacaaacggcagggccguggcaccuaggcaaguuggaauuggauuuugauuugugugaggguaccacagucguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccagucaaggaaaaggaagagaaucuagucaaaucaauggucucugcagggucaggggaaguggacagcuuuucacugggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgcuuccgacagaauggggaugggaacgacguaccuagcucugauggccacuuuuaaaaugagaccaauguuugcuguagggcuauuauuccgcagacuaacauccagagaaguucuucuucuaaccauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccaugacauuuaucaaaacaacguuuuccuugcacuaugcauggaagacaauggcuaugguacugucaauuguaucucucuuccccuuaugccuguccacgaccucccagaaaacaacauggcuuccggugcuauugggaucucuuggaugcaaaccacuaaccauguuucuuauagcagaaaacaaaaucuggggaaggaaaagcuggccccucaaugaagggaucauggcuguuggaauagucagcauccuacuaaguucacuccucaaaaaugaugugccgcuagcugggccacuaauagcuggagguaugcuaauagcauguuauguuauaucuggaagcucagccgaccuaucacuagagaaagcagcugaggucuccugggaagaagaagcagaacacucuggugccucacacaacauauuaguggagguucaagacgauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccaaaaguggaaagagcaguucuugaugaugguaucuauagaauuaugcagagaggacuguugggcaggucccaaguagggguaggaguuuuucaagaaaacguguuccauacaauguggcaugucaccaggggagcuguacucauguaucaagggaagagacuggaaccgagcugggccagugucaaaaaagaccugaucucauauggaggagguuggaggcuucaaggauccuggaacacgggagaagaagugcaggugauugcuguugaaccagggaaaaaccccaaaaauguacaaacggcgccgggcaccuuuaagaccccugaaggugaaguuggagccauugcccuagauuuuaaacccgguacaucuggaucccccaucgugaacagagaagggaaaauaguaggucuuuauggaaauggaguagugacaacaaguggaaccuacgucagugccauagcucaagccaaagcaucacaagaagggccccuaccagagauugaagacgaaguguucaggaaaagaaacuuaacaauaauggaccuacauccaggaucggggaaaacaagaagauaucuuccagccauaguccgugaggccauaaaaaggaagaugcgcacacuaauucuggcucccacaaggguugucgcuuccgaaauggcagaagcacucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagccacucccccaggaucaguggaggccuuuccacagaguaacgcagucauccaagaugaggaaagagacauuccugagagaucauggaacucaggcuaugaguggaucacugaauucccagguaaaacagucugguuuguuccaagcauuaaagcaggaaaugacauugccaacugcuuaagaaagaauggaaaacgagugauucaauugagcaggaagaccuuugauacagaguaccaaaaaacaaaaaauaacgacugggacuacgucgucacaacagacaucuccgaaaugggagcaaacuuccgggccgacagggugauagacccaagacggugucugaaaccgguaauacuaaaagaugguccagagcgcgucauuuuagcaggaccgaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccggagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagauuuggacaaaagaaggagaaagaaagaagcuacgcccccgcuggcuggaugccagaacauacucagacccacuggcccugcgcgaguuuaaagaguuugcagcaggaagaagaagcgucucaggugaucuaauacuagaaauagggaaacuuccacaacacuugacgcaaagggcccagaaugccuuggacaaccuggucauguugcacaacuccgaacaaggaggaagagccuauagacaugcaauggaagaacugccagauaccauagaaacguugaugcuccuagcuuugauagcuguguuaacugguggagugacgcuguucuuccuaucaggaaagggccuagggaaaacaucuaucggccuacucugcgugauggcuucaagcguacugcuauggauggccaguguggagccccauuggauagcggccuccaucauauuggaguucuuccugaugguguugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaacccacugacgcugacagcggcgguguugaugcuaguggcucauuacgccauaauuggaccuggacugcaagcaaaagcuacuagagaagcucaaaaaaggacagcggccggaauaaugaaaaauccaaccauugauggaauuguugcaauagauuuggacccugugguuuaugaugcaaaauuugagaaacaacuaggccaaauaaugcuguugauacuaugcacaucacagauccucuugaugcggacuacaugggccuugugcgaauccaucacacuggccacuggaccucugaccacacuuugggaaggaucuccaggaaaauuuuggaacaccacgauagcgguuuccauggcaaacauuuucagaggaaguuaucuagcaggagcaggucuggcuuucucauuaaugaaaucucuaggaggagguaggagaggcacgggagcccaaggggaaacacugggagagaaauggaaaagacagcugaaccaacugagcaagucagaauucaacaccuauaaaaggagugggauuauggaaguggacagauccgaagccaaagagggacugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauuuuuuauaccaccugagaaaugugauacccuuuugugugauauuggugaguccucuccaaacccaacuauagaggaaggaagaacgcuacgcguucuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacauaugaaagagacguggaccuaggcgccggaacaagacauguggcaguggaaccagagguaaccaaccuagauaucauuggccagaggauagagaacauaaaauaugaacauaagucaacauggcauuaugaugaggacaauccauauaaaacaugggccuaucauggaucauaugaggucaagccaucaggaucagccucauccauggucaauggcguggugaaacugcucaccaaaccaugggauguuauccccauggucacacaaauagccaugacugacacuacacccuuuggacaacagaggguguuuaaagagaaaguugacacacgcacaccaaaagcaaaacgaggcacagcacaaaucauggaagugacagccaggugguuauggaguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugaccgguucugggaccuugugcacagagagagggagcuucacaaacagggaaaaugugccacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuucacaaacuuggauauauacucagagacauaucaaagauuccagggggaaacauguaugcagaugacacagccggaugggauacaaggauaacagaggaugaccuccagaaugaggccaaaauuacugacaucauggaacccgaacaugcccuacuggcuaagucaaucuucaagcuaaccuaccaaaauaaggugguaaggguacagagaccagcaaaaaauggaaccgugauggaugucauauccagacgugaccagagaggaaguggccagguuggaacuuauggcuuaaacacuuucaccaacauggaagcccagcugauaagacaaauggagucugagggaaucuuuucacccaacgaauuagagaccccaaauuuagccgagagaguucucgacuggcuggaaaaauauggcgucgaaaggcugaaaagaauggcaaucagcggagaugacugcguagugaaaccaauugaugauagguuugcgacagccuuaacagcucugaaugauaugggaaaaguaaggaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggguuccaacuagccgcaccacuuggucgauccaugcccaucaccaauggaugacaacagaagacaugcugucaguauggaauaggguuuggauagaggaaaacccauggauggaggacaaaacccguauauccaguugggaagauguuccauaccuagggaaaagggaagaucaaugguguggaucucugauaggcuuaacagcaagggccaccugggccaccaacauacaaguggccauaaaccaagugagaagacuaauugggaaugagaauuauucggauuacaugacaucaaugaagagauucaagaacgagagugaacccgaaggggcacucugguga

SEQ ID NO: 6344 - RNA, 9879 nt, Artificial Sequence
  derived and/or modified CDS sequence (wt) from DENV-1__FJ176780__SS-prME
ucugugaccaugcuccuuaugcugaugccuacagccuuggcguuccauuugacuacacgagggggagagccgcacaugauagucagcaagcaggaaagaggaaagucacucuuguucaagaccucagcaggugucaacaugugcacccuuauagcgauggauuugggagaguuaugugaggacacaaugacuuacaaaugcccucgaaucacugaagcugaaccagaugacguugauuguugguguaaugccacagacacaugggugaccuauggaacaugcucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacugguggaagaacaagacgcgaacuuugugugucgacgaacguucguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguucacaccggagaccagcaccaagugggaaaugaaagcacagaacaugggacaacugcaacuauaacaccucaagcucccacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagauuugcuggugacauucaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacacagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgccuuuuggugagagcuacauuguaauaggggcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcaguuggccuaguaacacuauaccuaggagucaugguucaggcggauucaggauguguaauuaauuggaaagguagagaacucaaauguggaaguggcauuuuugucaccaaugaaguucauacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagcgaaaugauaauuccaaagaucuauggaggaccaauaucucagcacaacuacagaccaggauauuucacacaaacagcagggccguggcacuuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagacgggugcugguacgguauggaaaucagaccagucaaggaaaaggaagaaaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcucugauggccacuuuuaaaaugagaccgauguuugcuguagggcuauuauuucgcagacuaacauccagagaaguucuucuucuaacaauuggauugagucuaguggcaucuguggaguuaccaacuuccuuggaggagcugggggauggacuugcaaugggcauuaugauuuuaaaauuauugacugacuuucaaucacaucaguugugggcuaccuugcuguccuugacauuugucaaaacaacguuuuccuugcacuaugcauggaagacaauggcuaugguacugucaauuguaucucucuuccccuuaugccuguccacgaccucccaaaaaacaacauggcuuccggugcuauugggaucccuuggaugcaaaccacuaaccauguuucucauagcagaaaacaaaaucuggggaaggagaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcggcugaggucuccugggaagaagaagcagaacacucuggugccucacacaacauauuaguggagguccaagaugauggaaccaugaagauaaaggaugaagagagagaugacacgcuaaccauucuucuuaaagcaacucugcuagcaguuucagggguguacccauuaucaauaccagcgacccuuuucgugugguacuuuuggcagaaaaagaaacagagaucuggaguguuaugggacacacccagcccuccagaaguggaaagagcaguucuugaugauggcaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucguaaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacacacaggaaaagagauaguugaccuuaugugucacgccacuuucacuaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccggagagagaaaagagugcagcaauagacggggaauacagacugcggggugaagcaaggaaaacguuuguggagcucaugagaagaggagaucuaccugucuggcuauccuacaagguugccucagaaggcuaccaguacucugacagaagauggugcuuugacggagaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugaucuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacauuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaauauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaggagggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucuggaaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaguuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguaaccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucauccccaugguuacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguuuugggaccuugugcauagagagagggagcuucacaaacagggaaaaugugccacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggacacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuugaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaucaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauauaccaagugagaagacuaauugggaaugagaauuaucuagauuacaugacaucaaugaagagauucaagaacgagagugaucccgaaggggcacucugguga

SEQ ID NO: 6345 - RNA, 9879 nt, Artificial Sequence
  derived and/or modified CDS sequence (wt) from DENV-1__JN205310__SS-prME
ucugugaccgugcucuucaugcugcugcccacagcccuggcguuccaucugaccacccuagggggagagccgcacaugauagucagcaagcaggaaagaggaaagucacuuuuguuuaagaccucugcaggugucaacauguguacccuuauugcaauggauuugggagaguugugugaggacacaaugaccuacaaaugcccccggaucacugaaacggaaccagaugacguugacuguuggugcaacgccacggagacaugggugacuuauggaacauguucucaaacuggugaacaccgacgagacaaacguucuguugcacuggcaccacacguagggcuuggucuagaaacaagaaccgaaacguggauguccucugaaggcgcuuggaaacaaauacaaaaaguggagaccugggcucugagacacccaggauucacggugauagcucuuuuucuagcacaugccauaggaacauccauuacccagaaaggaauuauuuucauuuugcugaugcugguaacuccauccauggccaugcggugcgugggaauaggcaacagagacuucguggaaggaccgucaggagcuacguggguggaugugguacuggagcauggaaguugcgucacuacaauggcaaaaaacaaaccgacacuggauauugaacucuuaaagacggaggucacaaacccagccauccugcgcaaacugugcauugaagccaaaauaucaaauacuaccaccgauucgagauguccaacacaaggagaagccacgcugguggaagaacaagacacgaacuuugugugucgacgaacguucguggacagaggcuggggcaaugguugugggcuauuuggaaaagguagcuuaauaacgugugcuaaguuuaagugugugacaaaauuggaaggaaagauaguccaauaugaaaauuuaaaauauucagugauagucaccguccacacuggagaccagcaccaaguugggaaugagacuacagaacauggaacaacugcaaucauaacaccucaagcuccuacgucggaaauacagcugacagacuacggagcucuaacaccggacuguucaccuagaacagggcuagacuucaaugagaugguguuguugacaaugaaagaaaaaucauggcucguccacaaacaaugguuucuagacuuaccgcugccuuggaccucgggggcuucaacaucccaagagacuuggaauagacaagacuugcuggucacauuuaagacagcucaugcaaagaagcaggaaguaguuguacuaggaucacaagaaggagcgaugcacacugcgcugacuggagcaacagaaauccaaacgucuggaacgacaacaauuuucgcaggacaccugaaaugcagacugaaaauggauaaacugacuuuaaaagggguaucauauguaaugugcacaggcucauucaagcuagaaaaggaaguggcugagacccagcauggaacuguucuagugcagguuaaguacgaaggaacagaugcaccauguaagauccccuccucaucccaagaugagaagggagugauccagaaugggagauugauaacggccaaccccauagucacugacaaagaaaaaccagucaacauugaggcggagccaccuuuuggugagagcuacaucgugguaggagcaggugagaaagcuuugaaacuaagcugguucaagaagggaagcaguauagggaaaauguuugaagcaacugcccguggagcacgaaggauggccauucugggagacacugcaugggacuucgguucuauaggaggaguguucacguccgugggaaaacugguacaccagauuuuuggaacugcguacggaguuuuguucagcgguguuucuuggaccaugaaaauaggaauagggauucuguugacauggcuaggauuaaauucaaggagcacgucccuuucaaugacguguaucgcaguuggcaugguuacacuguaccuaggagucaugguucaggcggacucgggauguguaauuaacuggaaaggcagagaacucaaauguggaagcggcauuuuugucacuaaugaaguucacaccuggacagagcaauacaaauuccaggccgacuccccaaagagacuaucagcagccauagggaaggcaugggaggaggguguguguggaauucgaucagccacucgucucgagaacaucauguggaagcaaauaucaaaugaauuaaaccacaucuuacuugaaaaugacaugaaauucacaguggucguaggagaugucagugggaucuuggcccaaggaaagaaaaugauuaggccacaacccauggaacacaaauacucguggaaaagcuggggaaaagccaagaucauaggagcagauguacagaacaccaccuucaucaucgacggcccaaacaccccagaaugcccugauaaccaaagagcauggaacaucugggaaguugaagacuauggauuuggaauuuucacgacaaacauaugguugaaauugcgugacucuuuuacucaagugugugaccaccggcuaaugucagcugccauuaaggauagcaaagcaguccaugcugacaugggguacuggauagaaagugaaaagaaagagacuuggaaguuggcaagagccuccuucauagaaguuaagacaugcaucuggccaaaaucccacacucuauggagcaauggaguccuggaaagugagaugauaaucccaaagauauauggaggaccaguaucucagcacaacuacagaccaggauauuucacacaaacagcagggccauggcacuuaggcaaguuggaacuagauuuugauuugugugaagguaccacaguuguuguggaugaaaauuguggaaaucgaggaccaucucuuagaacuacaacagucacaggaaagacaacccaugaaaggugcuguagaucuugcacguuacccccucuacguuucaaaagggaagacgggugcugguacggcauggaaaucagaccagucaaggagaaggaagagaaccuaguuaagucaaugguuucugcagggucaggagaaguggauaguuuuucacuaggacugcuaugcauaucaauaaugaucgaagagguaaugagauccagauggagcagaaagaugcugaugacuggaacauuggcuguguuccuccuucucacaaugggacaaucgacauggaaugaucugaucaggcuauguaccaugguuggagccaaugcuucagacaugauggggaugggaacaacguaccuagcuuugauggccacuuucagaaugagaccaauguucgcagucggacucuuauuucgcagauuaacaucuagagaaauucuucuucuuacaguuggauugagccugguggcaucuguagaacuaccaaauuccuuagaagagcuaggggauggacuugcaaugggcaucaugauguugaaauuacugacugauuuucagccacaucagcuaugggcuaccuugcugucuuuaacauuugucaaaacaacucugucauugcacuaugcauggaagacaauggccaugauacuaucaauugugucucuccucccuuugugccuguccacgacaucucaaaaaacgacauggcuuccggugcugcugggaucucuuggaugcaaaccacuaaccauguuucuuauaacagaaaacaaaauuugggggaggagaaguuggccccucaaugaaggaauuauggcuauuggaauaguaagcauccuacuaaguucaccucucaaaaaugaugugccacuagcuggcccacuaauagcuggaggcaugcuaauagcauguuaugucauaucuggaagcucagccgacuuaucacuggagaaagcggcugagguuuccugggaagaugaagcagaacacucuggugccucacacaacauacuaguggagguccaagaugacggaaccaugaagauaaaagaugaagagagagaugacacacucaccauucuccucaaagcuacucuguuaguaaucucagggguauacccaaugucaauaccggcgacucucuuugugugguauuuuuggcagaaaaagaaacagagaucaggagugcuaugggacacacccagcccuccagaaguggaaagagcaguccuugacaauggcauuuauagaauucuccaaagaggauuguugggcaggucucaaguaggaguaggaguuuuucaagaagguguguuccacacaauguggcacgucaccaggggagcuguucucauguaccaagggaagagauuggaaccaaguugggcuagugucaaaaaagacuugaucucauauggaggagguuggagguuucaaggauccuggaacacgggagaagaagugcaggugauugcuguugaaccggggaagaaccccaaaaauguacagacaacgccaggcaccuucaagaccccugaaggugaaguuggagcuauagcucuagacuucaagcccggcacaucuggaucuacuaucgugaacagagagggaaaaauagugggucuuuauggaaauggaguggugacaacaaguggaaccuacgucagugccauagcucaagcuaaagcaucacaagaagggccccuaccagagauugaggacgagguguuuaggaaaaggaauuuaacaauaauggaccuacauccaggaucagggaaaacgagaagauaccuuccagccauaguccgugaggccauaaaaagaaagcugcgcacgcuagucuuggcccccacaagaguugucgcuucugaaauggcagaagcgcuuaagggaaugccaauaagguaucagacaacagcagugaaaagugaacacacgggaaaggagauaguugaucuuaugugucacgccacuuucacuaugcgucuccugucuccugugagaguccccaauuauaacaugauuaucauggaugaagcacauuucaccgauccagccagcauagcagccagaggguacaucucaacccgaguagguaugggugaagcagcugcgaucuucaugacagccacuccccccggaucgguggaggccuuuccacagagcaaugcaguuauccaagaugaggaaagagacauuccugaaagaucauggaacucaggcuaugaauggaucacugauuucccagguaaaacagucugguuuguuccaagcaucaaaucaggaaaugacauugccaacuguuuaagaaagaaugggaaacgggugguccaauugagcagaaaaacuuuugacacugaguaccagaaaacaaaaaauaacgacugggacuauguugucacaacagacauauccgaaaugggagcaaacuuccgagccgacaggguaauagacccaaggcggugccugaaaccgguaauacuaaaagaugguccagagcgugucauccuagccggaccgaugccagugacuguggcuagugccgcccagaggagaggaagaauuggaaggaacccaaauaaggaaggugaucaguacguguacaugggacagccucuaaacaaugaugaggaccacgcccauuggacagaagcaaaaaugcuccuugacaacauaaacacaccagaagggaucauuccagcccucuuugagccggagagagaaaagagugcagcaauagacggggaauacagauuacggggugaagcgaggaaaacguucguggaacucaugagaagaggagaucuaccugucuggcuauccuacaaaguugccucagaaggcuuccaguacucugacagaagauggugcuuugauggggaaaggaacaaccagguguuggaggagaacauggacguggagauuuggacaaaagaaggagaaagaaagaaacuacgaccccgcuggcuggaugccagaacauauucugacccacuggcucugcgcgaauucaaagaguucgcagcaggaagaagaagugucucaggugaccuaauauuagaaauagggaaacuuccacaacauuuaacgcuaaaagcucagaaugcuuuggauaaucuggucaugcugcacaacucugaacaaggagguaaagccuacagacacgccauggaagaacuaccagauaccauagaaacguuaaugcuccuagcucugauagcuguguugacugguggagugacgcuguucuuccuaucaggaagaggucuaggaaaaacauccauuggccuacucugugugauggccucaaguguacuguuguggauggccaguguggagccucauuggauagcggccucuaucauacuggaguucuuucugaugguguugcuuauuccagagccagaccgacagcgcacuccacaagacaaccagcuagcauauguggugauagguuuguuauucaugauauugacaguggcagccaaugagaugggauuguuggaaaccacaaagaaagaccuggggauuggucaugcagcugcugaaaaccaccaccaugcugcaaugcuggacguggaccuacauccagcuucagccuggacucucuaugcaguggccacaacaaucaucacucccaugaugagacacacaauugaaaacacaacggcaaauauuucccugacagcuaucgcaaaccacgcagcuauauugaugggacuugacaagggauggccaauaucaaagauggacauaggaguuccacuucucgccuuggggugcuauucucaggugaacccgcugacgcugacagcggcgguauugaugcuaguggcucacuaugccauaauuggaccuggacugcaggcaaaagcuacuagagaagcucaaaaaaggacagcagcuggaauaaugaaaaacccaacugucgacgggaucguugcaauagauuuggacccuguaguuuacgaugcaaaaauugaaaaacagcuaggccaaauaauguuguugauacuuugcacaucacagauucuccuaaugcggaccacaugggccuugugugaauccaucacauuggccacuggaccucugaccacgcuuugggagggaucuccaggaaaauucuggaacacaacuauagcgguguccauggcaaacauuuucaggggaaguuaucuagcaggagcaggucuggccuuuucauugaugaaaucucuaggaggagguaggagaggcacaggagcccaaggagaaacgcugggagaaaaauggaaaagacagcuaaaccaauugagcaaaucagaauuuaacauuuacaagaggagugggauuauagagguggauagaucugaagccaaagagggguugaaaagaggagaaacaaccaaacaugcagugucgagaggaacggccaaauugaggugguuuguggaaaggaaccuugugaaaccagaagggaaagucauugaccucgguuguggaagagguggcuggucauauuacugcgcugggcugaagaaagucacagaaguaaaaggauacacgaaaggaggaccuggacaugaggaaccaaucccaauggcaaccuauggauggaaccuaguaaagcuacacucuggaaaagauguauucuuuacaccaccugagaaaugugacacccuuuugugugauaucggugaguccucuccgaacccaacuauagaagaaggaagaacauuacguguucuaaagaugguggaaccauggcucagaggaaaucaauuuugcauaaaaauucuaaaucccuauaugccgagugugguagaaacucuggagcaaaugcaaaggaaacauggaggaaugcuagugcgaaauccacucucaagaaacuccacucaugaaauguacuggguuucauguggaacaggaaacauugugucagcagugaacaugacaucuagaaugcugcuaaaucgauucacaauggcucacaggaagccaacauaugaaagagacguggacuuaggcgcuggaacaagacauguggcaguggaaccagagguggccaaccuagauaucauuggccagaggauagagaauauaaaaaaugaacacaaaucaacauggcauuaugaugaggacaauccauacaaaacaugggccuaucauggaucauaugaggucaagccaucaggaucagcuucauccauggucaaugguguggugagacugcuaaccaaaccaugggaugucauucccauggucacacaaauagccaugacugauaccacacccuuuggacaacagaggguguuuaaagagaaaguugauacgcgcacaccaaaagcgaaacgaggcacagcgcaaauuauggagguaacagccaggugguuaugggguuuucucucuagaaacaaaaaacccagaaucugcacaagggaggaguuuacaagaaaaguuaggucaaacgcagccauuggagcaguguucguugacgaaaaccaguggaacucagcaaaagaggcaguggaagaugaacgguuuugggaccuugugcacagagagagagagcuucauaaacaaggaaaaugugccacgugugucuacaacaugaugggaaggagagagaaaaaauuaggagaguucggaaaggcaaaaggaagucgcgcaauaugguacaugugguugggagcgcgcuuuuuagaguuugaagcccuugguuucaugaaugaagaucauugguucagcagagagaauucacucaguggaguggaaggagaaggacaccacaaacuuggauacauacuuagagacauaucaaagauuccagggggaaauauguaugcagaugacacagccggaugggacacaagaauaacagaggaugaucuucagaaugaggcaaaaaucacugacaucauggaaccugaacaugcccuauuggccacgucaaucuuuaagcuaaccuaccaaaacaagguaguaagggugcagagaccagcaaaaaauggaaccgugauggaugucauauccagacgugaccagagaggaaguggacagguuggaaccuauggcuuaaacaccuucacuaacauggaggcccaacuaauaagacaaauggagucugagggaaucuuuucaccuagcgaauuggaaaccccaaaccuagcugaaagagucuucgacugguuggaaaaacauggcaucgagaggcugaaaagaauggcaaucaguggagaugacuguguggugaaaccaauugaugacagauuugcaacagccuuaacagccuugaaugacaugggaaagguaagaaaagacauaccgcaaugggaacccccaaaaggauggaacgauuggcaacaagugccuuuuuguucacaccauuuccaccagcugauuaugaaggaugggagggagauaguggugccaugccgcaaccaagaugaacuuguggguagggccagagucucgcaaggcgccggauggagcuugagagaaacugcaugccuaggcaagucauaugcacaaauguggcagcugauguacuuccacaggagagauuugagacuagcggcuaaugccaucuguucagccguuccaguugacugggucccaaccagccgcaccaccuggucgauccaugcccaccaucaguggaugacaacagaagacauguugucaguguggaauaggguuuggauagaggaaaacccauggauggaggacaagacucauguguccaguugggaagacguuccauaccuagggaaaagggaagaucaaugguguggaucccuaauaggcuuaacagcacgagccaccugggccacaaacauacaaguggccauaaaccaagugagaaggcucauugggaacgagaacuaucuagacuauaugacaucaaugaagagauucaaaaacgagagugauccugaaggagcacucugguga

SEQ ID NO: 6346 - RNA, 9879 nt, Artificial Sequence
  derived and/or modified CDS sequence (wt) from DENV-1__HQ332182__SS-prME
uccgugaccaugcuccucaugcugcugcccacagcccuggcguuccauuugaccacacgagggggagagccacacaugauaguuaguaagcaggaaagaggaaagucacucuuguuuaagaccucugcaggugucaacaugugcacucucauugcgauggacuugggagaguuaugugaggacacaaugaccuacaaauguccccggaucacugaggcggaaccagaugacguugacugcuggugcaaugccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagacuugggcuuugagacacccaggauucacggugauagcccuuuucuuagcacaugccauaggaacauccaucacucagaaagggaucauuuucauuuuguuaaugcuggugacaccaucaauggccaugcgaugcgugggaauaggcaacagagacuucguugaaggacugucaggagcaacguggguggacgugguauuggagcauggaagcugcgucaccaccauggcaaaaaauaaaccaaccuuggacauugaacucuugaagacggaggucacgaacccugccgucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcugggguaaugguugcggacuauucggaaagggaagccuauugacgugugccaaguucaagugugugacaaaacuagaaggaaagauaguucaauaugaaaacuugaaauauucagugauagucacuguccacacuggggaccagcaccaggugggaaaugagacuacagaacacggaacaauugcaaccauaacaccucaagcuccuacgucggaaauacagcugacugacuacggagcccucacauuggacugcucaccuagaacagggcuggacuuuaaugagauggugcuauuaacaaugaaagaaaaaucauggcuuguccacaaacaaugguuucuagacuuaccacugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaccugaaaugcagacuaaaaauggauaaacugacuuuaaaggggacgucauaugugaugugcacaggcucauuuaagcuagagaaggaaguggcugagacccaacauggaacuguucuagugcaggucaaauacgaaggaacagacgcgccaugcaagauccccuuuucgacccaagaugagaaaggagugacccagaauggaagauugauaacagccaaucccauaguuacugacaaagaaaaaccagucaacauugagacagaaccaccuuuuggugagagcuacaucgugguaggggcaggugaaaaagcuuugaaacuaagcugguucaagaaaggaagcagcauagggaaaauguucgaagcaacugcccgaggagcacgaaggauggcuauccugggagacaccgcaugggacuucggaucuauaggaggaguguucacaucuguaggaaaauugguacaccagguuuuuggaaccgcauaugggguucuguucagcgguguuucuuggaccaugaaaauaggaauagggauucugcugacaugguugggauuaaauucaaggagcacgucacuuucaaugacgugcauugcaguuggcaugguuacacuguaccuaggagucaugguucaagcggacucgggauguguaaucaacuggaagggcagagaacuuaaauguggaaguggcauuuuugucacuaaugaaguccacacuuggacagagcaauacaaguuccaggcugacuccccaaaaagacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaaggaaaaaaaaugauuaggccacaacccauggaacacaaauacucauggaaaagcuggggaaaagcuaaaaucauaggagcagacauacaaaauaccaccuucaucaucgacggcccagauaccccagaaugcccugaugaccaaagagcguggaacauuugggaaguugaggacuauggguuuggaauuuucacgacuaacauauggcugaaauugcgugacuccuacacccaaaugugugaccaccggcuaaugucagcugccaucaaggacagcaaggcaguccaugcugacaugggguacuggauagaaagugaaaagaacgaaaccuggaaguuggcgagagccuccuucauagaagucaagacaugcaccuggccgaaaucucacacucuauggagcaauggaguuuuggaaagugaaaugauaaucccaaagauauauggaggaccaauaucucagcacaacuacagaccaggguauuucacacaaacagcagggccauggcaccuaggcaaguuggaauuggacuuugacuugugugaagguaccacaguuguuguggaugaacauuguggaaaucgagguccaucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucgauggucucugcagggucaggagaaguggacaguuuuucauugggaauacuaugcguaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuguuucgcagacuaacauccagagaaguucuucuucucacgauuggauuaagccugguggcauccguagagcuaccaaauucuuuggaggagcuaggggauggacuugcaauggguaucaugauguuaaaauuauugacugaauuucagccacaccaguuauggaccaccuuacugucucugacauuuaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggcccaucaaugaaggaaucauggcuauuggaauagucagcauucuacugaguucacuccucaaaaaugaugugccguuggccggcccacuaauagcuggaggcaugcuaauagcauguuaugucauauccggaagcucagccgauuuaucauuggagaaagcggcugagguguccugggaacaagaagcagaacacucagguaccucacacaacauauuaguagagguccaagaugacggaacuaugagaauaaaagaugaagagaaggaugacacacucacuauacuccuuaaagcaacuuugcuggcagucucaggaguguacccaaugucaauaccagcaacucuuuuugugugguauuucuggcagaaaaagaaacagagaucaggaguguuaugggacacacccagcccuccggaaguggaaagagcaguucuugaugauggcaucuauagaaucuugcaaagaggacuguugggcagaucccaagugggagugggaguuuuccaagacggcguguuccacacaauguggcacgucaccaggggagcuguccuuauguaccaagggaagaggcuggaaccaagcugggccagugucaaaaaggacuugaucucauauggaggagguuggagguuucaaggaucauggaacacgggagaagaagugcaggugauagcuguugaaccaggaaaaaaccccaaaaauguacagacaacgccggguaccuucaagacuccugaaggcgaagucggagccauagcucuagauuuuaaacccggcacaucuggaucucccaucgugaacagagagggaaaaauaguaggucuuuauggaaacggaguggugacaacaaguggaaccuacgucagugccauugcucaagcuaaagcaucacaggaagggccucuaccagagauugaggacgagguguucaagaaaagaaacuuaacaauaauggaccugcauccaggaucaggaaaaacaagaagauaucuuccagccauaguccgugaggccauaaaaaggaaacugcguacguuaaucuuggcucccacaagaguugucgccucugaaauggcagaggcgcucaagggaaugccaauaagauaucagacaacagcagugaagagugaacacacaggaagggagauaguagaucucaugugccacgccacuuuuaccaugcgucucuuauccccagugagaguucccaauuacaacaugauuauuauggaugaagcacauuucaccgauccagccagcauagcggccagaggguacaucucaacccgaguggguaugggugaagcagcugcgaucuuuaugacagccacucccccaggaucgguagaggccuuuccacagaguaaugcaguuauccaagaugaggaaagagacauuccugagagaucauggaacucaggcuacgacuggaucacugauuuuccagguaaaacagucugguuugucccaagcauuaaaucaggaaaugacauugccaacuguuuaagaaagaacggaaaacggguaauccaauugagcagaaaaaccuuugacacugaguaccagaaaacaaaaaauaaugauugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaccaguauguuuacaugggacagccuuugaauaacgaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccacuggcccugcgcgaguuuaaagaguuugcagcaggaagaagaagugucucaggugaccuaauauuggaaauagggaaacuuccacaacacuugacgcugagagcccagaaugcucuggauaacuuggucauguugcacaauuccgaacaaggaggaaaagccuacagacaugcuauggaggaacuaccagacaccauagaaacauugaugcuucuagcuuugauagcuguguugacugguggagugacgcuguucuuccuaucaggaaaaggucuagggaaaacauccauuggcuugcucugugugacggccucaagcguacuguuauggauggccaguguggagccccauuggauagcggccuccaucauacuagaguucuucuugauggugcugcucauuccagagccagacagacagcgcacuccacaggacaaccagcuagcauauguggugauagguuuguuauucaugauacugacaguggcagccaaugagaugggauuauuggaaaccacaaagagagaccuggggauuggccauguggccgccgaaaaccaccaacaugcuacaaugcuggacguagaccuacguccagcuucagccuggacucucuaugcaguagccacaacaguuaucacucccaugaugagacacacaauugaaaacacaacggcaaacauuucccugacagccauugcaaaucaggcagcuauauugaugggacuugacaagggauggccaauaucgaagauggacauaggagucccacuucucgccuuagggugcuauucccaggugaacccauugacacugacagcggcaguguugauguuaguggcucauuaugccauaauuggaccaggacugcaagcaaaggccacuagagaagcucaaaaaaggacagcggccggaauaaugaaaaauccaacuguagacgggauuguugcaauagacuuggauccugugguuuaugaugcaaaauuugaaaaacagcuaggccaaauaaugcuacugauacuuugugcaucacaaguccucuugaugcggaccacaugggccuugugugaauccaucacacuggcgacuggaccccugaccacucucugggagggaucuccaggaaaauucuggaauaccacgauagcaguguccauggcaaacaucuucaggggaaguuaucuagcaggagcaggucuggcuuucucauugaugaaaucuuuaggaggagguaggagagguacgggagcucaaggggaaacacugggagagaaauggaaaagacaguuaaaccaacugagcaagucagaauucaacaccuacaaaaggagugggauuauggagguggacagauccgaagccaaagagggacuaaaaagaggagaaacaaccaaacaugcagugucgagaggaacagcuaaacugaggugguuuguggagaggaaccucgugaaaccagaagggaaagucauagaccucgguuguggaagggguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguauucuuuaugccaccugagaaaugugacacccuuuugugugauauuggugaguccucuccgaauccaacuauagaagaaggaagaacguuacguguucuaaaaaugguggaaccauggcucagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaauauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaggacaauccauacaaaacaugggccuaucauggaucauaugaggucaagccaucaggaucagccucaucuaugguaaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggugacagccaagugguugugggguuuccuuuccagaaacaaaaaacccagaaucugcacaagagaggaguucacaagaaagguuaggucaaacgcagcaguaggagcaguguucguugaugaaaaccaauggaacucagcaaaagaagcaguggaagacgaaagguuuugggaucuugugcacagagagagggagcuucauaaacagggaaaaugugccacgugugucuacaacaugauggggaagagagagaaaaaacuaggagaguuuggaaaggcaaaaggaagccgugcaauaugguacauguggcugggagcacgcuuucuggaguucgaagcccuugguuucaugaaugaagaucacugguuuagcagagagaauucacucaguggaguggaaggagaaggacugcacaaacuuggauacauacucagagacauaucaaagauuccagggggaaauauguaugcagaugauacagccggaugggacacaagaauaacagaggaugaucuucagaaugaggcuaaaaucacugacaucauggagccugaacaugcucuauuggcuacaucaauuuuuaagcugaccuaucaaaauaagguggugagggugcaaagaccagcaaaaaauggaaccgugauggauguuauaucuagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcaacagccuuaacagcucugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuuguaggcagggcuagaguaucacaaggcgccggauggagccugagagaaacugcuugccuaggcaagucauaugcacaaauguggcaguugauguacuuccacaggagagaccugagacuagcggcuaacgccaucuguucagccgucccaguugauugggucccaaccagccgcacaaccuggucaauucaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccaccaacauacaaguagccauaaaccaagugagaaggcucaucgggaaugagaauuaucuagauuacaugacaucaaugaagagauucaagaaugagagugaucccgaaggggcacucugguaa

SEQ ID NO: 6347 - RNA, 9879 nt, Artificial Sequence
  derived and/or modified CDS sequence (wt) from DENV-1__HQ332181__SS-prME
uccgugaccaugcuccucaugcugcugcccacagcccuggcguuucauuugaccacacgagggggagagccacacaugauaguuaguaagcaggaaagaggaaagucacuuuuguuuaagaccucugcgggcgucaauaugugcacccucauugcgauggacuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagagaaacguuccguggcacuggccccacacgugggacuuggucuagaaacaagaaccgaaacauggauguccucugaaggcgccuggaaacaaauacaaagaguggaaacuugggcuuugagacacccaggauucacggugauagcuuuuuuuuuagcacaugcuauaggaacauccaucacucagaaagggaucauuuucaucuugcugaugcuggugacaccaucaauggccaugcgaugcgugggaauaggcaacagagacuucguugaaggacugucaggagcaacguggguggacgugguauuggagcauggaagcugcgucaccaccauggcaaaaaauaaaccaacauuggacauugaacucuugaagacggaggucacgaacccugccgucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcugggguaauggcugcggacuauucggaaagggaagucuauugacgugugccaaguucaagugugugacaaaacuagagggaaagauaguucaauaugaaaaccuaaaauauucagugauagucacuguccacacuggggaccagcaccaggugggaaacgagaccacagaacauggaacaauugcaaccauaacaccucaagcucccacgucggaaauacagcugaccgacuacggagcccucacauuggacugcucaccuagaacagggcuggacuuuaacgagauggugcuauugacaaugaaagaaaaaucauggcuuguccacaaacaaugguuucuagacuuaccacugccauggacuucgggggcuucaacaucucaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuucgcaggacaccugaaaugcagacuaaaaauggauaaacugaccuuaaaggggaugucauaugugaugugcacaggcucauuuaagcuagagaaggaaguggcugagacccagcauggaacuguucuagugcaggucaaauaugaaggaacagacgcgccaugcaagauccccuuuucgacccaagaugagaaaggagugacccagaaugggagauugauaacagccaaucccauaguuacugacaaagaaaaaccagucaacauugagacagaaccaccuuuuggugagagcuacaucgugguaggggcaggcgaaaaagcuuugaaacuaagcugguucaagagaggaagcagcauagggaaaauguucgaagcaaccgcccgaggagcacgaaggauggcuauccugggagacaccgcaugggacuucgguucuauaggaggaguguuuacaucugugggaaaauugguacaccagguuuuuggaaccgcauaugggguucuguuuagcgguguuucuuggaccaugaaaauaggaauagggauucugcugacaugguugggacuaaauucaaggagcacgucacuuucgaugacgugcauugcaguuggcauggucacacuguaccuaggagucaugguccaagcggauucgggauguguaaucaacuggaagggcagagaacuuaaauguggaaguggcauuuuugucacuaaugaaguccacacuuggacagagcaauacaaauuccaggcugacuccccaaaaagacugucagcagccauuggaaaagcaugggaggagggcguguguggaauucgaucagccacgcgucuugagaacaucauguggaagcaaauaucaaaugaauugaaccacauucuacuugagaaugacaugaaauucacagugguuguaggagaugccaacggaauuuugguccagggaaaaaaaaugauuaggccacaacccauggaacacaaauacucauggaaaagcuggggaaaagcuaaaaucauaggagcagacauacaaaauaccaccuucaucaucgacggcccagacaccccagaaugucccgauggccaaagagcauggaacauuugggaaguagaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuacaggccaggguauuucacacaaacagcagggccauggcaccuagguaaguuggaauuggauuuugacuugugugaagguaccacaguuguuguggaugaacauuguggaaaucgagguccaucucucagaaccacaacagucacaggaaagauaauccaugaaugguguugcagauccugcacgcuaccccccuuacguuucagaggagaagacggguguugguauggcauggaaaucagaccaguaaaggagaaggaggagaaucuaguuaggucaaugguuucugcagggacaggagaaguggauaguuuuucauuaggaauacuaugcguaucaauaaugauugaagaagugaugagauccagauggaguagaaagaugcugaugacuggaacacuggcuguuuuccuccuucuuauaaugggacaauugacauggaaugauuugauuagguuaugcaucaugguuggagcuaaugcuucagacaggauggggaugggaacaacguaccuagccuugauggcuacuuucaaaaugagaccaauguucgcuguugggcuauuauuccgcagacuaacauccagagaaguucuucuccucacgauuggauuaagccugguggcauccguggagcuaccaaauucuuuggaggagcuaggggauggacuugcaauggguaucaugauguuaaaauuguugacugaauuucagccacaccaguuauggaccaccuuauugucucugacauuugucaaaacagcucucucauuggauuaugcauggaaaacaacggcuaugguacugucuaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaagcuggccccucaaugaaggaauuauggcuauuggaauagucagcauucuacuaagcucacuccucaaaaaugaugugccguuggccgggccacuaauagcuggaggcaugcuaauagcauguuaugucauauccggaagcucagccgauuuaucauuggagaaagcggcugaaguauccugggaacaagaagcagaacacuccggugccucacacaacauauuaguagagguccaagaugauggaacuaugaaaauaaaagaugaagagagggaugacacacucacuauacuucuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcaguucuugacaauggcaucuauagaaucuugcaaagaggacuguugggcaggucccaaguaggagugggagucuuccaagacggcguguuccacacaauguggcacguuaccaggggagcuguccuuauguaccaagggaagagacuggaaccaagcugggccagugucaaaaaggacuugaucucauauggaggagguuggagguuccaaggaucauggaacacgggagaagaagugcaggugauagcuguugaaccaggaaaaaaccccaaaaauguacagacaacgccaggcaccuucaagacuccugaaggcgaaguuggagccauagcucuagauuucaaacccggcacaucuggaucucccauugugaacagagagggaaaaauagugggucuguauggaaauggaguggugacaacaaguggaaccuacgucagugccauugcccaagcuaaagcaucacaggaagggccucuaccagagauugaggacgagguguuuaagaaaagaaacuuaacaauaauggaccugcacccaggaucagggaaaacaagaagauaucuuccagccauaguccgugaggccauaaaaaggaaacugcguacguuaaucuuggcucccacaagaguugucgccucugaaauggcagaggcacucaagggaaugccaauaagauaucagacaacagcagugaagagugaacacacaggaagggagauaguugaccucaugugccacgcuacuuuuaccaugcgucucuuauccccagugagaguucccaauuacaacaugauuauuauggaugaagcacauuuuaccgauccagcuagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggauuacugacuuuccagguaaaacagucugguuuguuccaagcauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuucugaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaccaguauguuuauaugggacagccuuuaaacaaugaugaggaucacgcucauuggacagaagcaaaaaugcuccuugacaauauaaacacaccagaagggaucaucccagcccuuuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcgaccucgcugguuggacgccagaacauacucugauccauuggcccugcgcgaguuuaaagaguucgcagcaggaagaagaagugucucaggugaccuaauauuggaaauagggaaacuuccacaacauuugacgcuaagagcccagaaugcucuggacaacuuggucauguugcacaauuccgaacaaggaggaaaagccuacagacaugcuauggaggaacuaccagacaccauagaaacauugaugcuucuagcuuugauagcuguguugacugguggagugacgcuguucuuccuaucaggaaaaggccuagggaaaacauccauuggcuugcucugugugacggccucaagcgcacuguuauggauggccaguguggagccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggcuauguagccgccgaaaaccaccaacaugcuacaaugcuggacguagaccuacacccagcuucagccuggacccucuaugcaguagccacaacaguuaucacucccaugaugagacacacaauugaaaauacaacggcaaacauuucccugaccgccauugcaaaucaggcagcuauauugaugggacuugacaagggauggccaauaucgaagauggacauaggaguuccacuucucgccuuagggugcuauucccaggugaacccauugacacugacagcggcgguguugauguuaguagcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacaauagcaguguccauggcaaacaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugagcaagucagaauucaauaccuacaaaaggagugggauuauggagguggacagauccgaagccaaagagggacugaaaagaggagaaacaaccaaacaugcagugucgagaggaacagccaaacugaggugguuuguggagaggaaccucgugaaaccagaaggaaaagucauagaccucgguuguggaagagguggcuggucauauuauugugcugggcugaagaaaguuacugaagugaagggauacacaaaaggaggaccuggacaugaggaaccuaucccaauggcgaccuauggauggaaccuaguaaagcuacacucuggaaaggauguauuuuuuaugccaccugagaaaugugacacccuucugugugauauuggugaguccucuccgaauccaacuauagaagaaggaagaacguuacguguucuaaaaaugguggaaccauggcucagaggaaaccaauucugcauaaaaauccuaaauccuuacaugccaagugugguagaaacucuggagcaaaugcaaagaaaacauggagggaugcuagugcgaaacccacucucaagaaauucuacccaugaaauguauuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguagccaaccuagauaucauaggccagaggauagagaauauaaaaaaugaacacaagucaacauggcauuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugacugauaccacacccuuuggacaacagagaguguuuaaagagaaaguugauacgcgcacaccaagagcaaaacgaggcacaacacagauuauggaggugacagccaagugguuaugggguuuccuuuccagaaacaaaaaacccagaaucugcacaagagaggaguucacaagaaagguuaggucaaacgcggcaauaggagcaguguucguugaugaaaaccaauggaacucagcaaaagaagcaguggaagacgaaagguuuugggaucuugugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaagcccuugguuucaugaaugaagaccacugguuuaguagagagaauucacucaguggaguggaaggagaaggacugcacaaacuuggauacauacucagagacauaucaaagauuccggggggaaauauguaugcagaugauacagccggaugggacacaagaauaacagaggaugaucuucagaaugaggcuaaaaucacugacaucauggagccugaacaugcucuauuggcuacgucaauuuuuaagcugacuuaucaaaacaagguggugagggugcaaagaccagcaaaaaauggaaccgugauggauguuauauccagacgugaucagagaggaaguggacaggucggaacuuauggcuuaaauacuuucaccaauauggagguccaacuaauaagacaaauggagucugaaggaaucuuucuacccagcgaauuggaaacccccaaccuagcugagagggcucuugacugguuagaaaaacauggcgccgaaaggcugaaacgaauggcaaucagcggagaugauugcguggugaaaccaauugacgacagguucgcaacagccuuaacagcucugaaugacaugggaaaaguaagaaaagacauaccgcagugggaaccuucaaaaggauggaaugauuggcagcaagugccuuuuuguucacaccauuuccaccagcugaucaugaaggaugggagggaaauaguggugccaugccgcaaccaagaugaacuugugggcagggcuagaguaucacaaggugccggauggagccugagagaaacugcuugccuaggcaagucauaugcacaaauguggcagcugauguacuuccacaggagagaccugagacuagcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuaggaaaaagggaagaucaaugguguggaucccugauaggcuugacagcgagggccaccugggccaccaacauacaaguagcuauaaaccaagugagaaggcucaucgggaaugagaauuauuuagauuacaugacaucaaugaagagauucaagaaugagagugauuccgaaggagcacucugguaa

SEQ ID NO: 6348 - RNA, 9879 nt, Artificial Sequence
  derived and/or modified CDS sequence (wt) from DENV-1__HQ332180__SS-prME
uccgugaccaugcuccucaugcugcugcccacagcccuggcguuccauuugaccacacgagggggagagccacacaugauaauuaguaagcaggaaagaggaaagucacucuuguuuaagaccucugcaggugucaauaugugcacucucauugcgauggacuugggagaguuaugugaggacacaaugaccuacaaaugcccccggauuacugaggcggaaccagaugacguugacugcuggugcaacgccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagaccugggcuuugagacacccaggauucacggugauagcccuuuuuuuagcacaugcuauaggaacauccaucacucagaaagggaucauuuucaucuugcugaugcuggugacaccaucaauggccaugcgaugcgugggaauaggcaacagagacuucguugaaggacugucaggagcaacguggguggacgugguauuggagcauggaagcugcgucaccaccauggcaaaaaauaagccaacauuggacauugaacucuugaagacggaggucacaaauccugccgucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcugggguaacggcugcggacuauucggaaagggaagucuauugacgugugccaaguucaagugugugacaaaacuagaaggaaagauaguucaauaugagaacuuaaaauauucagugauaguuaccguccacacuggggaccagcaucagguggggaacgagaccacagaacauggaacaauugcaaccauaacaccucaagcuccuacgucggaaauacagcugaccgacuacggagcccuuacauuggacugcucaccuagaacagggcuggacuuuaaugagauggugcuauugacaaugaaagaaaaaucauggcuuguccacaaacaaugguuucuagacuuaccacugccauggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuucgcaggacaccugaaaugcagacuaaaaauggacaaacugacuuuaaaggggaugucauaugugaugugcacaggcucauucaagcuagagaaggaaguggcugagacccagcauggaacuguucuagugcaggucaaauacgaaggaacagacgcgccaugcaagauccccuucucgacucaagaugagaaaggagugacccagaaugggagauugauaacagccaaucccauaguuacugacaaagaaaaaccagucaacauugagacagaaccaccuuuuggugagagcuacaucgugguaggggcaggcgaaaaagcuuugaaacuaagcugguucaagaaaggaagcagcauagggaaaauguucgaagcaaccgcccgaggagcacgaaggauggcuauccugggagacaccgcaugggacuucgguucuauaggaggaguguuuacaucugugggaaaauugguacaccagguuuuuggaaccgcauaugggguucuguucagcgguguuucuuggaccaugaaaauaggaauagggauucuguugacaugguugggauuaaauucaaggagcacgucacuuucgaugacgugcauugcaguuggcauggucacacuguaccuaggagccaugguucaagcggacucgggaugugugaucaacuggaagggcagagaacuuaaauguggaaguggcauuuuugucacuaaugaaguccacacuuggacagagcaauacaaauuccaggcugacuccccaaaaagacugucagcagccauuggaaaggcaugggaggagggaguguguggaauucgaucagccacgcgucuugagaacauuauguggaagcaaauaucaaaugaauugaaccacauucuacuugaaaaugauaugaaauucacagugguuguaggagaugcuaacggaauuuuggcccaagggaaaaaaaugauuaggccacaacccauggaacacaaauacucauggaaaagcuggggaaaagcuaaaaucauaggagcagacauacaaaauaccaccuuuaucaucgacggcccagacaccccagaaugucccgauggccaaagagcauggaacauuugggaaguugaggacuauggguuuggaauuuucacgacaaacauauggcugaaauugcgugacuccuacacccaaaugugugaccaccggcuaaugucagcugccaucaaggacagcaaggcaguucaugcugacaugggguacuggauagaaagugaaaagaacgaaaccuggaagcuggcgagagccuccuucauagaagucaagacaugcaccuggccaaaaucucacacucuauggagcaauggaguuuuggaaagugaaaugauaaucccaaagauauauggaggaccaauaucucagcacaacuacaggccaggguauuucacacaaacagcagggccauggcaccuagguaaguuggaacuggauuuugacuugugugaaggcaccacaguuguuguggaugaacauuguggaaaucgagguccaucucuuagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuauguguaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacgcaccuagccuugauggcuacuuucaaaaugagaccaauguucgcuguugggcuauuauuccgcagauuaacauccagagaaguucuucuccucacgauuggauuaagccugauggcauccauggagcuaccaaauucuuuggaggagcuaggggauggacuugcaauggguaucaugauguuaaaauuguugacugaauuucagccacaccaguuauggaccaccuuacugucuuugacauuugucaaaacaacucucucauuggauuaugcauggaaaacaacggcuaugauacugucuaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaaucauggcuauuggaauagucagcauucuacuaaguucacuccuaaaaaaugaugugccauuggccggcccacuaauagcuggaggcaugcuaauagcauguuaugucauauccggaagcucagccgauuuaucauuggagaaagcggcugagguguccugggaacaagaagcagaacacuccggugccucacacaacauauuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcaguucuugaugauggcaucuauagaaucuugcaaagaggacuguugggcaggucccaaguaggagugggagucuuccaagacggcguguuccacacaauguggcacgucaccaggggagcuguccuuauguaccaagggaagaggcuggaaccaagcugggccagugucaaaaaggacuugaucucauauggaggagguuggagauuucaaggaucauggaacacgggagaagaagugcaggugauagcuguugaaccaggaaaaaaccccaaaaauguacagacaacgccggguaccuucaagacuccugaaggcgaaguuggagccauagcucuagauuucaaacccggcacaucuggaucucccauugugaacagagagggaaaaauagugggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcacccaggaucaggaaaaacaagaagauaucuuccagccauaguccgugaggccauaaaaaggaaacugcguacguuaaucuuggcucccacaagagucguugccucugaaauggcagaggcacucaagggaaugccaauaagauaucagacaacagcagugaagagugaacacacaggaagggagauaguugaccucaugugccacgcuacuuuuaccaugcgucucuuauccccagugagaguucccaauuacaacaugauuauuauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucaccgacuuuccagguaaaacagucugguuuguuccaagcauuaaaucaggaaaugacauugccaacuguuuaagaaagaacggaaaacggguaauccaacugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagagaagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcggccucgcugguuggaugccagaacauacucugauccacuggcucugcgcgaguuuaaagaguuugcagcaggaagaagaagugucucaggugaccuaauauuggaaauagggaaacuuccacaacauuugacgcuaagagcccagaaugcucuggacaacuuggucauguugcacaauuccgaacaaggaggaaaagccuacagacacgcuauggaggaacuaccagacaccauagaaacauugaugcuucuagcuuugauagcuguguugacugguggagugacgcuauucuuccuaucaggaaaagguuuagggaaaacaucuauuggcuugcucugugugacggccucaagcgcacuguuauggauggccaguguggagccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggcuauguagccgccgaaaaccaccaacacgcuacaaugcuggacguagaccuacgcccggcuucagccuggacccucuaugcaguagccacaacaguuaucacucccaugaugagacauacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuagauccugugguuuaugaugcaaaauuugaaaaacagcuaggccaaauaauguuacugauacuuuguacaucacagauccucuugaugcggaccacaugggccuugugugaauccauuacacuggcuacuggaccccugaccacucucugggagggaucuccaggaaaauucuggaauaccacgauagcaguguccauggcaaacaucuucaggggaaguuaucuagcaggagcaggucuggcuuuuucauuaaugaaaucuuuaggaggagguaggagagguacgggagcucaaggggaaacacugggagagaaauggaaaagacaguuaaaccaacugagcaagucagaauucaacaccuacaaaaggagugggauuauggagguggacagauccgaagccaaagagggacugaaaagaggagaaacaaccaaacaugcagugucgagaggaacagccaaacugaggugguuuguggagaggaaccucgugaaaccagaaggaaaagucauagaccucgguuguggaagagguggcuggucauacuauugugcugggcugaagaaaguuacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguucuaaaaaugguggaaccauggcucaaaggaaaccaauucugcauaaaaauccuaaauccuuacaugccaagugugguagaaacucuggagcaaaugcaaagaaaacauggagggaugcuagugcgaaacccacucucaagaaauucuacccaugaaauguauuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugacugauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaagcccagaaucugcacaagagaggaguucacaagaaaaguuaggucaaacgcggcaauaggagcaguguucguugaugaaaaccaauggaacucggcaaaagaagcaguggaagacgaaagguuuugggaucucgugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaagcccuugguuucaugaacgaagaucacugguuuaguagagagaauucacucaguggaguggaaggagaaggacugcacaaacuuggauacauacucagagacauaucaaagauuccagggggaaauauguaugcagaugauacagccggaugggacacaagaauaacagaggaugaucuucagaaugaggcuaaaaucacugacaucauggagccugaacaugcucuauuggcuacgucaauuuuuaagcugacuuaucaaaacaagguggugagggugcaaagaccagcaaaaaauggaaccgugauggauguuauauccagacgugaccagagaggaaguggacaggucggaacuuauggcuuaaauacuuucaccaauauggagguccaacuaauaagacaaauggagucugaaggaaucuuuuuacccagcgaauuggaaacucccaaccuagcugagagaguucuugacugguuggaaaaacauggcgccgaaaggcugaaacgaauggcaaucagcggagaugauugcguggugaaaccaauugacgacagguucgcaacagccuuaacagcucugaaugacaugggaaaaguaagaaaagacauaccgcagugggagccuucaaaaggauggaaugauuggcagcaagugccuuucuguucacaccauuuccaccagcugaucaugaaggaugggagggaaauaguggugccaugccgcaaucaagaugaacuugugggcagggccagaguaucgcaaggcgccggauggagccugagagaaacugcuugccuaggcaagucauaugcacaaauguggcagcugauguacuuccacaggagagaccugagacuagcggcuaacgccaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccaccaacauacaaguagccauaaaccaagugagaaggcucaucgggaaugagaauuaucuagauuacaugacaucaaugaagagauucaagaaugagagugauccugaaggagcacucugguaa

SEQ ID NO: 6349 - RNA, 9879 nt, Artificial Sequence
  derived and/or modified CDS sequence (wt) from DENV-1__HQ332179__SS-prME
uccgugaccaugcuccucaugcuguugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagaccugggcuuugagacacccaggauucacggugauagcccuuuuuuuagcacaugcuauaggaacauccaucacucagaaagggaucauuuucaucuugcugaugcuggugacaccaucaauggccaugcgaugcgugggaauaggcaacagagacuucguugaaggacugucaggagcaacguggguggacgugguauuggagcauggaagcugcgucaccaccauggcaaaaaauaaaccaacauuggacauugaacucuugaagacggaggucacgaacccugccgucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcugggguaacggcugcggacuauucggaaagggaagucuauugacgugugccaaguucaaaugugugacaaaacuagaaggaaagauaguucaauaugagaacuuaaaauauucagugauaguuaccguccacacuggggaccagcaucaggugggaaacgagaccacagaacauggaacaauugcaaccauaacaccucaagcuccuacgucggaaauacagcugaccgacuacggagcccuuacauuggacugcucaccuagaacagggcuggacuuuaaugagauggugcuauugacaaugaaagaaaaaucauggcuuguccacaaacagugguuucuagacuuaccacugccauggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuucgcaggacaccugaaaugcagacuaaaaauggauaaacugacuuuaaaggggaugucauaugugaugugcacaggcucauucaaguuagagaaggaaguggcugagacccagcauggaacuguucuagugcaggucaaauacgaaggaacagacgcgccaugcaagauccccuucucgacucaagaugagaaaggagugacccagaaugggagauugauaacagccaaucccauaguuacugacaaagaaaaaccagucaacauugagacagaaccaccuuuuggugagagcuacaucgugguaggggcaggcgaaaaagcuuugaaacuaagcugguucaagaaaggaagcagcauagggaaaauguucgaagcaaccgcccgaggagcacgaaggauggcuauccugggagacaccgcaugggacuucgguucuauaggaggaguguuuacaucugugggaaaauugguacaccagguuuuuggaaccgcauaugggguucuguucagcgguguuucuuggaccaugaaaauaggaauagggauucuguugacaugguugggauuaaauucaaggagcacgucacuuucgaugacgugcauugcaguuggcauggucacacuguaccuaggagucaugguucaagcggacucgggaugugugaucaacuggaagggcagagaacuuaaauguggaaguggcauuuuugucacuaaugaaguccacacuuggacagagcaauacaaauuccaggcugacuccccaaaaagacugucagcagccauuggaaaggcaugggaggagggaguguguggaauucgaucagccacgcgucuugagaacaucauguggaagcaaauaucaaaugaauugaaccacauucuacuugaaaaugauaugaaauucacagugguuguaggagaugcuaacggaauuuuggcccaagggaaaaaaaugauuaggccacaacccauggaacacaaauacucauggaaaagcuggggaaaagcuaaaaucauaggagcagacauacaaaauaccaccuuuaucaucgacggcccagacaccccagaaugucccgauggccaaagagcauggaacauuugggaaguugaggacuauggguuuggaauuuucacgacaaacauauggcugaaauugcgugacuccuacacccaaaugugugaccaccggcuaaugucagcugccaucaaggacagcaaggcaguucaugcugacaugggguacuggauagaaagugaaaagaacgaaaccuggaagcuggcgagagccuccuucauagaagucaagacaugcaccuggccaaaaucucacacucuauggagcaauggaguuuuggaaagugaaaugauaaucccaaagauauauggaggaccaauaucucagcacaacuacaggccaggguauuucacacaaacagcagggccauggcaccuagguaaguuggaacuggauuuugacuugugugaaggcaccacaguuguuguggaugaacauuguggaaaucgagguccaucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcgcaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuccgcagauuaacauccagagaaguucuucuccucacgauuggauuaagccugguggcauccguggagcuaccaaauucuuuggaggagcuaggggauggacuugcaauggguaucaugauguuaaaauuguugacugaauuucagccacaccaguuauggaccaccuuacugucuuugacauuugucaaaacaacucucucauuggauuaugcauggaaaacaacggcuaugguacugucuaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaaguucacuccuaaaaaaugaugugccauuggccggcccacuaauagcuggaggcaugcuaauagcauguuaugucauauccggaagcucagccgauuuauuauuggagaaagcggcugagguguccugggaacaagaagcagaacacuccggugccucacacaacauauuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcaguucuugaugauggcaucuauagaaucuugcaaagaggacuguugggcaggucccaaguaggagugggagucuuccaagacggcguguuccacacaauguggcacgucaccaggggagcuguccuuauguaccaagggaagaggcuggaaccaagcugggccagugucaaaaaggacuugaucucauauggaggagguuggagauuucaaggaucauggaacacgggagaagaagugcaggugauagcuguugaaccaggaaaaaaccccaaaaauguacagacaacgccggguaccuucaagacuccugaaggcgaaguuggagccauagcucuagauuucaaacccggcacaucuggaucucccauugugaauagagagggaaaaauagugggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcacccgggaucaggaaaaacaagaagauaucuuccagccauaguccgugaagccauaaaaaggaaacugcgcacguuaaucuuggcucccacaagaguugucgccucugaaauggcagaggcacucaagggaaugccaauaagauaucagacaacagcagugaagagugaacacacaggaagggagauaguugaccucaugugccacgcuacuuuuaccaugcgucucuuauccccagugagaguucccaauuacaacaugauuauuauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugauuuuccagguaaaacagucugguuuguuccaagcauuaaaucaggaaaugacauugccaacuguuuaagaaagaacggaaaacggguaauccaacugagcagaaaaaccuuugacacugaguaccagaaaacaaaaaacaaugacugggacuauguugucacaacggacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagagaagaggaagaauuggaaggaaccaaaacaaggaaggugaucaguauguuuacaugggacagccuuuaaauaaugaugaggaucacgcucauuggacagaagcaaaaaugcuccuugacaacauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcgaccucgcugguuggaugccagaacauacucugauccacuggcucugcgcgaguuuaaagaguuugcagcaggaagaagaagugucucaggugaccuaauauuggaaauagggaaacuuccacaacauuugacgcuaagagcccagaaugcucuggacaacuuggucauguugcacaacuccgaacaaggaggaaaagccuacagacacgcuauggaggaacuaccagacaccauagaaacauugaugcuucuagcuuugauagcuguguugacugguggagugacgcuauucuuccuaucaggaaaagguuuagggaaaacaucuauuggcuugcucugugugacggccucaagcgcacuguuauggauggccuguguggagccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggcuauguagccgccgaaaaccaccaacacgcuacaaugcuggacguagaccuacgcccagcuucagccuggacccucuaugcaguagccacgacaguuaucacucccaugaugagacacacaauugaaaauacaacggcaaacauuucccugacagccauugcaaaucaggcagcuauauugaugggacuugacaagggauggccaauaucgaaaauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacucuguacaucacagauccucuugaugcggaccacaugggccuugugugaauccaucacacuggcuacuggaccccugaccacucucugggagggaucuccaggaaaauucuggaauaccacgauagcaguguccauggcaaacaucuucaggggaaguuaucuagcaggagcaggucuggcuuuuucauuaaugaaaucuuuaggaggagguaggagagguacgggagcucaaggggaaacacugggagagaaauggaaaagacaguuaaaccaacugagcaagucagaauucaacaccuacaaaaggagugggauuauggagguggacagauccgaagccaaagagggacugaaaagaggagaaacaaccaaacaugcagugucgagaggaacagccaaacugaggugguuuguggagaggaaccucgugaaaccagaaggaaaagucauagaccucgguuguggaagagguggcuggucauacuauugugcugggcugaagaaaguuacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacgcuacguguucuaaaaaugguggaaccauggcucaaaggaaaccaauucugcauaaaaauccuaaauccuuacaugccaagugugguagagacucuggagcaaaugcaaagaaaacauggagggaugcuagugcgaaacccacucucaagaaauucuacccaugaaauguauuggguuucauguggaacaggaaacaucgugucggcagugaacaugacauccagaauguuacugaaccgauucacaauggcucacaggaagccaacauaugaaagagacguggacuuaggcgcuggaacaagacauguggcaguggaaccagagguagccaaucuagauauuauuggccagaggauagagaauauaaaaaaugaacacaagucaacauggcauuaugaugaggacaauccauacaaaacaugggccuaucauggaucauaugaggucaagccaucaggaucagccucaucuauggugaauggaguggugagacugcucacaaaaccaugggauguuauccccauggucacacaaauagcuaugacugauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcggcaauaggagcaguguucguugaugaaaaccaauggaacucggcaaaagaagcaguggaagacgaaagguuuugggaucucgugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaagcccuugguuucaugaaugaagaucacugguuuaguagagagaauucacucaguggaguggaaggagaaggacugcacaaacuuggauacauacucagagacauaucaaagauuccagggggaaauauguaugcagaugauacagccggaugggacacaagaauaacagaggaugaucuucagaaugaggcuaaaaucacugacaucauggagccugaacaugcucuauuggcuacgucaauuuuuaagcugacuuaucaaaacaagguggugagggugcaaagaccagcaaaaaauggaaccgugauggauguuauauccagacgugaccagagaggaaguggacaggucggaacuuauggcuuaaauacuuucaccaauauggagguccaacuaauaagacaaauggagucugaaggaaucuuuuuacccagcgaauuggaaacucccaaccuagcugagagaguucuugacugguuggaaaaacauggcgccgaaaggcugaaacgaauggcaaucagcggagaugauugcguggugaaaccaauugacgacagguucgcaacagccuuaacagcucugaaugacaugggaaaaguaagaaaagacauaccgcagugggagccuucaaaaggauggaaugauuggcagcaagugccuuucuguucacaccauuuccaccagcugaucaugaaggaugggagggaaauaguggugccaugccgcaaccaagaugaacuugugggcagggccagaguaucgcaaggcgccggauggagccugagagaaacugcuugccuaggcaagucauaugcacaaauguggcagcugauguacuuccacaggagagaccugagacuagcggcuaacgcuaucuguucagccguuccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccaccaacauacaaguagccauaaaccaagugagaaggcucaucgggaaugagaauuaucuagauuacaugacaucaaugaagagauucaagaaugagagugauccugaaggagcacucugguaa

SEQ ID NO: 6350 - RNA, 9879 nt, Artificial Sequence
  derived and/or modified CDS sequence (wt) from DENV-1__KR919820__SS-prME
acugugguugcacuucuuauguuacuacccaugguuuuuucauuucaucugaccacccguggaggagagccccacaugauugucaauaaacaggagagaggaaaaucccuuuuguuuaaaacuucaggggguauuaacaugugcacccucauugcaauggacuugggggaucuaugugaagacacaaugacauacaaaugcccucggauuacugaagcggaaccggaugauguugacugcuggugcaacgccacagacacaugggucacauacggaauauguucuccaacuggugaacacaggagagaaaaacgcucaguggcccuugccccucauguuggacucggcuuggagacaagagcugaaacauggaugucuucagaaggagccuggaaacaaauacaaagaguugagacuugggcuuuacgacacccagguuucacaguaauagcccuuuuccuggcgcauauaauaggaacauccauaacucagaaaggaguuaucuucaucuuguugaugcuggugaccccgucaauggccaugagaugcguuggaguggggaacagagacuuuguagaaggacuuucaggagcaacauggguggauguggugcuagaacauggaagcuguguuacaacaauggcaaaaaauaaaccaacucuggacauagagcuucuaaaaacagagguuucgaacccugccguuuuacgcaaauugugcauugaagcuaggauaucaaacaccaccacugacucgagaugcccaacacagggugaggcuucauuaucagaggagcaggacaccaacuuugugugccgcagaacgcucguggacagagguuggggaaaugguuguggacuauucggaaaaggcagucugauaacaugugccaaguuugaaugccugacaaagauggaagguaaaauaguucaguaugaaaacuugaaguacucaguaauugucacugugcacacuggggaucagcaccaaguaggaaaugaaaccacagggcauggaacaacugcaaccauuacuccccaagcucccacaucagaaauacaauugacugacuacggagcucucacccuugauugcucaccuagaacaggauuagacuucaaugagaugguguugcuaacaaugaaagagaaaucauggcuuguccacaaacaaugguuccuggaccugccauugccaugggcuucaggggcguccucaccucaggagacuuggaacagacaggaccuacugguaacauucaaaacagcccaugcaaagaaacaagaaguagucguauugggaucccaagaaggagcaaugcauacggcauugacuggagcgacagagauccagacgucaggaacaacaacaaucuuugcgggacaucuaaaauguagguugaaaauggauaaacucacauugaaaggcaugucauaugugaugugcacaggcucauucaaguuaaagaaggaaguggccgaaacucaacauggcacuguuuugguacaaguagaauaugagggaacagacgccccuuguaagauccccuuuacaacgcaagaugaaaaagggguuauccagaauggaagacuaauaacagccaaccccauaguuacugacaaggagaagccugugaauauugaagcagaaccccccuuuggugaaagcuauauggugauagggguaggugacaaagcacuaaaacugaguugguuuaaaaaagggaguaguuuagggaaaauguuugaagcaacugcaagaggggcacgcagaauggccauccugggugacacagcuugggauuucgguuccguggggggaguauucacaucaauggggaaguugguacaucaaauuuuuggaaccgcauauggaguucuuuuuagcgguguuucuuggacgaugaaaauaggaauaggacuucugcuaacuuggcuuggacuaaauucaagaagcacaucucucucaaugacaugcauagcaguagguauaauaacacuauaucuaggagucaugguucaggcugauacaggauguguagucaacuggaaaggaagagaacugaaauguggaaguggcauuuuugucacuaacgagguccacacuuggaccgaacaauacaaguuccaagcggacucuccaaagagguuaucggcugccauuggaaaagcaugggaagauggcguguguggaauucgaucagccacucgucuugagaacaucauguggaagcaaauagcaaaugaguugaacuacaucuuacuugaaaaugacaugaaguucacagugguugugggagaugucaagggaauuuuaacucaggggaagaaaggcaucaggccacaaccaauggaacauaaguauucuuggaaaaguuggggaaaggcaaaaauaauuggagccgauguacagaacacuaccuucaucauugaugguccagacaccccagaauguccugacagccaaagagcauggaacaucugggagguugaagauuauggcuuuggaauuuucacaacaaacauuugguugaaacuacgugacucuuauacucaagugugugaccacagacugaugucugcugccauaaaagacagcagagcgguccacgcagauaugggguacuggauugagagugagaaaaaugagacuuggaaguuaucaagagccuccuuuauagaggugaaaacaugcacauggccgaaaucccacacucuauggagcaacggaguccuggagagugaaaugauaauaccaaaaaucuaugguggaccaaucucacaacauaacuauagaccaggguauuucacacaaacagcaggaccauggcaucuaggaaaacuagaacuggauuuugaccucugugagggaacuaccguggucguggaugaacaaugcggaaaccgcgguccaucccuuagaaccacaacagucacaggaaaaaucauccaugaauggugcugcagguccugcacacuaccaccccuacgguuuaaaggagaggauggcugcugguaugguauggagauuagaccugugaaagaaaaagaagaaaaucuggugaagucaauggucucagcaggcucagggaaaguugacaacuucucacuuggauuacucuguauaucaauuaugguagaagagguuaugagaucuagguggaguggaaagaugcugaugacuggaaccauggcaguguuccucuuguuagugaugggacagcucacauggaaugacuuaauuagggugugcauuaugguaggagcucacgcuuuagacagcaugggaaugggcacgaccuauuuagcguugauggccacuuucaaaauaagaccaaugcuugccgugggacucuuguuucgcaaacuaacaucgagagaaauucuccuacucacaauuggauugaguuuaauaacgccaguggaacuucccaacucuauagaagagcuaggagauggguuagcuauggguauuaugaugcugaaauugcugacugauuuccaaccauaccagcuaugggcuacuuuguugucuuugacauuugucaagaccacucucucccugcauuaugcauggaagacugcagccaugguucugucaauugugucccuucucccuuuguguuuaucaacaacuucccagaaaacaaccuggcucccaauauugcugggaucucuuggaugcaagccauugaccauguuucucauauccgaaaacaagaucuggggaaggagaaguuggccaauuaaugagggaauaauggccguagguauaguuagcauuuugaugagcucacuccugaaaaaugaugugccguuggccgggccguugauagcgggaggcaugcuuguggccugcuaugucauaucuggaaguucggcugacuuaacauuagaaaaaacagcugagguguccugggaggaggaagcagagcacucaggcacggcucauaacauacuaguggaagugcaggaugaugggaccaugaaaauaaaagaugaagagagagaagacacacuaacaauacugcugaaagcagcucuccuagcacuaucaggaguauacccaauguccauaccagccacacuuuuugugugguauuuuuggcaaaagaagaaacagagaucaggaguucugugggacaucccuagucccccagagguugaaaaagcaguccucgaugaugguaucuauaggauacugcagagagguguguuuggcagaucacagguggggguggguguuuuccaggaaggcguguuucauacaauguggcacgucaccaggggagccguucucacauaccaagggaaaagauuagaaccaagcugggccagugugaaaaaagaucugauaucauauggagggggcuggagacuccaaggcucuuggaacgugggagaagaaguccaagugauugcuguugagccaggaaaaaacccaaagaaugugcagacuguaccugggacauucaaaacucacgaaggugaaguuggagcuauagccuuggacuucaaacccggcacgucuggcucccccauugugaauagagaugggaaggugguaggucuguacggaaauggaguggugacaacgagcggaacuuauguuagugccauagcacaaucaaaaguaucacaggaaggaccuuugccugagauugaagaugaaguuuucaagaaaaagaauuuaacaaucauggaucuccauccaggaucagggaaaacaaggagauaucucccagcgauuguucgagaguccauaaaaagaagauugcgcacacugauuuuggcucccacaagaguaguggcaucagaaauggcugaggcgcuuaaaggcuugccaauuagauaccaaacaacagcuguaagaaaugaacauacaggaagggaaauaguggaccuuaugugccaugccacguucaccaugcgccuucuguccccgguaagaguccccaauuacaacaugaucaucauggacgaagcacauuucacugauccggcuagcauagcagcuaggggguacauuucaacucgagugggcaugggugaagcugcugcgaucuucaugaccgccacgcccccagggucagcagaggccuuuccucagagcaacucagucaucuaugaugaggaaaaagauauuccagaaaggucauggaacucaggcuaugauuggaucacugacuuccaaggaaagaccguuugguucguuccaagcauuaaaacaggaaacgacauugcuaauugcuugagaaaaaaugggaaacgggucauccaguugaguaggaaaacuuuugacacagaauaccaaaagacaaaaaauagugauugggauuucguugugaccacagacauaucugaaaugggagcgaacuuuagagcugacagggucauagauccgagacggugcuugaaaccaguuauauuaagggauggcccggaacgagucauucuggcagggccgaugccaguaacuguugccagugcugcacaaagaagaggaagaauuggaagaaaccaaaguaaggagggugaccaguacauauacaugggacagccacucaauaaugaugaggaccaugcucauuggacagaagccaaaaugcuucuugacaacaucaacacaccagaaggaaucauuccagcucuuuucgaaccugagcgggaaaaaagugcagccauagauggggaauacagauuaagaggugaggccaggaaaacguuuguggagcucaugagaaggggagaccuacccguaugguuguccuacaaaguggccucggaaggcauacaguacgcugauagaaaguggugcuuugauggagaaaggaacaaucaaauuuuggaagagaacauggacguggaaaucuggacaaaagaaggagaaaggaagaagcugagaccucgcuggcuagaugccaggacguauuccgauccacuggcucugagggaguuuaaggaguuugcagcuggaagaagaagcgucucaggcgaucugauacuagaaauaggaaaacucccacaucaccuaacacagagggcacagaaugcacuagacaauuuggucaugcuacacaacucagaacaaggggggagggcauacagacaugcaauggaagagcugccugauacaauagaaacacuaauguuauuagccaugauagccacgcugacugguggaguugcauuguuuuuucugucagggaaaggccugggaaagaccuccauuggccuucuaugcgugauggcuucaagcacauugcucuggauggcuaguguagagccccacuggauagcugcuuccauuguuuuggaauucuuucucaugguucuacucauuccagaaccagauaggcagcgcaccccacaggacaaccagcuagcguauguggugauaggucugcugguacugauacugacgguagcggccaaugagaugggacuccuggaaaccacaaagaaggaccuuggaauagguucugcggcggcagaaauccagcaucacaccacaauuuuagacguggaccuucauccggccucagcuuggacguuauacgcaguggccacgacagucaucacuccaauguuaaggcacacaauagagaacacaacagcaaacaugucccucacagcgaucgcaaaccaggcagcuauauugauggggcuugacaaaggauggcccauaucaaagauggacauaggaguuccccuccuagcacuaggcugcuacucucaagucaacccuaugacauuaaccgcagcagugcugauguugguagcccacuacgccauaauaggcccaggauugcaagcaaaagcaacaagagaugcccaaaaaaggacggcagcuggaaucaugaaaaauccgacuguugauggaauuguggcgauagaucuagauccaguaguguaugauacaaaguuugaaaaacaacuaggccaaauuaugcugcugauacucugcacaucacagauccugcugaugcggaccacaugggcuuuuugugaauccaucacacuagcuaccggaccguugaccacgcucugggaaggaucuccaggaaaguucuggaauacuacaauagcaguuucuauggcaaacaucuucagaggaaguuaccuggcuggggcaggucuggcuuuuuccuugaugaaaucauuaggagggaacaggagaggaacaggagcccaaggagaaacauuaggggagaaauggaagaggcagcuuaaucaacugagcaaacuagaguucaacacuuacaaaaggagcggaauaauggagguggacagaacagaggcuaaggaaggguugaaaagaggugaaacaacuagacaugcagugucaagaggaacugccaaacugaggugguuuguggaaagaaaucucgugaaacccgaaggaaaagucauugaucuugguugcggaagaggagguuggucauacuauugcgcaggguugaaaaaagucacagaggugaaaggguacacgaaaggaggaccaggacaugaggaaccaauuccaauggcgacauauggauggaacuuagugaaauuacacucugggaaagauguguucuuuaucccaccugaaaagugugacacucuucucugcgacauaggugaaucuucuccaaauccaaccauugaggaaggaagaacacuacggguucuaaagaugguagagccuuggcugagaggaaaccaauucugcauaaaaguucuaaaucccuacaugccaaguguaguagaaaccuuagagcgaaugcaaagaaaacauggagggaugcuugugcgaaacccauugucacggaacucaacccacgaaauguauuggguuucauguggaacagggaacauugugucugcagugaacaugacuuccagaauguugcuaaacagauuuacaaugacacauaggaagccuacguaugaaaaggauguggacuugggugccggaaccagacacguggcgguagaaccagagguggccaauuuagacauaauuggacagagaauagagaauauaaaaaaugaacacaaaucaacguggcacuaugaugaagauaacccauacaaaacgugggcauaccauggaucauaugagguaaaaccaucaggaucagcuucgucaaugguuaauggugugguaagacugcuaacaaaaccaugggaugucauccccauggucacacaaauagccaugacugacacaacgcccuuuggacaacaaagaguuuucaaagagaaaguugacacaagaacgcccaaagcaaaaagaggaacugcacaagucauggagauaacagccggcugguuguggaaauuucucuccagaaaaaagaagccuagaauaugcacaagagaggaguucacaagaaaggucaggucaaaugcugcaauaggagcgguauuugucgacgaaaaucaguggaauucagcaaaggaagcuguggaugaugaacgguucugggaucuugugaacagagagagggagcuucauaaacaaggaaaaugcgccacaugugucuacaauaugaugggaaaaagagagaagaaacuaggugaguuuggaaaggccaaaggaagucgugcaauaugguacauguggcuuggggcacgauuucuagaguuugaagcucuugguuuuaugaaugaagaccacugguucaguagggacaacucauugagcggaguagagggagaaggacuucacaagcucggcuacauccucagggacaucgcaagaaucccagguggaaacauguaugcagaugacacggccggaugggacacaaggauuacggaagaagaccuccaaaaugaagcaagagugacagaacuuauggaaccugaccaugcacagcuggccacgucaauauucaggcuaacuuaucagaauaagguugugagggugcagagaccuggaaagaauggaacaguaauggaugucauauccaggcgagaccagaggggaagcggacagguuggaacuuacggucuuaauaccuucacuaauauggaagcccagcugauaagacagauggaauccgagggaguauuuucuccuagugaauuggaaacucccaauuuggccaauagaguucuggacuggcuggaaaaguaugguguggaaaggcugaagaggauggccaucaguggagaugauugcguggugaaaccaauugaugacagauuugcaacagcuuugacugcacugaaugacaugggaaaagugagaaaagacauaccucaaugggagccaucaagaggauggaaugacuggcagcaaguaccguucugcucgcaccauuuccaucaauugauaaugaaggaugguagagagauaguagugccaugucgaaaccaagaugaacucgugggaagggccagagugucacagggcgcuggcuggagccuacgagaaacagcuugcuuaggcaaaucguacgcgcagauguggcaacugauguacuuucacaggagagaccugagacuagccgcuaaugcuaucuguucggccgucccaguagacuggguuccaaccagccgcaccacauggucaauccacgcucaccaccaauggaugacaacagaagacaugcuuucaguuuggaacagagucuggauagaagaaaacccauggauggaggauaaaacucaugugaccaguugggaagacguuccauaccugggaaagagagaagaucaaugguguggaucuuuaauaggucuaucagcuagggcaaccugggcaaucaauauacaaguggccauaaaccagguuagaaagcucauuggaaaugagcauuaccaggauuacaugacaucaaugagaagguucaagaaugaaagugaaccggaaggagcauugugguaa

SEQ ID NO: 6351 - RNA, 9879 nt, Artificial Sequence
  derived and/or modified CDS sequence (wt) from DENV-1__DQ285561__SS-prME
ucugugaccaugcuccucaugcuauugcccacagcccugacguuccaucugaccacccgagggggagagccgcacaugauaguuggcaagcaggaaagaggaaagucacuuuuguuuaagaccucugcaggugucaacauguguacccuuauugcaauggaucugggagaguuaugugaugacacgaugaccuacaaaugcccccggaucacugagacggaaccagaugacguugacuguuggugcaaugccacggagacaugggugaccuauggaacauguucucaaaccggugaacaccgacgagacaaacguuccguugcacuggcaccacacguagggcuuggucuggaaacaagaaccgaaacguggauguccucugaaggcgcuuggagacaaauacaaaaaguggagacaugggcccugagacacccaggauucacggugauagcccuuuuucuagcacaugccauagggacaucuaucacccagaaagggauuauuuucauuuugcugaugcugguaacuccauccauggccaugcggugcgugggaauaggaaacagagacuucguggaaggacugucaggagcuacguggguggauguaguacuggagcauggaaguugugucacuaccauggcaaaagacaaaccaacacuggacauugaacucuugaagacggaggucacaaacccugccgucuugcgcaaacugugcauugaagccaaaauaucaaauaccaccacugauucgagauguccgacacaaggagaagccacguugguggaagaacaagacacgaacuuugugugucgacgaacguucguggacagaggcuggggcaaugguuguggacuauucggaaaagguagcuuaauaacgugugcuaaguuuaagugugugacaaaauuggaaggaaagauaguccaauaugaaaacuuaaaauacucagugaucguuaccguccacacuggagaccagcaccaaguuggaaaugagaccacagaacauggaacaauugcaaccauaacaccucaagcucccacgucggaaauacaacugacagacuacggagcucugacacuggacuguucaccuagaacagggcuagacuuuaaugagaugguguuguugacaaugaaagaaaaaucauggcucguccacaaacaaugguuucuagacuuaccacugccuuggacuucaggggcuucaacaucccaagagauuuggaauagacaagacuugcuggucacauuuaagacagcucaugcaaagaagcaggaaguagucguacuaggaucacaagaaggagcaaugcauacugcguugacuggagcuacagaaauccaaacgucuggaacgacaacaauuuuugcaggccaucugaaaugcagacuaaaaauggacaaacugacucuaaaaggaauaucauauguaaugugcacaggcucauucaaguuagagaaggaaguggcugagacccagcauggaacuguucuaguacagguuaaauacgaaggaacagaugcaccaugcaagauccccuucucgucccaagaugagaagggaguaacccagaaugggagauugguaacggccaaccccauagucacugacaaagaaaaaccagucaauauugaggcggagccaccuuuuggugagaguuacaucgugguaggagcaggagaaaaagcuuugaaacuaagcugguucaagaagggaagcagcauagggaaaauguuugaagcaacugcccguggagcacgaaggauggccaucuugggagacaccgcaugggacuucgguucuauaggaggaguguucacgucugugggaaaacugguacaccagauuuuuggaacugcguauggagucuuguucaguggugucucuuggacuaugaaaauaggaauagggauucugcugacauggcugggauuaaacucaaggagcacgucucuuucaaugacguguaucgcaguuggcaugaucacacuguaccuaggagucaugguccaggcggacucgggauguguaaucaacuggaaaggcagagaacucaaauguggaaguggcauuuuugucaccaaugaaguucacaccuggacagagcaauacaaauuucaggccgacuccccaaagagacuaucagcagccauugggaaggcaugggaggaagguguguguggaauucgaucagccacccgucucgagaacaucauguggaagcaaauaucaaaugaauuaaaccacaucuuacuugaaaaugacaugaaauuuacaguggucguaggagacguuaguggaaucuuggcccaaggaaagaaaucgauuaggccacaacccauggaacauaaauacucguggaaaagcuggggaaaagccaaaaucauuggagcagauguucagaacacuacuuucaucaucgacggcccaaacaccccagaaugcccugaugaccaaagagcauggaacaucugggaaguugaagacuauggauuuggaauuuucacgacaaacauaugguugaaauugcgugacuccuacacccaagugugugaccaucgacuaaugucagcugccaucaaggauagcaaagcaguccaugcugacaugggguacuggauagaaagugaaaagaacgagacuuggaaguuggcaagagccuccuucauagaagucaagacaugcaucuggccaaagucucacacucuauggagcaauggaguccuggaaagugagaugauaaucccaaagauauauggaggaccaauaucucagcauaauuacagaccaggauauuucacacaaacagcaggaccguggcacuuaggcaaguuggaacuagauuuugauuugugugaagguaccacaguuguuguagaugaacacuguggaaauagaggaccaucucuuagaaccacaacagucacaggaaagauaauccaugaauggugcuguagaucuugcacguuacccccccuacguuucaaaggagaagacgggugcugguauggcauggaaaucagaccagucaaggagaaggaagagaaccuagucaagucaauggucucugcagggucaggagagguggacaguuuuucacuaggacuguugugcauaucaauaaugaucgaagagguaaugagauccagauggagcaggaaaaugcugaugacuggaacauuggcuguguuccuccuucucacaaugggacaauugacauggaacgaucuaaucaggcuaugcaucaugguuggagccaaugcuucagacaauauggggaugggaacaacguacuuagcuuugauggccacuuucagaaugagaccaauguucgcagucgggcuauuauuucgcagauuaacaucuagagaaguucuucuucucacgguuggauugagucugguggcaucuguagaacuaccaaauuccuuagaggagcuaggggauggacuugcaaugggcaucaugauauuaaaauuacuaacugauuuucaaucacaucagcuaugggccaccuugcugucucugacauuugucaaaacaaccuuuucauugcacuacgcauggaagacaauggcuaugauacugucaauuguaucucucuucccuuuaugccuguccacgacuucccaaaaaacaacauggcuuccggugcuucuggggucucuuggaugcaaaccacuaaccauguuucucauaacagaaaacaaaaucuggggaaggaaaaguuggccucucaaugaaggaaucauggcuguuggaauaguuagcauucuacuaagcucacuucucaaaaaugaugugccacuagcuggcccauuaauagcuggaggcaugcuaauagcguguuaugucauauccggaagcucggccgauuuaucacuggagaaagcggcugagguuuccugggaagaagaagcagaacacucuggugccucacacaacauacuaguggagauccaagaugauggaaccaugaagauaaaagaugaagagagagaugacacgaucaccauccuccucaaagcaaccuugcuagcaaucucagggguauacccaaugucaauaccggcgacucucuuugugugguauuuuuggcagaaaaagaaacagagaucaggagugcuaugggacacaccaagcccuccagaaguggaaagagcaguccuugaugauggcauuuauagaauucuccaaaggggauuguugggcaggucucaaguaggaguaggaguuuuccaagaaggcguauuccacacaauguggcaugucaccaggggagcuguucucauguaccaagggaagagauuggaaccaaguugggccagugucaaaaaagacuugaucucauauggaggaggcuggagguuucaaggauccuggaacacgggagaagaagugcaggugauugcuguugaaccggggaagaacccaaaaaauguacagacagcgccggguaccuucaagaccucugaaggcgaaguuggagccauagcucuagacuuuaaacccggcacaucuggaucuccuaucgugaacagagagggaaaaauaguaggucuuuauggaaauggaguggugacaacaaguggaaccuaugucagugcuauagcucaagcuaaagcaucacaagaagggccuuugccagagauugaggacgagguguuuaggaaaagaaacuuaacaauaauggaccuacacccaggaucgggaaaaacaagaagauaccuuccagccauaguccgugaggccauaaaaagaaagcugcgcacgcuaguucuagcucccacaaggguugucgccucugaaauggcagaggcgcucaagggaaugccaauaagguaucagacaacagcagugaagagugaacacacgggaagggagauaguugaccuuaugugucacgccacuuucacuaugcgucuccugucuccugugagaguucccaauuacaacaugauaaucauggaugaagcacauuucaccgauccagccagcauagcagccagaggguacaucucaacccgaguggguaugggugaagcagcugcgauuuucaugacagccacuccccccggaucgguggaggccuuuccacagagcaaugcaguuauccaagaugaggagaaagacauuccugaaagaucauggaacucaggcuaugacuggaucacugguuucccagguaaaacagucugguucguuccaagcaucaaaucaggaaaugacauugccaacuguuuaagaaaaaaugggaaacgggugauccaauugagcagaaaaacuuuugacacugaguaccagaaaacgaaaaauaacgacugggacuauguugucacaacagacauuuccgaaaugggagcaaacuuucgagccgacaggguaauagacccaaggcgaugccugaaaccgguaauacugaaagaugguccagagcgugucauucuagccggaccgaugccagugaccguggcuagugccgcccagaggagaggaagaauuggaaggaaccaaaauaaggaaggugaucaguauauuuacaugggacagccuuuaaauaacgaugaggaccacgcccauuggacagaagcaaaaaugcuccuugacaacauaaacacaccagaagggaucaucccagcccucuuugagccagaaagagaaaagagugcugcaauagacggggaauacagacuacggggugaagcgaggaaaacguuuguggagcucaugagaagaggagaucuaccugucuggcuaucuuacaaaguugccucagaaggcuuccaauacuccgacagaagguggugcuuugauggggaaagaaacaaccagguguuggaggagaacauggacguggagaucuggacaaaagaaggagaaagaaagaaacuacgaccccgcuggcuggaugccagaacauacucugacccacuggcucugcgcgaauucaaagaguucgcagcaggaagaagaagcgucucaggugaccuaauauuagaaauagggaaacuuccucaacaucuaacucaaagggcccagaaugcuuuggacaauuugguuaugcugcacaacucugaacaaggaggaaaagcuuacagacacgccauggaagaauugccagacacuauagagacguugaugcuccuagcucugauagcugugcugacugguggagugacgcuguucuuccuaucaggaagaggcuuagggaaaacauccauuggccuacucugcgugauguccucaagugcacuguuauggauggccaguguggagccccauuggauagcggccucuaucauacuggaguucuuucugaugguguugcuuauuccggagccagacagacagcgcacuccacaagacaaccaguuagcauauguggugauagguuuguuauucaugauauugacaguggcagccaaugagaugggauuauuagaaaccacaaagaaagaccuggggauuggucaugcagcugcugaaaaccaccaccacgccgcaaugcuggacguagaccuacauccagcuucagccuggacucucuacgcaguggccacaacgauuaucacucccaugaugagacacacaauugaaaacacaacggcaaacauuucccugacagccauugcaaaccaggcagcuauauugaugggacuugauaagggauggccaauaucaaagauggacauaggaguuccacuucucgccuuggggugcuauucucaggugaacccgcugacgcugacagcggcgguacugaugcuaguggcucauuaugccauaauuggaccaggacugcaagcaaaagccacuagagaagcucaaaaaagaacagcagccggaauaaugaaaaacccaacugucgacgggaucguugcaauagauuuagacccugugguuuaugaugcaaaauuugaaaaacagcuaggccaaauaauguuguugauacuaugcacaucucagauucucuugaugcggaccacaugggccuugugugaauccaucacacuggccacaggaccucugaccacgcuuugggagggaucuccaggaaaauucuggaacaccacgauagcgguguccauggcaaacauuuuuagggggaguuaucuagcaggagcgggucuggccuuuucauuaaugaaaucucuaggaggagguaggagagggacgggagcccaaggagaaacacugggagaaaaguggaaaagacagcuaaaccaauugagcaagucagaauuuaacauuuacaagaggagugguauuguagagguggauagaucugaagccaaggagggguuaaaaagaggagaaacaaucaaacacgcagugucgagaggaacggccaaacugaggugguuuguggagaggaaccuugugaaaccagaagggaaagucauagaccucggcuguggaagagguggcuggucauauuacugcgcugggcugaagaaagucacagaagugaaaggauacacaaaaggaggaccuggacaugaggaaccaaucccaauggcaaccuauggauggaaccuaguaaagcuauacuccgggaaagauguauucuuuauaccaccugagaaaugugacacccuuuugugugauauuggugaguccucuccgaacccgacuauagaagaaggaagaacguugcguguucuaaagaugguagaaccauggcucagaggaaaccaauuuugcauaaagauucuaaaucccuacaugccgagugugguagaaacucuggagcaaaugcaaagaaaacauggaggaaugcuagugcgaaauccacucucaagaaacuccacucaugaaauguacuggguuucauguggaacaggaaacauugugucagcaguaaauaugacaucuagaaugcugcugaaucgauucacgauggcucacaggaagccaacauaugaaagagauguggacuugggcgcuggaacgagacauguggcaguagaaccagagguggccaaccuagacaucauuggccagaggauagagaauauaaaaaaugaacacaaaucaacauggcauuaugaugaggacaacccguacaaaacaugggccuaucauggaucauaugaggucaagccaucaggaucagccucauccauggucaaugguguggugagacugcuaaccaaaccaugggaugucauucccauggucacacaaauagccaugacugauaccacacccuuuggacaacaaaggguguuuaaagagaaaguugacacgcguacaccaaaagcgaaacgaggcacagcacaaauuauggaggugacagccaagugguuaugggguuuucucuccagaaacaaaaaacccagaaucugcacaagagaggaguucacaagaaaagucaggucaaaugcagcuauuggagcgguguucguugaugaaaaucaauggaacucagcaaaagaggcaguggaagaugaaagguucugggaucuugugcgcagagagagggagcuucauaaacaaggaaaaugugccacgugugucuacaacaugaugggaaagagagagaaaaaauuaggagaguucggaaaggccaaaggaagucgcgcaauaugguauaugugguugggagcgcgcuucuuagaguuugaagcccucggcuucaugaaugaagaucacugguucagcagagagaauucacucaguggaguggaaggagaaggacuccacaaacuuggauacauacucagagacauaucaaagauuccagggggaaacauguaugcagaugauacagccggaugggacacaagaauaacagaggaugaucuucagaaugaggccaaaaucacugacaucauggaaccugaacacgcccuacuggccacgucaaucuuuaaguuaaccuaccaaaacaagguuguaagagugcagagaccagcaaaaaauggaaccgugauggaugucauauccaggcgugaccagagaggaaguggacagguuggaacuuauggcuuaaacaccuucaccaacaugggggcccaacuaauaagacaaauggagucugagggaaucuuuucacccagugaauuggaaaccccaaauuuagcuggaagaguccuugacugguuggaaaaacauggcaucgagaggcugagaagaauggcaaucaguggagaugacugcguggugaaaccaauugaugacagauuugcaacagccuuaacagccuugaaugacaugggaaagguaagaaaagacauaccgcaaugggaaccuucaaaaggauggaaugauuggcaacaagugccuuucugcucacaccacuuccaccagcugauuaugaaggauggaagggaaauaguagugccgugccgcaaccaagaugaacugguagguagggccagaguaucacaaggugccggauggagcuugagagaaacugcaugucuaggcaagucguaugcacaaauguggcagcugauguacuuccacaggagagacuugagauuagcggcuaaugcuauuuguucagccguuccaguugauugggucccaaccagucgcaccaccuggucgauccaugcccaccaucaauggaugacaacagaagacauguugucaguguggaauaggguuuggauagaggaaaacccauggauggaggauaaaacucacguguccagcugggaagacguuccauaccuagggaaaagggaagaucaaugguguggaucccuaauaggcuuaacagcacgagccaccugggccaccaacauacaaguggccauaaaccaagugagaaggcucauugggaaugagaauuaccuagacuacaugacaucaaugaagagauucaaaaacgagagugaucccgaaggggcacucugguaa

SEQ ID NO: 6352 - RNA, 9879 nt, Artificial Sequence
  derived and/or modified CDS sequence (wt) from DENV-1__DQ285562__SS-prME
uccgugaccaugcuccuuaugcugcugcccacagcccuggcguuccauuugaccacacgagggggagagccacacaugauagucagcaagcaggaaagaggaaagucacucuuguuuaagaccucugcaggugucaacaugugcacccucauugcaauggauuugggagaguuaugugaggacacaaugaccuacaaaugcccccggaucacugaagcggaaccagaugauguugauugcuggugcaaugccacagacacaugggugaccuaugggacguguucucaaacuggcgaacaccgacgggauaaacguucugucgcauuggccccacacguagggcuuggucuagaaacaagaaccgaaacguggauguccucugaaggcgccuggagacagauacaaaaaguggagacuugggccuugagacacccaggauucacggugauagcccuuuuuuuagcgcauaccauaggaacauccaucacccagaaagggaucaucuucauuuugcugaugcuggugacaccaucaauggccaugcgaugcgugggaauaggcaacagagacuucguugaaggacugucaggagcaacguggguggaugugguacuggagcauggaagcugcgucaccaccauggcaaaaaauaaaccaacauuggacauugaacucuugaagacggaggucacgaacccugccgucuugcgcaaacugugcauugaagcuaaaauaucaaacaccacuaccgauucaagaugcccaacacaaggagaagcuacacugguggaagaacaagacgcgaacuuugugugucgacgaacauucguggacagaggcugggguaaugguuguggacuauucgggaaaggaagcuuacugacgugugcuaaguuuaagugugugacaaaacuugaaggaaagauaguucaauaugaaaacuuaaaauauucggugauagucacuguccacacuggggaccagcaccaggugggaaaugagaccacagaacauggaacaauugcaaccauaacaccucaagcucccacgucggaaauacagcugacugacuacggagcccucacauuggacugcucaccuagaacagggcuggacuucaaugagauggugcuguugacaaugaaagaaaaaucauggcuuguccacaaacaaugguuuuuagacuugccacugccuuggaccucgggggcuucaacaucucaagagacuuggaacagacaagauuugcugguuacauuuaagacagcucaugcgaagaagcaggaaguagucguacuggggucacaagaaggagcaaugcacacugcguugacuggggcgacagaaauccagacgucaggaacgacgacaaucuucgcaggacaccugaaauguagacuaaaaauggauaaacugacuuuaaaaggggugucauaugugaugugcacaggcucauuuaaguuagagaaggaaguggcugagacccagcauggaaccguccuagugcagguuaaauacgaaggaacagaugcaccaugcaagauucccuuuucaacccaagaugagaaaggagugacccagaaugggagauugauaacagccaaucccauaguuacugacaaagaaaaaccagucaacauugagacagaaccaccuuuuggugagagcuacaucgugauaggggcgggugaaaaagcuuugaaacuaagcugguucaagaaaggaagcagcauagggaaaauguucgaagcuaccgcccgaggagcccgaaggauggcuauccugggagacacagcaugggacuucgguuccauaggagggguguucacaucugugggaaaauugguacaccagguuuuuggaaccgcauauggggucuuguucagcgguguuucuuggaccaugaaaauaggaauagggauccugcugacauggcuaggauuaaauucaaggagcacgucacucucgaugacgugcauuguaguuggcauggucacacuguaccuaggagucaugguucaagcggacucgggguguguaaucaacuggaagggcagagaacucaaaugcggaaguggcaucuucgucacuaaugaaguccacacuuggacagagcaauauaaauuccaggcugacuccccaaaaagacugucagcagccauugggaaggcaugggaggaaggcguguguggaauucgaucagccacacgucuugagaacaucauguggaagcaaauaucaaaugaauugaaccacauucuacuugaaaaugacaugaaauucacagugguuguaggagacgcuaauggaaucuugacccaaggaaaaaagaugauuaggccacaacccauggaacacaaauacucauggaaaagcuggggaaaagccaaaaucauaggagcagauauacagaacaccaccuucaucauugauggcccagacacuccagaaugccccgaugaccagagagcauggaacauuugggaaguugaggacuauggguuuggaauuuucacgacaaacauauggcugaaauugcgugacuccuacacccaaaugugugaccaccggcuaaugucagcugccaucaaggacagcaaggcaguccaugcugacaugggguacuggauagaaagugaaaagaacgagaccuggaagcuagcgagagccuccuucauagaagugaagacaugcaucuggccaagaucccacacucuauggagcaauggagucuuggaaagugaaaugauaaucccaaagauauauggaggaccaauaucucagcacaacuacagaccaggguauuucacacaaacagcagggccauggcaccuaggcaaguuggaacuagacuuugauuugugugaaggcaccacaguuguuguggaugaacauuguggaaaucgagguccuucucuuagaacuacaacagucacaggaaagauaauccaugaaugguguugcagauccugcacgcuaccccccuuacgcuucaaaggagaagacggauguugguauggcauggaaaucagaccaguuaaagagaaggaagagaaucuagucaggucaauggucucugcagggucaggagaaguggacaguuuuucauugggacuacuaugcguaucaauaaugguugaagaagugaugagauccagauggaguagaaagaugcugaugacuggaacacuggcuguuuucuuccuucuuauaaugggacaacugacauggaaugaucugaucagguuaugcaucaugguuggagccaaugucucagacaggauggggaugggaacaacguaccuagccuugauggccacuuucaaaaugagaccgauguucgcuguugggcuauuauuucgcagacuaacauccagagagguucuccuucucacaauuggacuaagccugguggcauccguggagcuaccaaauucuuuagaggagcuaggggacggacuugcaaugggcaucaugauguuaaaauuguugaccgauuuucagucacaccaguuauggacuaccuuacugucucugacauuuaucaaaacaacucuuucauuggauuaugcauggaagacaauagcuaugguauugucaaucguaucucucuuuccuuuaugucuaucuacgaccucucaaaaaacaacauggcuuccggugcuguuaggaucuuuuggaugcaaaccacuaaccauguuucuuauaacagaaaacaaaaucuggggaaggaaaaguuggccccucaaugaaggaauuauggcuguuggaauagucaguauucuacuaaguucacuccucaaaaaugaugugccacuagccggcccacuaauagcuggaggcaugcuaauaacauguuaugucauauccggaagcucagccgauuuaucauuggagaaagcggcugagguuuccugggaagaagaagcagaacacucuggugccucacacaauauacuaguggagguccaagaugauggaacuaugaaaauaaaagaugaagagagagaugacacgcucaccauacuccuuaaagcaacucuguuggcagucucagggguguacccaaugucaauaccagcaacccuuuuugugugguauuuuuggcagaaaaagaaacagagaucaggagucuugugggacacaccuagcccuccagaaguggaaagagcaguucuugaugaugguaucuauagaaucuugcaaagaggacuguuggguaggucccagguaggagugggaguuuuucaagacggcguguuccacacaauguggcaugucaccaggggggcuguccucauguaccaagggaagaggcuggaaccaaguugggccagugucaaaaaagacuugaucucauauggaggagguuggagguuucaaggaucauggaacacgggagaagaaguacaggugauagcuguugaaccaggaaaaaacccaaaaaauguacagacaacgccgggcaccuucaagaccccugaaggcgaaguuggagccauagcccuagauuucaaacccggcacaucuggaucucccaucgugaacagagagggaaaaauaguaggucuuuauggaaauggaguggugacaacaaguggaacuuacgucagugccaucgcccaagccaaagcaucacaagaagggccucuaccagagauugaggacgagguguuuaagaaaagaaaccuaacaauaauggaccuacauccaggaucaggaaaaacaagaagauaucuuccagccauaguccgugaggccauaaaaaggaaacugcgcacgcuaaucuuggcucccacaagaguugucgccucugaaauggcagaggcgcuuaaaggaaugccaauaagauaucagacaacagcaguaaagagugaacacacaggaagggagauaguugaucucaugugccacgccacuuucaccaugcgucuccuaucuccagugagaguucccaauuacaacaugauuaucauggaugaagcacacuuuaccgauccagccagcauagcggccagaggguacaucucaacccgaguggguaugggugaagcagcugcgaucuuuaugacagccacucccccaggaucgguagaggccuuuccacagagcaaugcaguuauccaagaugaggaaagagacauuccugagagaucauggaacucaggcuacgacuggaucacugauuucccaggaaaaacagucugguuuguuccaagcaucaaaucaggaaaugacauugccaacuguuuaagaaagaacgggaaacgggugauccaauugagcagaaaaaccuuugacacugaauaccagaaaacaaaaaacaaugacugggacuauguugucacaacagacauuuccgaaaugggagcaaauuuccgggcugacaggguaauagacccaaggcggugcuugaagccgguaauacuaaaagauggcccagagcgcgucauucuagcuggaccaaugccagugaccguggccagugcugcccagaggagaggaagaauuggaaggaaccaaaacaaggaaggugaccaguauauuuacaugggacagccuuuaaauaaugaugaggaccacgcucauuggacagaagcaaaaaugcuccuugacaauauaaacacgccagaagggauuaucccagcccucuuugagccggagagagaaaagagugcagcaauagacggggaguacagacugcggggagaagcaaggaaaacguucguggaguuaaugagaagaggggaucuaccaguuuggcuaucuuacaaaguugccucagaaggcuuccaguacuccgacagaagguggugcuuugacggggaaaggaacaaccagguguuggaggagaacauggacguggagaucuggacaaaagaaggagaaagaaagaaauuacgaccucgcugguuagaugccagaaccuacucugauccacuggcccugcgcgaguuuaaagaguucgcagcaggaagaagaagugucucaggugaccuaauauuagaaauagggaaacuuccacagcauuugacgcuaagggcccagaaugcuuuggacaacuuggucauguugcacaauuccgaacaagggggaaaagcuuauagacaugcuauggaagaauuaccagacaccauagaaacauugaugcuccuagcuuugauagcugugcugacugguggagugacguuguuuuuccuaucaggaaaaggucuagggaaaacauccauuggccuacuuugugugauggccucaaguguacuguuauggauggccaguguggagccccauuggauagcggccuccaucauacuagaguucuuucugauggugcugcucauuccagagccagacagacagcguacuccacaggacaaucagcuagcauauguggugauagguuuguuauucaugauauugacaguggcggccaaugagaugggauuacuggaaaccacaaagaaagaccuggggauuggccaugcagucgccgaaaaccaccaccaugcaacaaugcuagacauagaccuacauccagcuucagccuggacccucuaugcaguagccacaacaauuaucacucccaugaugagacacacaauugaaaacacaacggcaaauauuucccugacagcuauugcaaaucaggcggcuauauugaugggacuugacaagggauggccaauaucgaagauggacauaggagugccacuucucgcuuuagggugcuauucccaggugaacccauugacacugacagcagcgguguugauguuaguggcucauuaugccauaaucggaccuggacugcaagcaaaagccacuagagaagcccaaaaaaggacagcggccggaauaaugaaaaauccaacuguagacgggauuguugcaauagauuuggauccugugguuuaugaugcaaaauuugaaaaacagcuaggccaaauaauguuacugauacuuuguacaucacagauucucuugaugcggacuacaugggccuuaugugaauccaucacacuggcuacuggacccuugaccacucucugggagggaucuccaggaaaauucuggaauaccacgauagcaguguccauggcaaacaucuucaggggaaguuaucuagcaggagcaggucuggccuucucauuaaugaaaucuuuaggaggagguaggagagguacgggagcucaaggggaaacauugggagaaaaauggaaaagacaacuaaaccaacugagcaagucagaauuuaacacuuacaaaaggaguggaauuauggagguggacagaucugaagccaaggagggacugaaaagaggagaaacaaccaaacaugcagugucgagaggaacagccaaacuuaggugguuuguggagaggaaccuugugaaaccagaagggaaagugauagaccucgguuguggaagagguggcuggucauauuauugcgcugggcugaagaagguuacagaagugaagggauacacaaaaggaggacccggucaugaggaaccuaucccaauggcgacuuauggauggaaccuagugaagcuacacuccggaaaagauguauucuuuacaccaccugagaaaugugacacccuuuugugugacauuggugaguccucuccgaauccaaccauagaagaaggaagaacguuacguguucuaaagaugguggaaccauggcucagaggaaaucaguuuugcauaaaaauccuaaauccuuacaugccaagugugguagaaacucuggagcaaaugcaaagaaaacauggagggaugcuagugcgaaacccacucucaagaaauucuacccaugaaauguacuggguuucauguggaacaggaaacaucgugucggcagugaacaugacaucuagaauguugcugaaucgguucacaauggcucacaggaagccaacguaugaaagagacguggacuugggcgcuggaacaagacauguggcaguggaaccagagauagccaaccuagacauuauuggccagaggauagagaacauaaaaaaugaacacaagucaacauggcauuaugaugaggacaauccauacaaaacaugggccuaucauggaucauaugaggucaagccaucagggucagccucauccauggugaauggcguggugagauugcucaccaaaccaugggauguuauccccauggucacacaaauagcuaugacugauaccacacccuucggacaacagaggguguuuaaagagaaaguugacacacgcacaccaagaccaaaacgaggcacagcacaaauuauggaggugacagccaagugguugugggguuuccucucuagaaacaaaaaacccagaaucugcacaagagaggaguucacaagaaaagucaggucaaacgcagcaauuggagcaguguucguugaugaaaaccaauggaacucagcaaaagaagcaguggaagacgaaagguuuugggaccucgugcauagagagagggagcuucauaaacagggaaaaugcgccacaugugucuacaauaugauggggaaaagagagaaaaaauuaggagaguuuggaaaggcaaaaggaagucgugcaauaugguacaugugguugggagcacgcuuucuagaguuugaagcccuuggcuucaugaaugaagaccacugguucaguagagagaauucacucaguggaguggaaggagaaggacuacacaaacuuggauacauacucagagacauaucaaagauuccagggggaaauguguaugcagaugacacagcuggaugggacacaagaauaacggaggaugaucuucagaaugaggcuaaaaucacugacaucauggagcccgaacaugcucuacuggcuacgucaaucuucaagcugaccuaucaaaauaaggugguaagggugcaaagaccagcaaaaaguggaaccgugauggauauuauauccagacgugaccagagaggaaguggacaggucggaacuuauggcuuaaauacuuucaccaacauggagguccaacuaauaagacaaauggaaucugaaggaaucuuuucacccagcgaauuggaaaauucaaaucuagcugagagaguucucgacugguuggaaaaacauggcgucgaaagguugaaaagaauggcaaucagcggagaugacuguguggugaaaccaacugaugacagguucgcaacagcuuuaacagcccugaaugacaugggaaaagugagaaaagacauaccacaaugggaaccuucaaaaggauggaaugacuggcaacaagugccuuucuguucacaccauuuccaccaacugaucaugaaagaugggagggagauaguggugccaugccgcaaccaagaugaacuugugggcagggccagaguaucacaaggcgccggauggagccugagagaaacugcuugccuaggcaagucauaugcacaaauguggcagcugauguacuuccacaggagagaccugagacuagcggccaaugcuaucuguucagccguuccaguugauugggucccaaccagccgcaccaccuggucgauccaugcccaccaccaauggaugacaacagaagacauguuaucaguguggaauaggguuuggauagaggaaaacccauggauggaggacaaaacucauguauccaguugggaagauguuccauacuuaggaaaaagggaagaucaaugguguggaucccugauaggcuuaacagcaagggccaccugggccaccaacauacaaguggccauaaaacaagugagaaggcucauugggaaugagaauuauuuagacuacaugacaucaaugaagagauucaagaaugagagugaucccgaaggagcccucugguaa

SEQ ID NO: 6353 - RNA, 9879 nt, Artificial Sequence
  derived and/or modified CDS sequence (wt) from DENV-1__DQ285558__SS-prME
ucugugaccaugcuccucaugcuacugcccacagcccugacguuccaucugaccacccgagggggagagccgcacaugauaguuggcaagcaggaaagaggaaagucacuuuuguuuaagaccucugcaggugucaacauguguacccuuauugcaauggaucugggagaguuaugugaugacacgaugaccuacaaaugcccccggaucacugagacggaaccagaugacguugacuguuggugcaaugccacggagacaugggugaccuauggaacauguucucaaaccggugaacaccgacgagacaaacguuccguugcacuggcaccacacguagggcuuggucuggaaacaagaaccgaaacguggauguccucugaaggcgcuuggagacaaauacaaaaaguggagacaugggcccugagacacccaggauucacggugauagcccuuuuucuagcacaugccauagggacauccaucacccagaaagggauuauuuucauuuugcugaugcugguaacuccauccauggccaugcggugcgugggaauaggaaacagagacuucguggaaggacugucaggagcuacguggguggauguaguacuggagcauggaaguugugucacuaccauggcaaaagacaaaccaacacuggacauugaacucuugaagacggaggucacaaacccugccgucuugcgcaaacugugcauugaagccaaaauaucaaauaccaccacugauucgagauguccgacacaaggagaagccacguugguggaagaacaagacacgaacuuugugugucgacgaacguucguggacagaggcuggggcaaugguuguggacuauucggaaaagguagcuuaauaacgugugcuaaguuuaagugugugacaaaauuggaaggaaagauaguccaauaugaaaacuuaaaauacucagugaucguuaccguccacacuggagaccagcaccaaguuggaaaugagaccacagaacauggaacaauugcaaccauaacaccucaagcucccacgucggaaauacaacugacagacuacggagcucugacacuggacuguucaccuagaacagggcuagacuuuaaugagaugguguuguugacaaugaaagaaaaaucauggcucguccacaaacaaugguuucuagacuuaccacugccuuggacuucaggggcuucaacaucccaagagacuuggaauagacaagacuugcuggucacauuuaagacagcucaugcaaagaagcaggaaguagucguacuaggaucacaagaaggagcaaugcauacugcguugacuggagcuacagaaauccaaacgucuggaacgacaacaauuuuugcaggccaucugaaaugcagacuaaaaauggacaaacugacucuaaaaggaauaucauauguaaugugcacaggcucauucaaguuagagaaggaaguggcugagacccagcauggaacuguucuaguacagguuaaauacgaaggaacagaugcaccaugcaagauccccuucucgucucaagaugagaagggaguaacccagaaugggagauugguaacggccaaccccauagucacugacaaagaaaaaccagucaauauugaggcggagccaccuuuuggugagaguuacaucgugguaggagcaggagaaaaagcuuugaaacuaagcugguucaagaagggaagcagcauagggaaaauguuugaagcaacugcccguggagcacgaaggauggccaucuugggagacaccgcaugggacuucgguucuauaggaggaguguucacgucugugggaaaacugguacaccagauuuuuggaacugcguauggagucuuguucaguggugucucuuggaccaugaaaauaggaauagggauucugcugacauggcugggauuaaacucaaggagcacgucucuuucaaugacguguaucgcaguugggcugaucacacuguaccuaggagucaugguccaggcggacucgggauguguaaucaacuggaaaggcagagaacucaaauguggaagcggcauuuuugucaccaaugaaguucacaccuggacagagcaauacaaauuucaggccgacuccccaaagagacuaucagcagccauugggaaggcaugggaggaagguguguguggaauucgaucagccacccgucucgagaacaucauguggaagcaaauaucaaaugaauuaaaccacaucuuacuugaaaaugacaugaaauuuacaguggucguaggagacguuaguggaaucuuggcccaaggaaagaaaucgauuaggccacaacccauggaacauaaauacucguggaaaagcuggggaaaagccaaaaucauuggagcagauguucagaacacuacuuucaucaucgacggcccaaacaccccagaaugcccugaugaccaaagagcauggaacaucugggaaguugaagacuauggauuuggaauuuucacgacaaacauaugguugaaauugcgugacuccuacacccaagugugugaccaucgacuaaugucagcugccaucaaggauagcaaagcaguccaugcugacaugggguacuggauagaaagugaaaagaacgagacuuggaaguuggcaagagccuccuucauagaagucaagacaugcaucuggccaaagucucacacucuauggagcaauggaguccuggaaagugagaugauaaucccaaagauauauggaggaccaauaucucagcauaauuacagaccaggauauuucacacaaacagcaggaccguggcacuuaggcaaguuggaacuagauuuugauuugugugaagguaccacaguuguuguagaugaacacuguggaaauagaggaccaucucuuagaaccacaacagucacaggaaagauaauccaugaauggugcuguagaucuugcacguuacccccccuacguuucaaaggagaagacgggugcugguauggcauggaaaucagaccagucaaggagaaggaagagaaccuagucaagucaauggucucugcagggucaggagagguggacaguuuuucacuaggacuguugugcauaucaauaaugaucgaagagguaaugagauccagauggagcaggaaaaugcugaugacuggaacauuggcuguguuccuccuucucacaaugggacaauugacauggaacgaucuaaucaggcuaugcaucaugguuggagccaaugcuucagacaauauggggaugggaacaacguacuuagcuuugauggccacuuucagaaugagaccaauguucgcagucgggcuauuauuucgcagauuaacaucuagagaaguucuucuucucacgguuggauugagucugguggcaucuguagaacuaccaaauuccuuagaggagcuaggggauggacuugcaaugggcaucaugauauuaaaauuacuaacugauuuucaaucacaucagcuaugggccaccuugcugucucugacauuugucaaaacaaccuuuucauugcacuacgcauggaagacaauggcuaugauacugucaauuguaucucucuucccuuuaugccuguccacgacuucucaaaaaacaacauggcuuccggugcuucuggggucucuuggaugcaaaccacuaaccauguuucucauaacagaaaacaaaaucuggggaaggaaaaguuggccucucaaugaaggaaucauggcuguuggaauaguuagcauucuacuaagcucacuucucaaaaaugaugugccacuagcuggcccauuaauagcuggaggcaugcuaauagcguguuaugucauauccggaagcucggccgauuuaucacuggagaaagcggcugaggucuccugggaagaagaagcagaacacucuggugccucacacaacauacuaguggagauccaagaugauggaaccaugaagauaaaagaugaagagagagaugacacgaucaccauccuccucaaagcaaccuugcuagcaaucucagggguauacccaaugucaauaccggcgacucucuuugugugguauuuuuggcagaaaaagaaacagagaucaggagugcuaugggacacaccaagcccuccagaaguggaaagagcaguccuugaugauggcauuuauagaauucuccaaaggggauuguugggcaggucucaaguaggaguaggaguuuuccaagaaggcguauuccacacaauguggcaugucaccaggggagcuguucucauguaccaagggaagagauuggaaccaaguugggccagugucaaaaaagacuugaucucauauggaggaggcuggagguuucaaggauccuggaacacgggagaagaagugcaggugauugcuguugaaccggggaagaacccaaaaaauguacagacagcgccggguaccuucaagaccucugaaggcgaaguuggagccauagcucuagacuuuaaacccggcacaucuggaucuccuaucgugaacagagagggaaaaauaguaggucuuuauggaaauggaguggugacaacaaguggaaccuaugucagugcuauagcucaagcuaaagcaucacaagaagggccuuugccagagauugaggacgagguguuuaggaaaagaaacuuaacaauaauggaccuacacccaggaucgggaaaaacaagaagauaccuuccagccauaguccgugaggccauaaaaagaaagcugcgcacgcuaguuuuagcucccacaaggguugucgccucugaaauggcagaggcgcucaagggaaugccaauaagguaucagacaacagcagugaagagugaacacacgggaagggagauaguugaccuuaugugucacgccacuuucacuaugcgucuccugucuccugugagaguucccaauuacaacaugauaaucauggaugaagcacauuucaccgauccagccagcauagcagccagaggguacaucucaacccgaguggguaugggugaagcagcugcgauuuucaugacagccacuccccccggaucgguggaggccuuuccacagagcaaugcaguuauccaagaugaggagaaagacauuccugaaagaucauggaacucaggcuaugacuggaucacugauuucccagguaaaacagucugguucguuccaagcaucaaaucaggaaaugacauugccaacuguuuaagaaaaaaugggaaacgggugauccaauugagcagaaaaacuuuugacacugaguaccagaaaacgaaaaauaacgacugggacuauguugucacaacagacauuuccgaaaugggagcaaacuuucgagccgacaggguaauagacccaaggcgaugccugaaaccgguaauacugaaagaugguccagagcgugucauucuagccggaccgaugccagugaccguggcuagugccgcccagaggagaggaagaauuggaaggaaccaaaauaaggaaggugaucaguauauuuacaugggacagccuuuaaauaacgaugaggaccacgcccauuggacagaagcaaaaaugcuccuugacaacauaaacacaccagaagggaucaucccagcccucuuugagccagaaagagaaaagagugcugcaauagacggggaauacagacuacggggugaagcgaggaaaacguuuguggagcucaugagaagaggagaucuaccugucuggcuaucuuacaaaguugccucagaaggcuuccaauacuccgacagaagguggugcuuugauggggaaaggaacaaccagguguuggaggagaacauggacguggagaucuggacaaaagaaggagaaagaaagaaacuacgaccccgcuggcuggaugccagaacauacucugacccacuggcucugcgcgaauucaaagaguucgcagcaggaagaagaagcgucucaggugaccuaauauuagaaauagggaaacuuccucaacaucuaacucaaagggcccagaaugcuuuggacaauuugguuaugcugcacaacucugaacaaggaggaaaagcuuauagacacgccauggaagaauugccagacacuauagagacguugaugcuccuagcucugauagcugugcugacugguggagugacgcuguucuuccuaucaggaagaggcuuagggaaaacauccauuggccuacucugcgugauguccucaagugcacuguuauggauggccaguguggagccccauuggauagcggccucuaucauacuggaguucuuucugaugguguugcuuauuccggagccagacagacagcgcacuccacaagacaaccaguuagcauauguggugauagguuuguuauucaugauauugacaguggcagccaaugagaugggauuauuagaaaccacaaagaaagaccuggggauuggucaugcagcugcugaaaaccaccaccacgccgcaaugcuggacguagaccuacauccagcuucagccuggacucucuacgcaguggccacaacgauuaucacucccaugaugagacacacaauugaaaacacaacggcaaacauuucccugacagccauugcaaaccaggcagcuauauugaugggacuugauaagggauggccaauaucaaagauggacauaggaguuccacuucucgccuuggggugcuauucucaggugaacccgcugacgcugacagcggcgguacugaugcuaguggcucauuaugccauaauuggaccaggacugcaagcaaaagccacuagagaagcucaaaaaagaacagcagccggaauaaugaaaaacccaacugucgacgggaucguugcaauagauuuagacccugugguuuaugaugcaaaauuugaaaaacagcuaggccaaauaauguuguugauacuaugcacaucucagauucucuugaugcggaccacaugggccuugugugaauccaucacacuggccacaggaccucugaccacgcuuugggagggaucuccaggaaaauucuggaacaccacgauagcgguguccauggcaaacauuuuuagggggaguuaucuagcaggagcgggucuggccuuuucauuaaugaaaucucuaggaggagguaggagagggacgggagcccaaggagaaacacugggagaaaaguggaaaagacagcuaaaccaauugagcaagucagaauuuaacauuuacaagaggagugguauuguagagguggauagaucugaagccaaggagggguuaaaaagaggagaaacaaucaaacacgcagugucgagaggaacggccaaacugaggugguuuguggagaggaaccuugugaaaccagaagggaaagucauagaccucggcuguggaagagguggcuggucauauuacugcgcugggcugaagaaagucacagaagugaaaggauacacaaaaggaggaccuggacaugaggaaccaaucccaauggcaaccuauggauggaaccuaguaaagcuauacuccgggaaagauguauucuuuauaccaccugagaaaugugacacccuuuugugugauauuggugaguccucuccgaacccgacuauagaagaaggaagaacguugcguguucuaaagaugguagaaccauggcucagaggaaaccaauuuugcauaaagauucuaaaucccuacaugccgagugugguagaaacucuggagcaaaugcaaagaaaacauggaggaaugcuagugcgaaauccacucucaagaaacuccacucaugaaauguacuggguuucauguggaacaggaaacauugugucagcaguaaauaugacaucuagaaugcugcugaaucgauucacgauggcucacaggaagccaacauaugaaagagauguggacuugggcgcuggaacgagacauguggcaguagaaccagagguggccaaccuagacaucauuggccagaggauagagaauauaaaaaaugaacacaaaucaacauggcauuaugaugaggacaacccguacaaaacaugggccuaucauggaucauaugaggucaagccaucaggaucagccucauccauggucaaugguguggugagacugcuaaccaaaccaugggaugucauucccauggucacacaaauagccaugacugauaccacacccuuuggacaacaaaggguguuuaaagagaaaguugacacgcguacaccaaaagcgaaacgaggcacagcacaaauuauggaggugacagccaagugguuaugggguuuucucuccagaaacaaaaaacccagaaucugcacaagagaggaguucacaagaaaagucaggucaaaugcagcuauuggagcgguguucguugaugaaaaucaauggaacucagcaaaagaggcaguggaagaugaaagguucugggaucuugugcgcagagagagggagcuucauaaacaaggaaaaugugccacgugugucuacaacaugaugggaaagagagagaaaaaauuaggagaguucggaaaggccaaaggaagucgcgcaauaugguauaugugguugggagcgcgcuucuuagaguuugaagcccucggcuucaugaaugaagaucacugguucagcagagagaauucacucaguggaguggaaggagaaggacuccacaaacuuggauacauacucagagacauaucaaagauuccagggggaaacauguaugcagaugauacagccggaugggacacaagaauaacagaggaugaucuucagaaugaggccaaaaucacugacaucauggaaccugaacacgcccuacuggccacgucaaucuuuaaguuaaccuaccaaaacaagguuguaagagugcagagaccagcaaaaaauggaaccgugauggaugucauauccaggcgugaccagagaggaaguggacagguuggaacuuauggcuuaaacaccuucaccaacaugggggcccaacuaauaagacaaauggagucugagggaaucuuuucacccagugaauuggaaaccccaaauuuagcuggaagaguccuugacugguuggaaaaacauggcaucgagaggcugagaagaauggcaaucaguggagaugacugcguggugaaaccaauugaugacagauuugcaacagccuuaacagccuugaaugauaugggaaagguaagaaaagacauaccgcaaugggaaccuucaaaaggauggaaugauuggcaacaagugccuuucugcucacaccacuuccaccagcugauuaugaaggauggaagggaaauaguagugccaugccgcaaccaagaugaacugguagguagggccagaguaucacaaggugccggauggagcuugagagaaacugcaugucuaggcaagucguaugcacaaauguggcagcugauguacuuccacaggagagacuugagauuagcggcuaaugcuauuuguucagccguuccaguugauugggucccaaccagucgcaccaccuggucgauccaugcccaccaucaauggaugacaacagaagacauguugucaguguggaauaggguuuggauagaggaaaacccauggauggaggauaaaacucacguguccagcugggaagacguuccauaccuagggaaaagggaagaucaaugguguggaucccuaauaggcuuaacagcacgagccaccugggccaccaacauacaaguggccauaaaccaagugagaaggcucauugggaaugagaauuaccuagacuacaugacaucaaugaagagauucaaaaacgagagugaucccgaaggggcacucugguaa

SEQ ID NO: 6354 - RNA, 9879 nt, Artificial Sequence
  derived and/or modified CDS sequence (wt) from DENV-1__DQ285559__SS-prME
uccgugacuaugcuccucaugcugcugcccacugcccugacauuccauuugaccacacgagggggagagccacacaugauaguuagcaagcaggaaagaggaaagucacucuuguuuaagaccucuguaggugucaauaugugcacucucauugcgauggauuugggagaguuaugugaggacacaaugaccuacaaaugcccccggaucacugaggcggaaccagaugauguugacuguuggugcaaugccacagacacaugggugaccuaugggacguguucucaaaccggcgaacaccgacgagacaaacguuccgucgcacuggccccacaugugggacuuggucuggaaacaagaaccgaaacguggauguccucugaaggcgccuggaaacaaauacaaaaaguggagacuugggcuuugcgacacccaggauuuacggugauagcccuuuucuuggcacaugccauaggaacauccaucacucagaaagggaucauuuucauucugcugaugcugguaacaccaucaauggccaugcgaugcgugggaauaggcaauagagacuuuguugaaggacugucaggagcaacguggguggauguaguacuggagcauggaagcugcgucaccaccauggcaaaaaauaaaccaacacuggacauugaacuucugaaaacggaggucacgaacccugccguccugcgcaaacugugcauugaagcuaaaauaucaaacaccaccaccgauucaagauguccaacacaaggagaagcuacacugguggaagaacaagaugcgaacuuugugugucgacgaacguucguggacagaggcugggguaauggcugcggacuauuuggaaaaggaagccuacugacgugugcuaaguucaagugugugacaaaacuagaaggaaagauaguucaauaugaaaacuuaaaauauucagugauagucacuguccacacuggggaccagcaccaggugggaaacgagacuacagaacauggaacaauugcaaccauaacaccucaagcuccuacgucggaaauacagcugaucgacuacggagcccucacauuggauugcucaccuagaacugggcuggacuuuaaugagauggugcuauugacaaugaaaggaaaaucauggcuuguccacaaacaaugguuucuagacuuaccacugccuuggacuucgggggcuucaacaucccaagagacuuggaacagacaggauuugcuggucacauucaagacagcucaugcaaagaagcaggaaguugucguacugggaucacaggaaggagcaaugcacacugcguugacuggggcgacagaaauccagacgucaggaacgacaacaaucuuugcaggacaccugaaaugcagacuaaaaauggauaaacugacuuuaaaagggaugucauaugugaugugcacaggcucauuuaagcuagagaaggaaguggcugagacccagcauggaacugucuuagugcagguuaaauacgaaggaacagaugcaccaugcaagauccccuuuucgacccaagaugagaaaggagugacccagaaugggagauugauaacagccaauccuauaguuacugacaaagaaaaaccaguuaacauugagacagaaccaccauuuggugagagcuacaucgugguaggggcaggugaaaaagcuuugaaacuaaguugguucaagaaaggaagcagcauagggaaaauguucgaagcaaccgcccgaggagcacgaaggauggcuauccugggagacaccgcaugggacuucgguuccauaggaggaguguucacgucugugggaaaauugacacaucagguuuuuggaaccgcauaugggguucuguucagcgguguuucuuggaccaugaaaauaggaauagggauucugcugacaugguugggauuaaauucaaggagcacgucacuuucgaugacgugcauugcaguuggcauggucacacuguaccuaggagucaugguucaagcggacucgggauguguaaucaacuggaagggcagagaacucaaauguggaaguggcauuuuugucacuaaugaaguccacacuuggacagagcaauacaaauuccaggcugacuccccaaaaaaacugucagcagccauuggaaaggcaugggaggagggcguguguggaauucgaucagccacgcgucuugagaacaucauguggaagcaaauaucaaaugaauugaacuacaucuuacuugaaaaugacaugaaauucacagugguuguaggagaugccaauggaauuuuggcccaagggaaaaaaaugauuagaccacaacccauggaacacaaauauucauggaaaagcuggggaaaagccaaaaucauaggagcagacauacagaacaccacuuucauuauugacggcccagauacuccagaaugucccgaugaccagagagcauggaacauuugggaaguugaggacuauggauucggaauuuucacgacaaacauauggcugaaauugcgugacuccuauacccaaaugugugaccaccggcuaaugucagcugccaucaaggacagcaaggcaguccaugcugauaugggguacuggauagaaagugaaaagaacgagaccuggaagcuagcgagagccuccuuuauagaagucaagacaugcaucuggccgaaaucccacacucuauggaguaauggagucuuggaaagugaaaugauaauuccaaagauauauggaggaccaauaucucagcacaacuacagaccaggguauuucacacaaacagcagggccauggcaccuaggcaaguuggaauuggauuuugauuugugugaagguaccacaguuguuguggaugaacauuguggaaaucgagguccaucucucagaacuacaacagucacaggaaagauaauccaugaaugguguugcagauccugcacguuaccccccuuacgcuucagaggagaagacggauguugguaugguauggaaaucagaccaguuaaggagaaggaggagaaucuaguuaggucaauggucucugcagggucaggagaaguggacaguuuuucauuaggaauacuaugcguaucaauacuaauugaagaagugaugagauccaaauggaguagaaagaugcugaugacuggaacacuggcuguuuuccuccuucuuauaaugggacaacugacauggaaugauuugaccagguuaugcaucaugguuggagccaaugcuucagacaggauggggaugggaacaacauaccuagccuugauggcuacuuucaaaaugagaccaauguuugcuguugggcuauuauuucguagacuaacauccagagaaguucuucuucucacgauuggauuaagccugguggcauccguggagcuaccaaauucuuuagaggagcuaggggauggacucgcaaugggcaucaugauauuaaaauuauugacugauuuucagccacaccaguuauggaccaccuuacugucuuuaacauuuaucaaaacgacucuuucauuggauuaugcauggaagacaauggccaugacacugucaauuguaucucucuuuccuuugugucugucuacgaccucccaaaaaacaacauggcuuccggugcuguuaggauccuuuggauguaaaccauuaaccauguuucuuauaacagaaaacaaaaucuggggaaggaaaaguuggcccaucaaugaaggaaucauggcuguuggaauagucagcauucuacuaaguucacuccucaaaaaugaugugccgcuagccggcccacuaauagcuggaggcauguuaauagcauguuaugucauauccggaagcucagccgaucuaucauuggagaaagcggcugagguguccugggaagaagaagcagaacacucugguaccucacacaacauauugguggagguucaagaugauggaaccaugaaaauaaaagaugaagagagggaugacacacucaccauacuccuuaaagcaacucugcuggcagucucaggaguguacccaaugucaauaccagcaacucuuuuugugugguauuuuuggcagaaaaagaaacagagaucaggaguguuaugggacacacccagcccuccggaaguggaaagagcaguucuugaugauggcauuuauagaaucuugcagagaggacuguuggggaggucccaaguaggagugggaguuuuccaagacggcguguuccacacaauguggcacgucaccaggggagcuguccuuauguaccaagggaagaggcuggaaccaagcugggcuagugucaaaaaagacuugaucucauauggaggagguuggagguuucaaggaucauggaacacaggagaagaagugcaagugauagcuguugaaccaggaaaaaaccccaaaaauguacagacaacgccggguaccuucaagacuccugaaggcgaaguuggagccauagcucuagacuucaaacccggcacaucuggaucucccaucgugaacagagagggaaaaauaguaggucuuuauggaaauggaguggugacaacaaguggaaccuacgucagugccaucgcucaagccaaagcaucgcaagaagggccucuaccagagauugaggacgagguguuuaagaaaagaaacuuaacaauaauggaccugcauccaggaucaggaaaaacaagaagauaucuuccagccauaguccgugaggccauaaaaaggaagcugcgcacgcuaaucuuggcucccacaagaguugucgccucugaaauggcagaggcgcucaagggaaugccaauaagauaucagacaacagcagugaagagugaacauacaggaagggagauaguugaccucaugugccacgccacuuuuaccaugcgucucuuaucuccagugagaguucccaauuacaacaugauuaucauggaugaagcacauuuuaccgauccagccagcauagcggccagaggguacaucucaacccgaguggguaugggugaagcagcugcgaucuucaugacagccacacccccaggaucgguggaggccuuuccacagaguaaugcaguuauccaagacgaggaaaaagacauuccugagagaucauggaacucaggcuacgacuggaucacugauuuuccagguaaaacaguuugguuugucccaagcaucaaaucaggaaaugauauugccaacuguuuaagaaagaacggaaaacgggugauucaacugagcaggaaaacauuugacacugaguaccagaaaacaaaaaacaaugacugggacuauguugucacaacagacauuuccgaaaugggagcaaauuuccgagccgauagggugauagauccaaggcggugcuugaaaccgguaauacuaaaagaugguccagagcgcgucauucuagccggaccaaugccagugacuguggccagugcugcccagaggagaggaagaauuggaaggaaucaaaacaaagaaggugaucaguacguuuacaugggacagccuuuaaauaaugaugaggaucacgcccacuggacagaagcaaaaaugcuccucgacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuaucuuacaaagucgccucagaagguuuccaauauuccgacagaagaugguguuuugauggggaaaggaacaaccagguguuggaggagaacauggacguggagaucuggacaaaggaaggagaaagaaagaaauugcgaccccgcugguuggaugcuagaacuuacucugauccauuggcccugcgcgaguuuaaagaguuugcagcaggaagaagaagugucucaggugaccuaauauuggaaauaggaaaacuuccacaacauuugacgcuaagagcccagaaugcuuuggauaauuuggucauguugcacaauuccgaacaaggaggaaaagccuacagacaugcuauggaggaacuaccagacaccauagaaacauugaugcuccuagcuuugauagcugugcugacugguggagugacgcuguucuuccuaucaggaaaaggucuaggaaaaacauccauuggccuacucugugugauggccucaagcgcacuguuauggauggccaguguggagccccauuggauagcggccuccaucauacuagaguucuuucugauggugcugcucauuccagagccagacagacagcgcaccccacaggacaaccaguuagcauauguggugauaggcuuguuauucaugauacucacaguggcagccaacgagaugggauuguuggaaaccacaaagaaagaccuggggauuggccacguagccgccgaaaaccaccaccaugcuacaauguuggacguagaccuacguccagcuucagccuggacccucuaugcaguagccacaacaguuaucacccccaugaugaggcacacaauugaaaauacaacggcaaauauuucccugacagccauugcaaaucaggcagccauauugaugggacuugacaagggauggccaauaucgaagauggacauaggaguuccacuucuugccuuagggugcuauucccaggugaacccauugacacugacagcagcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggucaaauaauguuacugauacuuuguacaucacagauucucuugaugcggaccacaugggcuuugugugaauccaucacacuggcuacuggacccuugaccacucuuugggagggaucuccaggaaaauucuggaacaccacgauagcaguguccauggcaaacaucuucaggggaaguuaucuagcaggagcaggucuggccuucucauugaugaaaucuuuaggaggagguaggagaggcacgggagcucaaggggaaacacugggagaaaaauggaaaagacagcuaaaccaacugagcaagucagaauuuaacaccuacaaaaggagugggauuauggagguggacagauccgaagccaaagagggauugaaaagaggagaaacaaccaaacaugcagugucgagaggaacagccaaacugaggugguuuguggagaggaaccucgugaaaccagaagggaaagucauagaccucgguuguggaagagguggcuggucauauuauugcgcugggcugaagaaagucacugaagugaagggauauacaaaaggaggaccuggacaugaggaaccuaucccaauggcgaccuauggauggaaccuaguaaagcugcacucuggaaaagauguguucuucauaccgccugagaaaugugacacccuuuugugugauaucggugaguccucuccgaauccaacuauagaagaaggaagaacguuacguguucuaaagaugguggaaccauggcucaaaggaaaccaauucugcauaaagauccugaauccuuacaugccaagugugguagaaacucuggagcaaaugcaaagaaaacauggagggaugcuggugcgaaacccacucucaagaaauuccacccaugaaauguacuggguuucauguggaacaggaaacauugugucggcagugaacaugacauccagaauguuacugaaccgauucacaauggcucauaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaagacaauccauacaaaacaugggcuuaucauggaucguaugaggucaagccaucaggaucagccucauccauggugaauggcguggugagauugcucaccaaaccaugggauguuaucccuauggucacacaaauagccaugacugauaccacaccauucggacaacagaggguguuuaaagagaaaguugacacgcgcacaccaagagcaaaacgaggcacagcacaaauuauggaggugacagccaagugguuaugggguuuccuuuccagaaacaaaaaacccagaaucugcacaagagaggaguucacaagaaaagucaggucaaacgcagcaauaggagcaguguucguugaugaaaaccaauggaacucagcaaaagaagcaguggaagacgaaagguuuugggaucucguacacagagagagggagcuucauaaacagggaaaaugugccacguguguuuacaacaugauggggaagagagagaaaaaauuaggagaguuuggaaaagcaaaaggaagccgugcaauaugguacauguggcugggagcacgcuuucuagaauuugaagcccuugguuucaugaaugaagaucacugguucaguagagagaauucacucaguggaguggaaggagaaggacugcacaaacuuggauacauacucagagacauaucaaagauuccggggggaaauauguaugcagaugacacagccggaugggacacaagaauaacagaggaugaucuucagaaugaggcuaaaaucacugacaucauggagccugaacaugcucuauuggcuacagcaauuuuuaaacugaccuaccaaaauaagguggugagggugcaaagaccagcaaaaaguggaaccguaauggaugucauauccagacgugaccagagaggaaguggacaggucggaacuuauggcuuaaacacuuucaccaauauggaggcucaauuaauaagacaaauggagucugaaggaaucuuccuacccagcgaauuggaaacccccaaucuagcuaagagaguucuugacugguuggaaaaauauggcgccgaaaggcugaaaagaauggcaauuagcggagaugauuguguggugaaaccaauugaugacagguucgcaaaggccuuaacagcucugaaugauaugggaaaaguaagaaaagacauaccgcagugggaaccuucaaaaggauggaaugacuggcagcaagugccuuucuguucacaccacuuccaccagcugaucaugaaagaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuagcggcuaaugcuaucuguucagccgucccaguugacugggucccaaccagccgcacuaccuggucgauccaugcccaccaccaauggaugacaacagaagacauguuaucaguguggaauaggguuuggauagaggaaaacccauggauggaggacaaaacucauguauccaguugggaagagguuccauacuuagggaaaagggaagaucaaugguguggaucccugauaggcuugacagcgagggccaccugggccaccaacauacaaguagccauaaaccaggugagaaggcucaucgggaaugagaauuaucuagauuacauggcaucgaugaagagauucaagaaugagagugaucccgaaggggcgcucugguag

SEQ ID NO: 6355 - RNA, 9879 nt, Artificial Sequence
  derived and/or modified CDS sequence (wt) from DENV-1__AF311956__SS-prME
uccgugaccaugcuccucaugcugcugcccacagcccuggcuuuccauuugaccacacgagggggagagccacacaugauaguuaguaagcaggaaagaggaaagucacucuuguucaagaccucugcagguguuaauaugugcacucucauugcgauggauuugggagaguuaugugaggacacaaugaccuacaaaugcccccggaucacugaggcggaaccagaugacguugacuguuggugcaaugccacagacacaugggugaccuaugggacguguucucaaaccggcgaacaccgacgagacaaacguuccguggcacuggccccacacgugggacucggucuagaaacaagaaccgaaacauggauguccucugaaggcgccuggaaacaaauacaaaaaguggagacuugggcuuugagacacccaggauucacggugauagcccuuuuuuuagcacaugccauaggaacauccaucacucagaaagggaucauuuucauucugcugaugcuggugacaccaucaauggccaugcgaugcgugggaauaggcaacagagacuucguugaaggacugucaggagcaacguggguagacgugguauuggagcauggaagcugcgucaccaccauggcaaaaaauaaaccaacauuggacauugaacucuugaagacggaggucacgaacccugccgucuugcgcaaacugugcauugaagccaaaauaucaaacaccaccaccgauucaagauguccaacacaaggagaggcuacacugguggaagaacaagacgcgaacuuugugugucgccgaacguuuguggacagaggcugggguaauggcugcggauuauucggaaaaggaagucuauugacgugugccaaguucaagugugugacaaaacuagaaggaaagauaguucaauaugaaaacuuaaaauauucagugauagucaccguccacacuggggaucagcaccaggugggaaacgagacuacagaacauggaacaauugcaaccauaacaccucaagcuccuacgucggaaauacaguugacugacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagacuuggaacagacaagauuugcuggucacauucaagacagcucaugcaaagaaacaggaaguagucguacugggaucacaagaaggagcaaugcacaccgcguugacuggggcgacagaaauccagacgucaggaacgacaacaaucuuugcagggcacuugaaaugcagacuaaaaauggauaaacugacuuuaaaggggacgucauaugugaugugcacaggcucauuuaagcuagagaaggaaguggcugagacccagcaugggacuguucuagugcaggucaaauacgaaggaacagaugcgccaugcaagauccccuuuucgacccaagaugagaaaggggugacccagaaugggagauugauaacagccaaucccauaguuacugacaaagaaaaaccagucaacaucgagacagaaccaccuuuuggugagagcuacaucgugguaggggcaggugaaaaagcuuugaaacuaagcugguucaagaaaggaagcagcauagggaaaauguucgaagcaaccgcccgaggagcacgaaggauggcuauccugggagacaccgcaugggacuucggcucuauaggaggaguguucacauccgugggaaaauugguacaccagguuuuuggaaccgcauaugguguucuguucagcgguguuucuuggaccaugaaaauaggaauagggauucugcugacaugguugggauuaaauucaaggagcacgucacuuucgaugacgugcauugcaguuggcaugguuacacuguaccuaggagucaugguucaagcggacucgggauguguaaucaacuggaagggcagagaacucaaauguggaaguggcauuuuugucacuaaugaaguccacacuuggacagagcaauacaaauuccaagcugacuccccaaaaagacugucagcagccauuggaagggcaugggaggagggcguguguggaauucgaucagccacgcgucuugagaacaucauguggaagcaaauaucaaaugaauugaaccacauucuacuugaaaaugacauaaaauucacagugguuguaggaaaugcuaauggaauuuuggcccaaggaaaaaaaaugauuaggccacaacccauggaacacaaauacucauggaaaagcuggggaaaagcuaaaaucauaggagcagacauacaaaauaccaccuucaucaucgacggcccagauacuccagaaugccccgaugaacaaagagcguggaacauuugggaaguugaggacuauggguuuggaauuuucacgacaaacauauggcugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccucguucauagaagucaagacaugcaucuggccgaaaucccacacucuauggaguaauggaguuuuggaaagugaaaugauaaucccaaagauguacggaggaccaauaucucagcacaacuacagaccaggguauuucacacaaacagcagggccauggcaccuaggcaaguuggaauuggauuuugacuugugugaaggaaccacaguuguuguggaugaacauuguggaagucgagguccaucucucagaacuacaacagucacaggaaagauaauccaugaaugguguugcagauccugcacguuaccccccuuacguuucagaggagaagacggauguugguaugguauggaaaucagaccaguuaaggagaaggaggagaaccuaguuaggucaauggucucugcagggucaggagaaguggacaguuuuucauuaggaauacuaugcguaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaagauggggaugggaacaacguaccuagccuugauggcuacuuucaaaaugagaccaauguucgcuguugggcuauuauuucgcagacuaacauccagagaaguucuucuucucacgauuggauuaagccugguggcauccguggagcuaccaaauucuuuggaggagcuaggggauggacuugcaauggguaucaugauguuaaaauuauugacugaauuucagccacaccaguuauggaccaccuuacugucucugacauuuaucaaaacaacucuuucauuggauuacgcauggaagacaacggcuaugguacugucaaucguaucucucuuuccuuuaugccugucuacgaccucucaaaaaacaacauggcuuccggugcuguuaggaucuuuuggaugcaaaccauuaaccauguuucuuauaacagaaaacgaaaucuggggaagaaaaaguuggccccucaaugaaggaauuauggcuauuggaauagucagcauucuacuaaguucacuccucaaaaaugaugugccguuggccggcccacucauagcuggaggcaugcuaauagcauguuaugucauauccggaagcucagccgaucuaucauuggagaaagcggcugagguauccugggaagaagaagcagaacacuccgguaccucacacaacauauuaguagagguccaagaugauggaacuaugaaaauaaaagaugaagaaagggaugacacacucacuauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcgguucuugaugauggcaucuacagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccaguguaaaaaaggacuugaucucauauggaggagguuggagguuucaaggaucauggaacacgggagaagaagugcaggugauagcuguugaaccagggaaaaaccccaaaaauguacagacaacgccggguaccuucaagacuccugaaggcgaaguuggagccauagcucuagauuuuaaacccggcacaucuggaucucccaucgugaacagagagggaaaaauaguaggucuuuauggaaauggaguggugacaacaaguggaaccuacgucagugccauagcccaagcuaaagcaucacaggaagggccucuaccagagauugaggacgagguguuuaagaaaagaaacuuaacaauaauggaccuccauccaggaucaggaaaaacaagaagauaucuuccagccauaguccgugaggccauaaaaaggaaacugcgcacguuaaucuuggcucccacaagaguugucgccucugaaauggcagaggcgcucaagggaaugccaauaagauaucagacaacagcagugaagagugagcacacaggaagggagauaguugaccucaugugccacgccacuuuuaccaugcgucucuuauccccagugagaguucccaauuacaacaugauuauuauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaauucaggcuacgacuggaucacugauuuuccagguaaaacagucugguuuguuccaagcauuaaaucaggaaaugacauugccaacugucuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagauggcccagagcguguuauucuagccggaccgaugccagugacuguggccagugcugcccaaaggagaggaagaauuggaaggaaccagaacaaggaaggugaucaguauguuuacaugggacagccuuuaaauaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagauuuaccaguuuggcuauccuacaaaguugccucagaagguuuccaguacuccgacagaagguggugcuuugauggagaaaggaacaaccagguguuggaggagaacauggacguggagaucuggacaaaggaaggagaaagaaagaaauugcgaccccgcugguuggaugccagaacauacucugauccacuggcccugcgcgaguuuaaagaguuugcagcaggaagaagaagugucucaggugaccuaauauuggaaauagggaaacuuccacaacauuugacgcuaagagcccagaaugcucuggauaacuuggucauguugcauaauuccgaacaaggaggaaaagccuauagacaugcuauggaggaacuaccagacaccauagaaacauugaugcuccuagcuuugauagcuguguugacugguggagugacgcuguucuuccuaucaggaaaaggucuagggaaaacauccauuggcuugcucugugugacggccucaagcgcacuguuauggauggccaguguggagccccauuggauagcggccuccaucauacuagaguucuuuuugauggugcugcucauuccugagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaauacuggacguagaccuacauccagcuucagccuggacucucuaugcaguagccacaacagucaucacucccaugaugagacacacaauugaaaauacaacggcaaacauuucccugacagccauugcaaaucaggcagcuauauugaugggacuugacaagggauggccaauaucgaagauggaccuaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccuccugaugcggaccacaugggccuugugugaaucuaucacacuggcuacuggaccccugaccacucuuugggagggaucuccaggaaaauucuggaauaccacgauagcaguguccauggcaaacaucuucaggggaaguuaucuagcaggagcaggucuggccuucucauuaaugaaaucuuuaggaggagguaggagagguacgggagcucaaggggaaacacugggagagaaauggaaaagacaguuaaaccaacugagcaagucagaauucaacaccuacaaaaggagugggauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaacccaucccaauggcgaccuauggauggaaccuagugaagcugcacucuggaaaagauguauuuuuuaugccaccugagaaaugugacacccuucugugugauauuggugaguccucuccgaauccaacuauagaagaagguagaacguuacguguucuaaagaugguggaaccauggcucagaggcaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucaugugggacaggaaacauugugucggcagugaacaugacauccagaauguugcugaaucgauucacaauggcucauaggaagccaacauaugaaagagacguggacuuaggcgcuggaacaagacauguggcaguggaaccagaaguagccaaccuagauaucauuggccagaggauagagaauauaaaaaaugaacacaagucaacauggcauuaugaugaggacaauccauacaaaacaugggccuaucauggaucauaugagguuaagccaucaggaucagccucaucuauggugaauggaguggugagauugcucacaaaaccaugggaugucauccccauggucacacaaauagcuaugacugauaccacacccuuuggacaacagagaguguuuaaagagaagguugacacgcgcacaccaagagcaaaacgaggcacagcacaaauuauggaggugacagccaagugguuauggggauuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucacaaacagggaaaaugugccacgugugucuacaacaugauggggaagagagagaaaaaauuaggagaguuuggaaaggcaaaaggaagucgugcaauaugguacauguggcugggagcacgcuuucuggaguucgaggcccuugguuucaugaaugaagaucacugguuuaguagagagaauucacucaguggaguggaaggagaaggacugcacaaacuuggauacauacucagagacauaucaaagauuccggggggaaauauguaugcagaugauacagccggaugggacacaagaauaacagaggaugaucuucagaaugaggcuaaaaucacugacaucauggagccugaacaugcucuauuggcuacgucaauuuuuaagcugaccuaccaaaacaagguggugagggugcaaagaccagcaaaaaauggaaccgugauggauguuauauccagacgugaccagagaggaaguggacaggucggaacuuauggcuuaaauacuuucacuaauauggagguccaacuaauaagacaaauggagucugaaggaaucuuuuuucccagcgaauuggaaagccccaaucuagcugaaagaguucuugacugguuggaaaaacauggcgccgaaaggcugaaaagaauggcaaucagcggagaugacuguguagugaaaccaauugaugacagauucgcaacagccuuaauagcucugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgcuggauggagccugagagaaacugcuugccuaggcaagucauaugcacaaauguggcagcugauguacuuccacaggagagaccugagacuagcggcuaaugcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccaccaacauacaaguagccauaaaccaagugagaaggcucaucgggaaugagaauuaucuagauuacaugacaucaaugaagagauucaagaaugagagugaucccgaaggggcacucugguga

SEQ ID NO: 6356 - RNA, 9879 nt, Artificial Sequence
  derived and/or modified CDS sequence (wt) from DENV-1__AF311958__SS-prME
uccgugaccaugcuccucaugcugcugcccacagcccuggcguuccauuugaccacacgagggggagagccacacaugauaguuaguaagcaggaaagaggaaagucacucuuguucaagaccucugcagguguuaauaugugcacucucauugcgauggauuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagacaaacguuccguggcacuggccccacacgugggacucggucuagaaacaagaaccgaaacauggaugucuucugaaggcgccuggaaacaaauacaaaaaguggagacuugggcuuugagacacccaggauucacggugauagcccuuuuuuuagcacaugccauaggaacauccaucacucagaaagggaucauuuucauucugcugaugcuggugacaccaucaauggccaugcgaugcgugggaauaggcaacagagacuucgucgaaggacugucaggagcaacguggguagacgugguauuggagcauggaagcugcgucaccaccauggcaaaaaauaaaccaacauuggacauugaacucuugaagacggaggucacgaacccugccgucuugcgcaaacugugcauugaagccaaaauaucaaacaccaccaccgauucaagauguccaacacaaggagaggcuacacugguggaagaacaagacgcgaacuuugugugucgccgaacguuuguggacagaggcugggguaauggcugcggauuauucggaaaaggaagccuauugacgugugccaaguucaagugugugacaaaacuagaaggaaagauaguucaauaugaaaacuuaaaauauucagugauagucaccguccacacuggggaucagcaccaggugggaaacgagacuacagaacauggaacaauugcaaccauaacaccucaagcuccuacgucggaaauacaguugacugacuacggaacccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagacuuggaacagacaagauuugcuggucacauucaagacagcucaugcaaagaaacaggaaguagucguacugggaucacaagaaggagcaaugcacaccgcguugacuggggcgacagaaauccagacgucaggaacgacaacaaucuuugcagggcaccugaaaugcagacuaaaaauggauaaacugacuuuaaaggggacgucauaugugaugugcacaggcucauuuaagcuagagaaggaaguggcugagacccagcaugggacuguucuagugcaggucaaauacgaaggaacagaugcgccaugcaagauccccuuuucgacccaagaugagaaaggggugacccagaaugguagauugauaacagccaaucccauaguuacugacaaagaaaaaccagucaacauugagacagaaccaccuuuuggugagagcuacaucgugguaggggcaggugaaaaagcuuugaaacuaagcugguucaagaaaggaagcagcauagggaaaauguucgaagcaaccgcccgaggagcacgaaggauggcuauccugggagacaccgcaugggacuucggcucuauaggaggaguguucacaucugugggaaaauugguacaccagguuuuuggaaccgcauaugguguucuguucagcgguguuucuuggaccaugaaaauaggaauagggauucugcugacaugguugggauuaaauucaaggagcacgucacuuucgaugacgugcauugcaguuggcaugguuacacuguaccuaggagucaugguucaagcggacucgggaugcguaaucaacuggaagggcagagaacucaaauguggaaguggcauuuuugucacuaaugaaguccacacuuggacagagcaauacaaauuccaggcugacuccccaaaaagacugucagcagccauuggaagggcaugggaggagggcguguguggaauucgaucagccacgcgucuugagaacaucauguggaagcaaauaucaaaugaauugaaccacauucuacuagaaaaugacauaaaauucacagugguuguaggaaaugcuaauggaauuuuggcccaaggaaaaaaaaugauuaggccacaacccauggaacacaaauacucauggaaaagcuggggaaaagcuaaaaucauaggagcagacauacaaaauaccaccuucaucaucgacggcccagauacuccagaaugccccgaugaacaaagagcguggaacauuugggaaguugaggacuauggguuuggaauuuucacgacaaacauauggcugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccucguucauagaagucaagacaugcaucuggccgaaaucucacacucuauggaguaauggaguuuuggaaagugaaaugauaaucccaaagauguauggaggaccaauaucucagcacaacuacagaccaggguauuucacacaaacagcagggccauggcaucuaggcaaguuggaauuggauuuugacuugugugaaggaaccacaguuguuguggaugaacauuguggaagucgagguccaucucucagaacuacaacagucacaggaaagauaauccaugaaugguguugcagauccugcacguuaccccccuuacguuucagaggagaagacggauguugguaugguauggaaaucagaccaguuaaggagaaggaggagaaccuaguuaggucaauggucucugcagggucaggagaaguggacaguuuuucauuaggaauacuaugcguaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaagauggggaugggaacaacguaccuagccuugauggcuacuuucaaaaugagaccaauguucgcuguugggcuauuauuucgcagacuaacauccagagaaguucuucuucucacgauuggauuaagccugguggcauccguggagcuaccaaauucuuuggaggagcuaggggauggacucgcaauggguaucaugauguuaaaauuauugacugaauuucagccacaccaguuauggaccaccuuacugucucugacauuuaucaaaacaacucuuucauuggauuacgcauggaagacaacggcuaugguacugucaaucguaucucucuuuccuuuaugccugucuacgaccucucaaaaaacaacauggcuuccggugcuguuaggaucuuuuggaugcaaaccauuaaccauguuucucauaacagaauacgaaaucuggggaagaaaaaguuggccccucaaugaaggaauuauggcuauuggaauagucagcauucuacuaaguucacuccucaaaaaugaugugccguuggccggcccacuaauagcuggaggcaugcuaauagcauguuaugucauauccggaagcucagccgaucuaucauuggagaaagcggcugagguauccugggaagaagaagcagaacacuccgguaccucacacaacauauuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcgguucuugaugauggcaucuauagaaucuugcaaagaggacuguugggcaggucccaagugggagugggaguuuuccaagacggcguguuccacacaauguggcacgucaccaggggagcuguccuuauguaccaagggaagaggcuggaaccaagcugggccagugucaaaaaggacuugaucucauauggaggagguuggagguuucaaggaucauggaacacgggagaagaagugcaggugauagcuguugaaccaggaaaaaaccccaaaaauguacagacaacgccggguaccuucaagacucccgaaggcgaaguuggagccauagcucuagauuuuaaacccggcacaucuggaucucccaucgugaacagagagggaaaaauaguaggucuuuauggaaauggaguggugacaacaaguggaaccuacgucagugccauagcccaagccaaagcaucacaggaagagccucuaccagagauugaggacgagguguuuaagaaaagaaacuuaacaauaauggaccuucauccaggaucaggaaaaacaagaagauaucuuccagccauaguccgugaggccauaaaaaggaaacugcguacguuaaucuuggcucccacaagaguugucgccucugaaauggcagaggcgcucaagggaaugccaauaagauaucagacaacagcagugaagagugagcacacaggaagggagauaguugaccucaugugccaugccacuuuuaccaugcgucucuuauccccagugagaguucccaauuacaacaugauuauuauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaauucaggcuacgacuggaucacugauuuuccagguaaaacagucugguuuguuccaagcauuaaaucaggaaaugacauugccaacugcuuaagaaagaacggaaaacggguaauccaauugagcaggaaaaccuuugacacugaguaccagaaaacaaaaaacaaugacugggacuauguugucacaacagacauuucugaaaugggggcaaauuuccgggcugacaggguaauagacccaaggcggugcuugaaaccgguaauacuaaaagaugguccagagcguguuauucuagccggaccgaugccagugacuguggccagugcugcccaaaggagaggaagaauuggaaggaaccagaacaaggaaggugaucaguauguuuacaugggacagccuuuaaauaaugaugaggaucacgcucauuggacagaagcaaaaaugcuccuugacaauauaaacacaccagaagggaucaucccagcccuuuuugagccagagagagaaaagagugcagcaauagacggggaguacagacugcggggagaagcaaggaaaacguucguggagcucaugagaagaggagaucuaccaguuuggcuauccuacaaaguugccucagaagguuuccaguacuccgacagaagguggugcuuugauggagaaaggaacaaccagguguuggaggagaacauggacguggagaucuggacaaaggaaggagaaagaaagaaauugcgaccccgcugguuggaugccagaacauacucugauccacuggcccugcgcgaguuuaaagaguuugcagcaggaagaagaagugucucaggugaccuaauauuggaaauagggaaacuuccacaacauuugacgcuaagagcccagaaugcucuggacaacuuggucauguugcauaauuccgaacaaggaggaaaagccuauagacaugcuauggaggaacuaccagacaccauagaaacauugaugcuccuagcuuugauagcuguguugacugguggagugacgcuguucuuccuaucaggaaaaggucuagggaaaacauccauuggcuugcucugugugacggccucaagcgcacuguuauggauggccaguguggagccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagacuuacauccagcuucagccuggacucucuaugcaguagccacaacagucaucacucccaugaugagacacacaauugaaaauacaacggcaaacauuucccugacagccauugcaaaucaggcagcuauauugaugggacuugacaagggauggccaauaucgaagauggaccuaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaaucuaucacacuggcuacuggaccccugaccacucuuugggagggaucuccaggaaaauucuggaauaccacgauagcaguguccauggcaaacaucuucaggggaaguuaucuagcaggagcaggucuggccuucucguuaaugaaaucuuuaggaggagguaggagagguacgggagcucaaggggaaacauuaggagagaaauggaaaagacaguuaaaccaacugagcaagucagaauucaacaccuacaaaaggagugggauuauggagguggacagaucugaagccaaagagggacugaaaagaggagaaacaaccaaacaugcagugucgagaggagcagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaacccaucccaauggcgaccuauggauggaaccuagugaagcugcacucuggaaaagauguauuuuuuaugccaccugagaaaugugacacccuucugugugauauuggugaguccucuccgaauccaacuauagaagaagguagaacguuacguguucuaaagaugguggaaccauggcucagaggcaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucaugugggacaggaaacauugugucggcagugaacaugacauccagaauguugcugaaucgauucacaauggcucauaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaagacaauccauacaaaacaugggccuaucauggaucauaugagguuaagccaucaggaucagccucaucuauggugaauggaguggugagauugcucacaaaaccaugggauguuauccccauggucacacaaauagcuaugacugauaccacacccuuuggacaacagagaguguuuaaagagaagguugacacgcgcacaccaagagcaaaacgaggcacagcacaaauuauggaagugacagccaagugguuaugggguuuccuuuccagaaacaaaaaacccagaaucugcacaagagaggaguucacaaggaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaggcccuugguuucaugaaugaagaucacugguuuaguagagagaauucacucaguggaguggaaggagaaggacugcacaaacuuggauacauacucagagacauaucaaagauuccagggggaaauauguaugcagaugauacagccggaugggacacaagaauaacagaggaugaucuucagaaugaggcuaaaaucacugacaucauggagccugaacaugcucuauuggcuacgucaauuuuuaagcugaccuaccaaaacaagguggugagggugcaaagaccagcaaaaaauggaaccgugauggauguuauauccagacgugaccagagaggaaguggacaggucggaacuuauggcuuaaauacuuucacuaauauggagguccaacuaauaagacaaauggagucugaaggaaucuuuuuucccagcgaauuggaaagccccaaucuagcugaaagaguucuugacugguuggaaaaacauggcgccgaaaggcugaaaagaauggcaaucagcggagaugauuguguagugaaaccaauugaugacagauucgcaacagccuuaauagcucugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugucgcaaccaagaugaacuugugggcagggcuagaguaucacaaggcgccggauggagccugagagaaacugcuugccuaggcaagucauaugcacaaauguggcagcugauguacuuccacaggagagaccugagacuagcggcuaaugcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccaccaacauacaaguagccauaaaccaagugagaaggcucaucgggaaugagaauuaucuagauuacaugacaucaaugaagagauucaagaaugagagugaucccgaaggggcacucugguaa

SEQ ID NO: 6357 - RNA, 9879 nt, Artificial Sequence
  derived and/or modified CDS sequence (wt) from DENV-1__AF311957__SS-prME
uccgugaccaugcuccucaugcugcugcccacagcccuggcguuccauuugaccacacgagggggagagccacacaugauaguuaguaagcaggaaagaggaaagucacucuuguucaagaccucugcaggugucaauaugugcacucucauugcgauggauuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagacaaacguuccguggcacuggccccacacgugggacucggucuagaaacaagaaccgaaacauggaugucuucugaaggcgccuggaaacaaauacaaaaaguggagacuugggcuuugagacacccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucgucgaaggacugucaggagcaacguggguagacgugguauuggagcauggaagcugcgucaccaccauggcaaaaaauaaaccaacauuggacauugaacucuugaagacggaggucacgaacccugccgucuugcgcaaacugugcauugaagccaaaauaucaaacaccaccaccgauucaagauguccaacacaaggagaggcuacacugguggaagaacaagacgcgaacuuugugugucgccgaacguuuguggacagaggcugggguaauggcugcggauuauucggaaaaggaagccuauugacgugugccaaguucaagugugugacaaaacuagaaggaaagauaguucaauaugaaaacuuaaaauauucagugauagucaccguccacacuggggaucagcaccaggugggaaacgagacuacagaacauggaacaauugcaaccauaacaccucaagcuccuacgucggaaauacaguugacugacuacggagcccucacauuggacugcucacccagaacagggcuggacuuuaaugagauggugcuauugacaaugaaagaaaaaucauggcuuguccacaaacaaugguuucuagacuuaccacugccuuggacuucgggggcuucaacaucccaagagacuuggaacagacaagauuugcuggucacauucaagacagcucaugcaaagaaacaggaaguagucguacugggaucacaagaaggagcaaugcacaccgcguugacuggggcgacagaaauccagacgucaggaacgacaacaaucuuugcagggcaccugaaaugcagacuaaaaauggauaaacugacuuuaaaggggacgucauaugugaugugcacaggcucauuuaagcuagagaaggaaguggcugagacccagcaugggacuguucuagugcaggucaaauacgaaggaacagaugcgccaugcaagauccccuuuucgacccaagaugagaaaggggugacccagaaugggagauugauaacagccaaucccauaguuacugacaaagaaaaaccagucaacauugagacagaaccaccuuuuggugagagcuacaucgugguaggggcaggugaaaaagcuuugaaacuaagcugguucaagaaaggaagcagcauagggaaaauguucgaagcaaccgcccgaggagcacgaaggauggcuauccugggagacaccgcaugggacuucggcucuauaggaggaguguucacaucugugggaaaauugguacaccagguuuuuggaaccgcauaugguguucuguucagcgguguuucuuggaccaugaaaauaggaauagggauucugcugacaugguugggauuaaauucaaggagcacgucacuuucgaugacgugcauugcaguuggcaugguuacacuguaccuaggagucaugguucaagcggacucgggauguguaaucaacuggaagggcagagaacucaaauguggaaguggcauuuuugucacuaaugaaguccacacuuggacagagcaauacaaauuccaggcugacuccccaaaaagacugucagcagccauuggaagggcaugggaggagggcguguguggaauucgaucagccacgcgucuugagaacaucauguggaagcaaauaucaaaugaauugaaccacauucuacuagaaaaugacauaaaauucacagugguuguaggaaaugcuaauggaauuuuggcccaaggaaaaaaaaugauuaggccacaacccauggaacacaaauacucauggaaaagcuggggaaaagcuaaaaucauaggagcagacauacaaaauaccaccuucaucaucgacggcccagauacuccagaaugccccgaugaacaaagagcguggaacauuugggaaguugaggacuauggguuuggaauuuucacgacaaacauauggcugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccucguucauagaagucaagacaugcaucuggccgaaaucccacacucuauggaguaauggaguuuuggaaagugaaaugauaaucccaaagauguauggaggaccaauaucucagcacaacuacagaccaggguauuucacacaaacagcagggccauggcaucuaggcaaguuggaauuggauuuugacuugugugaaggaaccacaguuguuguggaugaacauuguggaagucgagguccaucucucagaacuacaacagucacaggaaagauaauccaugaaugguguugcagauccugcacguuaccccccuuacguuucagaggagaagacggauguugguaugguauggaaaucagaccaguuaaggagaaggaggagaaccuaguuaggucaauggucucugcagggucaggagaaguagacaguuuuucauuaggaauacuaugcguaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaagauggggaugggaacaacguaccuagccuugauggcuacuuucaaaaugagaccaauguucgcuguugggcuauuauuucgcagacuaacauccagagaaguucuucuucucacgauuggauuaagccugguggcauccguggagcuaccaaauucuuuggaggagcuaggggauggacuugcaauggguaucaugauguuaaaauuauugacugaauuucagccacaccaguuauggaccaccuuacuuucucugacauuuaucaaaacaacucuuucauuggauuacgcauggaagacaacggcuacgguacugucaaucguaucucucuuuccuuuaugccugucuacgaccucucaaaaaacaacauggcuuccggugcuguuaggaucuuuuggaugcaaaccauuaaccauguuucucauaacagaaaacgaaaucuggggaagaaaaaguuggccccucaaugaaggaauuauggcuauuggaauagucagcauucuacuaaguucacuccucaaaaaugaugugccguuggccggcccacuaauagcuggaggcaugcuaauagcguguuaugucauauccggaagcucagccgaucuaucauuggagaaagcggcugagguauccugggaagaagaagcagaacacuccgguaccucacacaacauauuaguagagguucaagaugauggaacuaugaaaauaaaagaugaagagagggaugacacacucacuauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcgguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggacuugaucucauauggaggagguuggagguuucaaggaucauggaacacgggagaagaagugcaggugauagcuguugaaccaggaaaaaaccccaaaaauguacagacaacgccggguaccuucaagacuccugaaggcgaaguuggagccauagcucuagauuuuaaacccggcacaucuggaucucccaucgugaacagagagggaaaaauaguaggucuuuauggaaauggaguggugacaacaaguggaaccuacgucagugccauagcccaagcuaaagcaucacaggaagggccucuaccagagauugaggacgagguguuuaagaaaagaaacuuaacaauaauggaccuccauccaggaucaggaaaaacaagaagauaucuuccagccauaguccgugaggccauaaaaaggaaacugcguacguuaaucuuggcucccacaagaguugucgccucugaaauggcagaggcgcucaagggaaugccaauaagauaucagacaacagcagugaagagugagcacacaggaagggagauaguugaccucaugugccacgccacuuuuaccaugcgucucuuauccccagugagaguucccaauuacaacaugauuauuauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaauucaggcuacgacuggaucacugauuuuccagguaaaacagucugguuuguuccaagcauuaaaucaggaaaugacauugccaacugcuuaagaaagaacggaaaacggguaauccaauugagcaggaaaaccuuugacacugaguaccagaaaacaaaaaacaaugacugggacuauguugucacaacagacauuucugaaaugggggcaaauuuccgggcugacaggguaauagacccaaggcgguguuugaaaccgguaauacuaaaagaugguccagagcguguuauucuagccggaccgaugccagugacuguggccagugcugcccaaaggagaggaagaauuggaaggaaccagaacaaggaaggugaucaguauguuuacaugggacagccuuuaaauaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuauccuacaaaguugccucagaagguuuccaguacuccgacagaagguggugcuuugauggagaaaggaacaaccagguguuggaggagaacauggacguggagaucuggacaaaggaaggagaaagaaagaaauugcgaccccgcugguuggaugccagaacauacucugauccacuggcccugcgcgaguuuaaagaguuugcagcaggaagaagaagugucucaagugaccuaauauuggaaauagggaaacuuccacaacauuugacgcuaagagcccagaaugcucuggauaacuuggucauguugcauaauuccgaacaaggaggaaaagccuauagacaugcuauggaggaacuaccagacaccauagaaacauugaugcuccuagcuuugauagcuguguugacugguggagugacgcuguucuuccuaucaggaaaaggucuagggaaaacauccauuggcuugcucugugugacggccucaagcgcacuguuauggauggccaguguggagccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagacuuacauccagcuucagccuggacucucuaugcaguagccacaacagucaucacucccaugaugagacacacaauugaaaauacaacggcaaacauuucccugacagccauugcaaaucaggcagcuauauugaugggacuugacaagggauggccaauaucgaagauggaccuaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaaucuaucacacuggcuacuggaccccugaccacucuuugggagggaucuccaggaaaauucuggaauaccacgauagcaguguccauggcaaacaucuucaggggaaguuaucuagcaggagcaggucuggccuucucauuaaugaaaucuuuaggaggagguaggagagguacgggagcucaaggggaaacauugggagagaaauggaaaagacaguuaaaccaacugagcaagucagaauucaacaccuacaaaaggagugggauuauggagguggacagaucugaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaacccaucccaauggcgaccuauggauggaaccuagugaagcugcacucuggaaaagauguauuuuuuauaccaccugagaaaugugacacccuucugugugauauuggugaguccucuccaaauccaacuauagaagaagguagaacgcuacguguucuaaagaugguggaaccauggcucagaggcaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucaugugggacaggaaacauugugucggcagugaacaugacauccagaauguugcugaaucgauucacaauggcucauaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaagacaauccauacaaaacaugggccuaucauggaucauaugagguuaagccaucaggaucagccucaucuauggugaauggaguggugagauugcucacaaaaccaugggauguuauccccauggucacacaaauagcuaugacugauaccacacccuuuggacaacagagaguguuuaaagagaagguugacacgcgcacaccaagagcaaaacgaggcacagcacaaauuauggaagugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaggcccuugguuucaugaaugaagaucacugguuuaguagagagaauucacucaguggaguggaaggagaaggacugcacaaacuuggauacauacucagagacauaucaaagauuccggggggaaauauguaugcagaugauacagccggaugggacacaagaauaacagaggaugaucuucagaaugaggcuaaaaucacugacaucauggagccugaacaugcucuauuggcuacgucaauuuuuaagcugaccuaccaaaacaagguggugagggugcaaagaccagcaaaaaauggaaccgugauggauguuauauccagacgugaccagagaggaaguggacaggucggaacuuauggcuuaaauacuuucacuaauauggagguccaacuaauaagacaaauggagucugaaggaaucuuuuuucccagcgaauuggaaagccccaaucuagcugaaagaguucuugacugguuggaaaaacauggcgccgaaaggcugaaaagaauggcaaucagcggagaugauuguguagugaaaccaauugaugacagauucgcaacagccuuaauagcucugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugucgcaaccaagaugaacuugugggcagggcuagaguaucacaaggcgccggauggagccugagagaaacugcuugccuaggcaagucauaugcacaaauguggcagcugauguacuuccacaggagagaccugagacuagcggcuaaugcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccaccaacauacaaguagccauaaaccaagugagaaggcucaucgggaaugagaauuaucuagauuacaugacaucaaugaagagauucaagaaugagagugaucccgaaggggcacucugguga

SEQ ID NO: 6358 - RNA, 9879 nt, Artificial Sequence
  derived and/or modified CDS sequence (wt) from DENV-1__EU280167__SS-prME
ucugugaccaugcuccuuacgcugaugccuacagccuuggcguuccauuugacuacacgagggggagagccgcacaugauagucagcaagcaggaaagaggaaagucacuuuuguucaagaccucagcaggugucaacaugugcacccuuauagcgauggauuugggagaguuaugugaggacacagugacuuacaaaugcccucgaaucacugaggcggaaccagaugacguugauuguuggugcaaugccacagacacaugggugaccuauggaacauguucccaaacuggcgagcaccgacgagacauacguuccgucgcacuggccccacacgugggacuugguuuggaaacaagaacugaaacguggauguccucugaaggcgcuuggaaacagauacaaagaguggauacuuguguccugagacacccaggauucacggugauagcccuuuuucuagcacaugccauaggaacauccaucagccagaaagggauuauuuucauuuuguuaaugcugguaacaccauccaugaccaugcgaugcgugggaauaggcagcagggacuucguggaaggacugucaggagcaacuuggguagaugugguacuggaacauggaaguugugucaccagcauggcaaaagacaaaccaacacuggacauugaacuguugaagacggaagucccaaacccugccguccugcgcaaacugugcauugaagcuaaaauaucaaacaccaccacugacucaagauguccaacacaaggagaagccacacugguggaagaacaagacgcgaacuuugugugucgacgaacguuuguggacagaggcuggggcaauggcugugggcucuucggaaaaggaagccuacuaacgugugauaaguucaagugugugacaaaacuggaaggaaagauaauucaauaugaaaacuuuaaauauucaguaauagucaccguccacacuggagaccagcaucaggugggaaaugaaagcacagaacaugggacaacugcaacuauaacaccucaagcuccuacgacggaaauacagcugaccgacuacggagcucuuacauuggauuguucaccuagaacaggauuagacuuuaaugaaaugguguuguugacaaugaaagaaaaaucauggcuaguccacaaacaaugguuucuagacuuaccacugccuuggaccucgggagcuucaacaucacgagagaccuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaauggaagauugauaacagccaaccccauagucacugacaaagaaaaaccagucaacauugaggcagaaccgccuuuuggugagaguuacaucgugauaggaguaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacaugguuaggauuaaacucaaggagcacgucccucucgaugacgugcauugcaguuggccuaguaacacuauaccuaggagucaugguucaggcggauucaggaugcguaauuaauuggaaggguagaggacucaaauguggaaguggcauuuuugucaccaaugaaguucacacuuggacagggcaauacaaauuucaagcugacuccccaaaaggacuaucagcagccaucgggaaggcaugggaggaggguguguguggaauucgaucagcaacucgucucgagaacaucauguggaagcaaauaucaaaugaacugaaccacaucuuacuugaaaaugacaugaaauucacagugguuguaggagauguugcugggaucuuggcucaaggaaaaaaaaugauuaggccacaacccauggaacacaaauacucguggaaaaauuggggaaaggcuaaaaucauaggggcagauguacagaacuccaccuucaucauugacggcccaaacaccccagaaugcucugaugaccaaagagcauggaacauuugggaaguugaggacuauggauuuggaauuuucacgacaaacauauggcugaaauugcgugacuccuacacccaagugugugaccaccggcuaaugucagcagccaucaaggacagcaaggcaguucacgcugacaugggguacuggauagaaagugaaaagaacgagaccuggaagcuggcaagagccucuuucauagaaguuaaaacauguauuuggccaaaaucccacacucuauggagcaauggaguucuggaaagugaaaugauaauuccaaagaucuauggaggaccaauaucucagcauaacuacagaccaggauauuucacacaaacggcagggccguggcaccuaggcaaguuggaauuggauuuugauuugugugaggguaccacagucguuguggaugaacauuguggaaaucgaggaccaucucuugggaccacaacagucacaggaaagauaauucaugaaugguguugcagaucuuguacgcuaccacccuuacguuucagaggagaagaugggugcugguacgguauggaaaucagacccgucaaggaaaaggaagagaaucuagucaaaucaauggucucugcagggucaggggaaguggacagcuuuucacugggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgcuuccgacagaauggggaugggaacgacguaccuagcucugauggccacuuuuaaaaugagaccaauguuugcuguagggcuauuauuccgcagacuaacauccagagaaguucuucuucuaaccauuggauugagucuaguggcaucuguggaguuaccaaauuccuuggaggagcugggggauggacuugcaaugggcauuaugauuuuaaaauuauugacugacuuucgaucacaucaguugugggcuaccuugcuguccaugacauuuaucaaaacagcguuuuccuugcacuaugcauggaagacaauggcuaugguacugucaauuguaucucucuuccccuuaugccuguacacgaccucccagaaaacaacauggcuuccggugcuauugggaucucuuggaugcaaaccacuaaccauguuccuuauagcagaaaacaaaaucuggggaaggaaaagcuggccccucaaugaagggaucauggcuguuggaauagucagcauccuacuaaguucacuccucaaaaaugaugugccgcuagcugggccacuaauagcuggagguaugcuaauagcauguuauguuauaucuggaagcucagccgaccuaucacuagagaaagcagcugaggucuccugggaagaagaagcagaacacucuggugccucacacaacauauuaguggagguucaagacgauggaaccaugaagauaaaggaugaagagagagaugacacgcuaaccauucuccuuaaagcaacucugcuagcaguuucagggguguacccauuaucaauaccagcgacccuuuuuguguggugcuuuuggcagaaaaagaaacagagaucuggaguguuaugggacacaccuagcccuccaaaaguggaaagagcaguucuugaugaugguaucuauagaauuaugcagagaggacuguugggcaggucccaaguagggguaggaguuuuucaagaaaacguguuccauacaauguggcaugucaccaggggagcuguacucauguaucaagggaagagacuggaaccgagcugggccagugucaaaaaagaccugaucucauauggaggagguuggaggcuucaaggauccuggaacacgggagaagaagugcaggugauugcuguugaaccagggaaaaaccccaaaaauguacaaacggcgccgggcaccuuuaagaccccugaaggugaaguuggagccauugcccuagauuuuaaacccgguacaucuggaucccccaucgugaacagagaagggaaaauaguaggucuuuauggaaauggaguagugacaacaaguggaaccuacgucagugccauagcucaagccaaagcaucacaagaagggccccuaccagagauugaagacgaaguguucaggaaaagaaacuuaacaauaauggaccuacauccaggaucggggaaaacaagaagauaucuuccagccauaguccgugaggccauaaaaaggaagaugcgcacacuaauucuggcucccacaaggguugucgcuuccgaaauggcagaagcacucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagccacucccccaggaucaguggaggccuuuccacagaguaacgcagucauccaagaugaggaaagagacauuccugagagaucauggaacucaggcuaugaguggaucacugacuucccagguaaaacagucugguuuguuccaagcauuaaagcaggaaaugacauuaccaacugcuuaagaaagaauggaaaacgagugauucaauugagcaggaagaccuuugauacagaguaccaaaaaacaaaaaauaacgacugggacuacgucgucacaacagacaucuccgaaaugggagcaaacuuccgggccgacagggugauggacccaagacggugucugaaaccgguaauacuaaaagaugguccagagcgcgucauuuuagcaggaccgaugccagugacuguggccagugccgcccagaggagaggaagaauuggaaggaaccacaauaaggaaggugaucaguacaucuacaugggacagccuuuaaccaacgaugaagaucacgcucacuggacugaagcaaaaaugcuccuugauaauauaaacacaccagaagggauuaucccagcccucuucgagccggagagagaaaagagugcagcaauagacggggaauacagacugcggggugaagcaaggaaaacguuuguggagcucaugagaagaggagaucuaccugucuggcuaucccacaaaguugccucagaaggcuuccaguacucugacagaagauggugcuuugacggggaaaggaacaaccagguguuggaggagaacauggacguggagauuuggacaaaagaaggagaaagaaagaagcuacgcccccgcuggcuggaugccagaacauacucagacccacuggcccugcgcgaguuuaaagaguuugcagcaggaagaagaagcgucucaggugaucuaauacuagaaauagggaaacuuccacaacacuugacgcaaagggcccagaaugccuuggacaaccuggucauguugcacaacuccgaacaaggaggaagagccuauagacaugcaauggaagaacugccagauaccauagaaacguugaugcuccuagcuuugauagccguguuaacugguggagugacgcuguucuuccuaucaggaaagggccuagggaaaacaucuaucgggcuacucugcgugauggcuucaagcguacugcuauggauggccaguguggagccccauuggauagcggccuccaucauauuggaguucuuccugaugguguugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacccccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaacccacugacgcugacagcggcgguguugaugcuaguggcucauuacgccauaauuggaccuggacugcaagcaaaagcuacuagagaagcucaaaaaaggacagcggccggaauaaugaaaaauccaaccauugauggaauuguugcaauagauuuggacccugugguuuaugaugcaaaauuugagaaacaacuaggccaaauaaugcuguugauacuaugcacaucacagauccucuugaugcggacuacaugggccuugugcgaauccaucacacuggccacuggaccucugaccacacuuugggaaggaucuccaggaaaauuuuggaacaccacgauagcgguuuccauggcaaacauuuucagaggaaguuaucuagcaggagcaggucuggcuuucucauuaaugaaaucucuaggaggagguaggagaggcacgggagcccaaggggaaacacugggagagaaauggaaaagacagcugaaccaacugagcaagucagaauucaacaccuauaaaaggagugggauuauggaaguggacagauccgaagccaaagagggacugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauuuuuuauaccaccugagaaaugugauacccuuuugugugauauuggugaguccucuccaaacccaacuauagaggaaggaagaacgcuacgcguucuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacgggaaacauugugucagcaguaaacaugacauccagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggauguuauccccauggucacacaaauagccaugacugacacuacacccuuuggacaacagaggguguuuaaagagaaaguugacacacgcacaccaaaagcaaaacgaggcacagcacaaaucaugguagugacggccaggugguuauggaguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugaccgguucugggaccuugugcacagagagagggagcuucacaaacagggaaaaugugccacguguguuuacaacacgauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuucacaaacuuggauauauacucagagacauaucaaagauuccagggggaaacauguaugcagaugacacagccggaugggauacaaggauaacagagggugaccuccagaaugaggccaaaauuacugacaucauggaacccgaacaugcccuacuggcuaagucaaucuucaagcuaaccuaccaaaauaaggugguaaggguacagagaccagcaaaaaauggaaccgugauggaugucauauccagacgugaccagagaggaaguggccagguuggaacuuauggcuuaaacacuuucaccaacauggaagcccagcugauaagacaaauggagucugagggaaucuuuucacccaacgaauuagagaccccaaauuuagccgagagaguucucgacuggcuggaaaaauauggcgucgaaaggcugaaaagaauggcaaucagcggagaugacugcguagugaaaccaauugaugauagguuugcgacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggguggagccugagagaaacugcaugccuaggcaagucauaugcacaaauguggcagcugauguacuuccacaggagagaccugagacuagccgcuaaugcuaucuguucagccguuccaguugauuggguuccaacuagccgcaccacuuggucgauccaugcccaucaccaauggaugacaacagaagacaugcugucaguauggaauaggguuuggauagaggaaaacccauggauggaggacaaaacccguauauccaguugggaagauguuccauaccuaggggaaagggaagaucaaugguguggaucucugauaggcuuaacagcaagggccaccugggccaccaacguacaaguggccauaaaccaagugagaagacuaauugggaaugagaauuauucggauuacaugacaucaaugaagagauucaagaacaagagugaacccgaaggggcacucugguga

SEQ ID NO: 6359 - RNA, 9876 nt, Artificial Sequence
  derived and/or modified CDS sequence (wt) from DENV-2__AJ968413__SS-prME
acugcaggcaugaucauuaugcugauuccaacagugauggcguuccauuuaaccacacguaacggagaaccacacaugaucgucaguagacaagagaaagggaaaagucuccuguuuaaaacagaggauggugugaacauguguacccucauggccauggaccuuggugaauugugugaagauacaaucacguauaaguguccucuucucaggcagaaugaaccagaagacauagauuguugguguaacucuacguccacauggguaaccuaugggacguguaccaccacaggagaacacagaagagagaaaagaucaguggcacuagucccacaugugggaaugggauuggagacacgaacugaaacauggaugucaucagaaggggccuggaaacaugcccagagaauugaaacuuggauuuugcgacauccaggcuuuaccuuaauggcagcaauccuggcauacaccauaggaacgacacauuuccaaagagcucugaucuucaucuuacugacagccgucgcuccuucaaugacaaugcguugcauaggaauaucaaacagagauuuuguagaagggguuucaggaggaagcuggguugacauagucuuagaacauggaagcugugugacgacaauggccaaaaacaaaccaacauuggauuuugaacugauaaaaacagaagccaaacaacuugccacucuaaggaaguacuguauagaggcaaaguuaaccaacacaacaacagaaucucgcuguccaacacaaggggaacccagccuaaaugaagagcaggacaaaagguucgucugcaaacacuccaugguagacagaggauggggaaauggauguggacuauuuggaaaaggaggcauugugaccugugcuauguucacaugcaaaaagaacauggaaggaaaaauugugcaaccagaaaacuuggaauauaccaucgugauaacaccccacucaggggaagagcacgcaguuggaaaugacacaggaaaacauggcaaggaaaucaaaauaacaccacagaguuccaucacagaagcagaguugacaggcuauggcacugucacgauggagugcucuccgagaacgggccucgacuucaacgagaugguguuguugcaaauggaaaauaaagcuuggcuggugcaccggcaaugguuccuagaccugccguugccaugguugcccggagcggacacacaaggaucaaauuggauacagaaggagacauuggucacuuucaaaaauccccaugcgaagaaacaagauguuguuguuuuaggaucccaagaaggggcuaugcacacagcacucacaggggccacagaaauccagaugucaucagggaacuuacuguucacaggacaucucaagugcaggcugaggauggacaaacuacagcucaaaggaaugucauacuccaugugcacaggaaaguuuaaaguugugaaggaaauagcagaaacacaacauggaacaauaguugucagaguacaauaugaaggggacgguucuccauguaagauucccuuugagauaauggauuuggaaaaaagacaugucuugggucgccugauuacagucaacccaauugugacagaaaaggauagcccagucaacauagaagcagaaccuccauucggagacagcuacgucaucauaggaguagagccggggcaauugaagcuuaauugguuuaagaaaggaaguucuaucggccaaauguuugagacaacaaugaggggagcgaagagaauggcuauucuaggugacacagcuugggauuuuggaucccugggaggaguguucacaucuauaggaaaggcucuccaccagguuuuuggagcaaucuacggggcugccuucaguggggucucguggacuaugaaaauccucauaggagucauuauuacauggauaggaaugaauucacguagcaccucacugucuguaucacuaguauuggugggagucgugacacuguacuugggagucguggugcaggccgauagugguugcguugugagcuggaaaaacaaagaacugaaauguggcagugggauuuucaucacagacaaugugcacacauggacagaacaauacaaguuccaaccagaauccccuucaaaacuagcuucagcuauccagaaagcucaucaagagggcauuuguggaauccgcucaguaacaagacuggaaaauuugauguggaaacaaauaacaccggaauugaaucacauucuaucagaaaaugaggugaagcugacuauuaugacaggagacaucaaaggaaucaugcaugcaggaaaacgaucucugcggccucagcccacugagcugagguauucauggaagacauggggcaaagcgaaaauccucucuacagagucccauaaccagaccuuucucauugauggccccgaaacagcagaaugccccaacacaaacagagcuuggaauucgcuggaaguugaagacuaugguuuuggaguauucaccaccaauauauggcuaaagcugagagaaaagcaagauguauuuugcgacucaaaacucaugucagcggccauaaaagacaacagagccguccaugccgacauggguuauuggauagaaagugcacucaaugacacauggaagauagagaaagccucuuucaucgaaguuaaaagcugccacuggccaaagucacacacccucuggagcaauggagugcuagaaagugagaugauaauuccaaagaauuuugcuggaccagugucacaacacaauuacagaccaggcuaccauacacaaacagcaggaccauggcauuuagguaagcuugagauggacuuugauuucugcgaaggaacuacagugguggugacugaggacuguggaaauagaggacccuccuuaagaacaaccacugccucuggaaaacucauaacagaauggugcugcagaucuugcacauuaccaccacuaagauacagaggugaggauggaugcugguacgggauggaaaucagaccauugaaagagaaagaagagaauuuggucaacuccuuggucacagccggacaugggcagauugacaacuucucacuaggagucuugggaauggcauuguuccuggaagaaaugcucaggacccgaguaggaacgaaacaugcaacacuacuaguugcaguuucuuuugugacauuaaucacagggaacauguccuuuagagaccugggaagagugaugguuauggugggcgcuacuaugacggaugacauagguaugggcgugacuuaucuugcccuacuagcagccuucaaagucagaccaacuuuugcagcuggacuacucuugagaaaguugaccucuaaggaauugaugaugacuaccauaggagucguacuccucucccagagcaccauaccagagaccauucuugaacugacugaugcguuagccuugggcaugaugguccucaaaauagugagaaaaauggaaagguaucaauuggcagugacuaucacggcuaucuugugcgucccaaaugcagugauauuacaaaacgcauggaaagugagcugcacaauauuggcagugguguccguuuccccacugcucuuaacauccucacagcaaaaagcggauuggauaccauuagcauugacgauuaaaggucucaauccaacagcuauauuucuaacaacccuuucacgaacuagcaagaaaaggagcuggccacuaaaugaggcuaucauggcagucgggauggugagcauuuuagccaguucacuucuaaagaaugacauucccaugacaggaccacuaguggcuggagggcuccucacuguaugcuacgugcucacuggacgaucggccgauuuggaauuggagaaagcugccgacgucagaugggaagaucaggcagagauaucaggaagcaguccaauucugucaauaacaauaucagaagaugguagcaugucaauaaaaaacgaagaggaagaacaaacacugaccauacuuauuagaacaggauugcuggugaucucaggacuuuuuccuguaucaauaccaaucacggcagcagcaugguaccugugggaagugaagaaacaacgggcuggaguauugugggaugucccuucacccccaccugugggaaaggcugaacuggaagauggagccuauagaaucaagcaaaaagggauucuuggauauucccagaucggagccggaguuuacaaagaaggaacauuccauacaauguggcaugucacacguggcgccguucuaaugcauaaaggaaagaggauugagccaucaugggcggacguuaaaaaagaccuaauaucauauggaggaggcuggaaacuagaaggagaauggaaggaaggagaagaaguccaggucuuggcauuggagccuggaaaaaauccaagagccguccaaacaaaaccuggucuuuucaaaaccaauaccggaacuauaggugccguaucucuggacuuuucuccuggaacgucaggaucaccaaucauugacaaaaaaggaaagguggugggucuuuaugguaacggcguuguuacaaggaauggagcauaugugagugcuauagcccagacggaaaaaagcauugaagacaauccagagauugaagaugacauuuuucgaaagaaaagauugaccauuauggaccuccacccaggagcaggaaagacgaaaagauaccuuccggccauagucagagaggcuauaaaacggggccugaggacauuaauucuggcccccacuagagucguggcagcugaaauggaggaagcucuuaggggacuuccaauaagauaccaaaccccagccaucagagccgagcacaccgggcgagagauuguggaccuaaugugucaugccacauucacuaugaggcugcuaucgccaguuagaguaccaaauuacaaccugauuaucauggacgaagcccauuucacagacccagcaaguauagcggccagaggauacauuucaacucgaguggaaaugggugaggcagcugggauuuucaugacagccacuccuccggggagcagagacccauuuccccagagcaaugcaccaaucauggaugaagaaagagaaaucccugaacguucguggaauuccggacaugaauggguuacggauuuuaaagggaagacugucugguucguuccaaguauaaaagcaggaaaugacauagcagcuugccugagaaaaaauggaaagaaagugauacaacucagcaggaaaaccuuugauucugaguaugucaagacuagaaccaaugauugggacuuugugguuacaacugacauuucagaaaugggugccaacuucaaggcugagaggguuauagaucccagacgcugcaugaaaccagucauacuaacagauggugaagagcgggugauccuagcaggacccaugccagugacccacucuagugcagcacaaagaagagggagaauaggaagaaauccaaaaaaugaaaacgaccaguacauauacaugggggaaccucuggaaaaugacgaagacugugcacauuggaaagaagcuaaaaugcuccuagauaacaucaauacaccugaaggaaucauuccuagcauguucgaaccagagcgcgaaaagguggaugccauugauggugaauaccgcuugagaggagaagcacggaaaaccuuuguagaccuaaugagaagaggagaccuaccagucugguuagccuacaagguggcagcugaaggcaucaacuacgcagacagaaggugguguuuugauggaaucaggaacaaccaaaucuuggaagaaaauguggaaguggaaaucuggacaaaagaaggggaaaggaagaaauuaaaacccagaugguuggacgccaggaucuauucugacccacuagcgcuaaaagaauucaaggaauuugcagcuggaagaaaguccuugacccugaaccuaaucacagaaaugggaaggcuuccaacuuucaugacucagaaggcaagagacgcauuggacaaccuggcagugcugcacacggcugaagcagguggaagggcguacaaucaugcucucagugaacugccggagacccuggagacauuacuuuuacugacacuccuggcuacagucacgggaggaaucuuuuuguucuugaugagcggaagagguauagggaagaugaccuuaggaaugugcugcauaaucacggccaguauucuucuaugguacgcacaaauacagccacacuggauagcagcuucaauaauauuggaauuuuuucucauaguucugcuuauuccagaaccagaaaagcagagaacaccccaagauaaccaauugaccuacguugucauagccauccucacagugguggccgcaaccauggcaaacgagauggguuuccuggaaaaaacgaagaaagaucucggauuaggaagcauuacaacccagcaacccgagagcaacauccuggacauagaucuacguccugcaucagcauggacgcuguaugccguggccacaacauucgucacaccaauguugagacauagcauugaaaauuccucagugaacgugucccuaacagcuauugccaaccaagccacaguguuaaugggccuugggaaaggauggccacugucaaagauggacaucggaguuccccuucucgccauuggaugcuacucacaaguuaaccccauaacacucacagcagcucuucucuuauugguagcacauuaugcuaucauagggccaggacuccaagcaaaagcaacuagagaagcucagaaaagagcagcagcgggcaucaugaaaaacccaacugucgauggaauaacaguaauugaccuagauccaauacccuaugauccaaaguuugaaaagcaguugggacaaguaaugcuccuaguccucugugugacucaaguauugaugaugaggacuacaugggcucugugugaggcuuuaaccuuagcgaccgggcccauuuccacauugugggaaggaaauccagggagguuuuggaacacuaccauugcagugucaauggcuaacauuuuuagaggaaguuacuuggcuggagcuggacuucucuuuucuaucaugaagaacacaaccaauacaagaaggggaacuggcaacauaggagagacgcuuggagagaaauggaaaaaccgguugaacgcauuggggaaaagugaauuccagaucuacaagaaaaguggaauccaggaaguagauagaaccuuagcaaaagaaggcauuaaaagaggagaaacggaccaucacgcugugucgcgaggcucagcaaaacugagaugguucgucgagagaaauauggucacaccagaagggaaaguaguggaccuugguugcggcagaggaggcuggucauacuauugugggggacuaaagaauguaagagaagucaaaggccugacaaaaggaggaccagggcacgaagaacccaucccuaugucaacauauggauggaaucuagugcgucuucaaaguggaguugauguuuucuuuacuccgccagaaaagugcgacacauugcugugugacauaggggagucgucaccaaaucccacgguagaagcaggacgaacacucagaguccucaacuuaguggaaaauugguugaacaacaacauccaauuuugcauaaagguucucaacccauacaugcccucagucauagaaaaaauggaagcacuacaaaggaaauauggaggagccuuagugagaaauccacucucacgaaacucuacacaugagauguacuggguauccaaugccucugggaacauagugucaucagugaacaugauuucaaggauguugaucaauagauucacaaugaaacacaagaaagccacuuacgagccagauguugaccuaggaagcggaacccgcaacaucggaauugaaagugagguaccaaaccuggacauaauugggaaaagaauagaaaaaauaaaacaagagcaugaaacaucauggcacuaugaccaagaccacccauacaaaacaugggcuuaccaugguagcuaugaaacaaaacaaacuggaucagcaucauccauggugaacggaguggucagacugcugacaaaaccuugggacgucguccccauggugacacagauggcaaugacagauacgacuccauuuggacaacagcgcguuuuuaaagagaaaguggacacgagaacccaagaaccgaaagaaggcacaaagaaauuaaugaaaaucacggcagaauggcuuuggaaagaacuagggaagaaaaagacaccuaggaugugcacuagagaagaauucacaagaaaggugagaagcaaugcagccuugggggccauauucacugaugagaacaaguggaagucggcacgugaggcuguugaagauaguagguuuugggggcugguugacaaggaaaggaaucuccaucuugaaggaaagugugaaacauguguguacaacaugauggggaaaagagagaagaagcuaggggaguucggcaaggcaaaaggcagcagagccauaugguauauguggcuuggagcacgcuuuuuagaguuugaagcccuaggauucuugaaugaagaucacugguucuccagagagaacucccugaguggaguggaaggagaagggcugcacaagcuaggcuacauuuuaagagacgugagcaagaaagagggaggagcaauguaugcugaugacaccgcaggaugggacacaagaaucacacuggaagauuuaaaaaaugaagaaaugguaacaaaccacauggaaggagaacacaagaaacuagccgaggcuauuuucaaauuaacauaccaaaacaagguggugcgugugcaaagaccaacaccaaggggcacaguaauggauaucauaucgagaagagaccaaagagguagcggacaaguugguaccuauggacucaauacuuucaccaauauggaagcccaacuaaucagacagauggaaggagaaggagucuucaaaagcauucagcaccugacggucacagaagaaaucgccgugcaaaacuggcuagcaagaguagggcgcgaaagguuaucaagaauggccaucaguggagaugauuguguugugaaaccuuuagaugacagauucgcaagcgcuuuaacagcucuaaaugacaugggaaaggucaggaaagacauacaacaaugggaaccuucaagaggguggaacgacuggacacaagugcccuucuguucacaucauuuccaugaguuaaucaugaaagacggucgcguacuuguaguuccauguagaaaccaggaugaauuaauugguagagcccgaauuucccagggagcuggauggucuuugagggagacagccuguuuagggaagucuuaugcccaaauguggagcuugauguacuuccacagacgugaccucaggcuggcggcaaaugcuaucugcucggcggucccaucacauuggguuccaacaaguagaacaaccugguccauacacgccaaacaugaauggaugacaacggaagacaugcugacagucuggaacaggguguggauucaagaaaauccauggauggaagacaaaacuccaguggaaucaugggaggagaucccauauuuggggaaaagagaagaccaauggugcggcucacugauugggcuaacaagcagggccaccugggcaaagaacauccaaacagcaauaaaucaaguuagaucccuuauaggcaaugaggaauacacagauuacaugccauccaugaaaagauucagaagagaagaggaagaggcaggaguccugugguag

SEQ ID NO: 6360 - RNA, 9876 nt, Artificial Sequence
  derived and/or modified CDS sequence (wt) from DENV-2__AB543624__SS-prME
ucugcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagauauagacugcuggugcaacuccacguccacguggguaaccuaugggaccuguaccacuacgggagaacauaggagagaaaaaagaucaguggcacucguuccacaugugggaaugggacuggagacgcgaacugaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauccuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacauuggauuucgaacugauaaaaacggaagccaaacagccugccacccuaaggaaguacugcauagaagcaaaacuaaccaacacaacaacagaaucccguugcccaacacaaggggaacccagccugaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaagagcaugcggucggaaaugacacaggaaaacacggcaaggaaaucaaaguaacaccacagaguuccaucacagaagcagaauugauagguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggauccccagaaggggcuaugcauacagcacucacaggagccacagaaauccaaaugucgucaggaaacuugcucuucacuggacaucucaagugcaggcugagaauggacaagcuacagcucaaaggaaugucauacucuaugugcacaggaaaguuuaaaguugugaaggaaauagcagaaacacaacauggaacgauaguuaucagagugcaauaugaaggggacggcucuccaugcaaaaucccuuucgagauaauggauuuggaaaaaagauaugucuuaggccgccugaucacagucaacccaauuguaacagaaaaagauaacccagucaacauagaagcagaaccuccauucggagacaguuacaucaucauaggaguagagccgggacaacugaagcucaacugguucaagaaaggaaguucuaucggccaaauguuugagacaacgaugagaggggcgaagagaauggccauuuugggugacacagccugggacuucggaucccugggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaggaagagggaauuugugggauccgcucgguaacaagauuggagaaccuaauguggaaacaaauagcaccagaauugaaucacauucuagcagaaaaugaggugaaguuaacuaucaugacaggagacaucaaaggaaucaugcaggcaggaaaacgaucuuugcggccucagcccacugagcuaaaguauucauggaaaacaugggguaaagcaaaaaugcucuccacagagucuuauaaccaaaccuuucucauugauggccccgagacggcagagugccccaacacaaauagagcuuggaacucguuggagguugaagacuacggcuuuggaguguucacuaccaauauauggcuaaaauugaaagaaagacaggaugcauucugcgacucaaaacucaugucagcggccauaaaagacaacagagccguccaugccgacauggguuacuggauagaaagugcacucaaugacacauggaagauagagaaagccucuuucauugaaguaaaaaacugccacuggccaaaaucacacacccucuggagcaauggagugcuagaaagugagaugauaauuccaaagaaucucgcuggaccagugucucaacacaacuauagaccaggcuaccauacacaaauagcaggaccauggcaccuaggcaagcuugagauggacuuugauuucugcgauggaaccacagugauagugacugaggacugcggaaauagaggacccucuuugagaacaacuacugccuccggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcgccaccauggcggaugacauagguaugggcgugacuuaucuugcccuacuagcagccuucaaaguuagaccaacuuuugcagcuggacuacucuugagaaagcugaccuccaaggaauugaugaugacuaccauaggaauuguacuccucucccaaagcaccauaccagagaccguucuugaauugacugaugcguuagccuuaggcaugaugguccuuaaaauaguaagaaacauggaaaaguaucaauuggcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaacuaacaagaaaagaagcuggccacuaaaugaggcuaucauggcagucggaauggugagcauuuuagccaguucccuccuaaaaaaugauauucccaugacaggaccacuaguggcuggaggacuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauccuuggauacucucagaucggagcuggaguuuacaaagaaggaacauuucauacaauguggcaugucacacguggcgcuguucuaaugcauaaaggaaagaggauugaacccucaugggcggacgucaaaaaagaucuaauaucauauggaggaggauggaaguuagaaggagaauggaaggaaggagaagaaguccaggugcuggcacuggagccgggaaaaaauccaagagccguccaaacaaaaccuggccuuuucaaaaccaacaacggaacaauaggugccguaucuuuggacuucuccccuggaacgucaggaucuccaaucauugacaaaaaaggaaaaguugugggucuuuaugguaauggaguugucacgaggaguggagcauaugugagugccauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuacaacuugauuaucauggacgaagcccauuucacagacccagcaaguauagcagcuagaggauacaucucaacccgaguggagaugggugaggcagcugggauuuucaugacagccacucccccaggaaguagagauccauuuccccagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacucaguaggaagacuuuugauucugaguaugucaagacaagaaccaaugauugggauuucgugguuacaacugacauuucagaaaugggugccaauuucaaagcugagaggguuauagaccccagacgcugcaugaaaccagucauacuaacagauggugaggagcgggugauucuggcaggacccaugccagugacccacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgggaaaaaguggaugccauugauggcgaauaccguuugagaggagaagcaaggaaaaccuuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaauucaaagaauuugcagccggaagaaagucucugacccugaaccuaaucacagaaaugggcaggcuuccaacauucaugacucagaagacaagagacgcacuggacaaccuagcagugcugcacacggcugaagcagguggaagggcguacaaucaugcucucagugaacugccggagacccuagagacacugcuuuuacugacacuucuggcuacagucacaggagggaucuuuuuauucuugaugagugggaggggcauagggaagaugacccugggaaugugcugcauaauuacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccuuacagugguggccgcaaccauggcaaacgagauggguuuccuagaaaaaacgaagaaagaucuuggauuaggaagcauugcaacccagcaccccgagagcaacauccuggacauagaucuacgucccgcaucagcuuggacgcuguaugccguggcuacaacauucauuacaccaaugcugagacauagcauugagaauuccucagugaauguaucccuaacagcuauagccaaccaagcaacaguguuaaugggucuagggaaaggauggccauugucaaagauggacaucggaguuccccuucucgccauuggauguuacucacaagucaaccccauaacucucacagcagcucuucucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucagguauugaugaugaggacuacaugggcucugugugaggccuuaaccuuagcuacggggcccaucuccccacugugggaaggaaauccaggaagguucuggaacacuaccauugcggugucaauggcuaacaucuuuagagggaguuacuuggcuggagcuggacuucucuuuuccauaaugaagaacacaaccaacacaagaaggggaacuggcaacauaggagagacgcuuggagaaaaauggaaaagccgauugaacgcacugggaaaaagugaauuccaaaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuacuguggaggacuaaaaaacguaagagaagugaaaggccuaacaaaaggaggaccaggacacgaagaacccaucccuaugucaacauauggguggaaucuagugcgucuucagaguggaguugacgucuucuucaucccgccagaaaagugugauacauuguugugugacauaggggagucaucaccaaaucccacaguggaagcaggacgaacacucagaguccuuaauuuaguagaaaacugguugaacaaccacacucauuuuugcauaaaaguucucaacccauauaugcccucaguuuuagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacacguaacauuggaauugaaagugaaauaccaaaccuagacauaauugggaaaagaauagaaaaaauaaagcaagagcaugaaacaucauggcacuacgaccaagaccacccauauaaaacgugggcauaccaugguagcuaugaaacaaaacagacuggaucagcaucauccauggucaacggaguggucaggcugcugacaaaacccugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaguucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaaacuaggggaauuuggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggcacaguaauggacaucauaucgagaagagaccaaagagguagugggcaaguugguaccuauggacucaauacuuucaccaauauggaagcccaauuaaucagacagauggagggagaaggagucuuuaaaaacauccagcgccugacagucacagaagaaguugcugugcauaacuggcuggcaagaguggggcgcgaaagguugucaagaauggccaucaguggagaugauuguguugugaaaccuuuagaugacagguucgcaaacgcuuugacagcucuaaaugacaugggaaagauuagaaaagacauacaacaaugggaaccuucaaaaggauggaacgauuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcucaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacaugcugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6361 - RNA, 9876 nt, Artificial Sequence
  derived and/or modified CDS sequence (wt) from DENV-2__AB189122__SS-prME
acugcagguguaauuauuaugaugauuccaacagugauggcauuccauuuaaccacacgcaacggagaaccacacaugaucgucaguagacaagagaaagggaaaagucuucuguuuaaaacagagaacggugugaacauguguacccucauggccauggaccuuggugaauugugugaagacacaaucacuuauaauuguccucuucucaggcagaaugaaccagaagacauagacuguuggugcaacucuacgucuacauggguaacuuaugggacaugcaccgccacaggagaacacagaagggaaaaaagaucaguggcacucgcuccacaugugggaaugggacuggagacacgaacugaaacauggaugucaucagaaggggccuggaaacaugcccagagaauugaaacuugggucuugagacauccaggcuucaccauaauggcagcaauccuggcauauaccauaggaacgacauauuuccaaagaguccugauuuucaucuuacugacagcugucgcuccuucaaugacaaugcgcuguauaggaauaucaaauagagacuuuguggaagggguuucaggaggaagcuggguugacauagucuuagaacauggaagcugugugacgacgauggcgaaaaauaaaccaacauuggauuuugaacugauaaaaacggaagccaaacaucccgccacucuaaggaaguauuguauagaggcaaagcugaccaacacaacuacagcaucucgcugcccaacacaaggagaaccuagccuaaaugaagaacaggacaaaagguuugucugcaaacacuccaugguagacagaggauggggaaauggaugcggauuauuuggaaagggaggcaucgugaccugugcaauguucacaugcaaaaagaacauggaaggaaaagucgugcaaccagaaaacuuggaguacaccauugugauaacaccucacucaggggaagagaaugcagucggaaacgacacaggaaaacacggcaaggaaauuaaaguaacaccacagaguuccauuacagaagcagaacugaccggcuauggcacugucacgauggaaugcucuccgagaacgggccucgacuuuaaugagaugguguugcugcaaauggaaaacaaggcuuggcuggugcacaggcaaugguucuuagaccugccguuaccauggcugcccggagcagacacacaaggaucaaauuggauacagaaggagacauuggucacuuucaaaaauccccaugcgaagaaacaggauguuguuguuuuaggaucccaagaaggggcuaugcauacagcacucacaggggcuacggaaauccagaugucaucaggaaacuuacuguucacaggacaucuuaagugcaggcugagaauggacaaacuacagcucaaaggaaugucauauucuauguguacaggaaaguuuaaaguugugaaggaaauagcagaaacacaacauggaacaauaguuaucagaguacaauaugaaggggacgguucuccgugcaagaucccuuuugaaauaauggauuuggaaaaaagacaugucuuaggucgcuugaucacagucaacccaauuguuacagaaaaagacagcccagucaacauagaagcagagccuccauucggagacagcuacaucauuauaggaguagaaccgggacaacugaagcucaacugguuuaagaaaggaaguucuauuggccaaauguuugagacaacaaugagaggagcgaagagaauggccauuuuaggugacacagcuugggauuuuggaucccugggaggaguguucacaucuauaggaaaggcccuccaccaagucuuuggagcaaucuauggggcugccuucagugggguuucauggacuaugaaaauccucauaggagucgucaucacauggauaggaaugaauucacgcagcaccucacugucugugucacuaguauuagugggggucgugacacuguacuugggagucauggugcaggccgauagugguugcguugugaguuggaaaaacaaagaacugaaaugugguagugggauuuuuaucacagacaacgugcacacauggacagaacaauacaaauuccaaccagaauccccuucaaagcuggcuucagcuauccagaaggcucaugaagagggcauuuguggaauccgcucaguaacaagauuggagaaucugauguggaaacaaauaacaccagaacugaaucacauucuaucagaaaaugagguaaaauugacuaucaugacaggagacauuaaaggaaucaugcaggcaggaaaacgaucccugcggccucaacccacugagcugaaguacucuuggaaagcauggggcaaagcgaaaaugcucuccacagagcuucauaaccacaccuuucucauugauggccccgaaacagcagaaugucccaacacaaacagagcuuggaacucauuagaaguugaagacuauggcuuuggaguauucaccaccaacauauggcugaaacugaaagaaaggcaggauguauuuugugacucaaaacucaugucagcagccauaaaagacaacagggccguccacgccgauauggguuauuggauagaaagcgcacucaaugacacauggaagauugagaaagccucuuuuauugaaguuaaaagcugccacuggccaaagucacacacucucuggaguaauggagugcuagaaagugagaugauaauuccaaagaauuuugcaggaccagugucacaacacaacuacagaccagguuaucauacacaaacggcaggacccuggcaucuagguaagcuugagauggacuuugauuucugcgaaggaaccacagugguagugacugaggacuguggaaauagaggacccucuuuaagaacaacuacugcuucuggaaaacucauaacagaauggugcugccgaucuugcacauuaccaccgcuaagguacagaggugaggauggaugcugguauggaauggaaaucagaccauugaaagagaaagaagagaacuuggucaacucuuuggucacagccggacauggacagauugacaacuucucacuaggagucuugggaauggcauuguuccuggaagaaaugcucaggacccgaguaggaacgaaacaugcaauauuacuaguugcaguuucuuucgugacauugaucacagggaacauguccuuucgagauuuggggagagugaugguuauggugggcgcuacuaugacggaugacauaggcaugggcgugacuuaucuugcccuauuagcagccuucaaagucagaccaacuuuugcagcuggacuacucuugagaaagcugaccuccaaggaauuaaugaugaccaccauaggaaucguacuccucucucagagcaccauaccagagacuauacuugaacugacugacgcgcuagcuuuggggaugaugguucucaaaauagugagaaacauggaaaaguaucaacuagcagugacuaucauggccaucuugugcgucccaaaugcagugauauuacaaaacgcauggaaagugagcugcacaacacuggcagugguguccguuuccccacugcuuuuaacauccucacagcagaaagcggauuggauaccacuggcguugacgaucaaaggccucaauccaacagccauuuucuuaacaacccucucaagaacuagcaagaaaaggagcuggccacuaaaugaggcuauuauggcagucgggauggugagcauuuuagccaguucucucuuaaagaaugauauucccaugacaggaccauuaguagcuggagggcuucucacuguguguuacgugcucacuggaagaucggcugauuuggaacuggagagagcugcugacguaagaugggaagaacaggcagaaauaucaggaaguaguccaauucugucaauaacaauaucggaagaugguaguaugucgauaaaaaaugaagaagaagaacaaacacugaccauacucauuaggacaggacugcuggugauaucaggacuuuuucccgugucaauaccaaucacggcagcugcaugguaccugugggaagugaaaaaacaacgagccggaguauugugggaugucccuucacccccaccugugggaaaggccgaacuggaagauggagccuauagaaucaagcagaaagggauucuaggauacucgcagaucggagucggaguuuacaaagaaggaacauuccacacaauguggcaugucacacguggugcuguccuaaugcauaaagggaagagaauugaaccaucaugggcggacgucaagaaagaccuaauaucguauggaggaggcuggaagcuagaaggagaauggaaggaaggagaagaaguccagguccuggcauuagagccuggaaagaauccaagagccguccaaacaaaacccggucucuucaaaacuaacacuggaaccauaggcgccguaucucuggacuuuucuccuggaaccucaggaucuccaauaguugacaaaaaaggaaaaguugugggccuuuauggcaacggugucgucacaaggaguggaacauaugugagugccauagcccagacugaaaaaaacauugaagacaauccagagauugaagaugacaucuuucgaaagaaaagauuaaccaucauggaccuccacccaggagcgggaaaaacgaagagauaccuuccagcaauagucagagaagccauaaaacgaggcuugaggacacuaauccuggcccccacuagaguuguggcggcugaaauggaagaagcucucagaggacuuccaauaagauaucaaaccccagcuaucagagccgagcacacugggcgggagauuguggaucuaaugugucaugccacauuuaccaugaggcugcugucaccaauuagaguaccaaauuacaaccugaucaucauggaugaagcccauuucacagacccagcaagcauagcagcuagaggauauauuucaacucgaguugagaugggugaagcagcugggauuuucaugacagcuacuccuccuggaagcagagacccauuuccucagagcaaugcaccaaucauggaugaagaaagggaaaucccugagcguucguggaauucuggacaugaguggguuacggauuuuaaagggaagacuguuugguuuguuccaaguauaaaagcaggaaaugauauagcagcuugccugagaaagaauggaaagaaagugauacaacucagcaggaagaccuuugauucugaauauaucaagacuaggaccaaugauugggacuuuguggucacgacagacauuucagaaaugggugcuaacuucaaggcugagaggguuauagaccccaggcgcugcaugaaaccagucauacuaacagacggugaagagcgggugauucuggcaggacccaugccagugacccacucuagugcagcacaaagaagagggagaguaggaagaaauccaaaaaaugaaaaugaccaguacauauacaugggggaaccucuggaaaaugaugaagacugugcacacuggaaagaagcuaagaugcuucuagauaacaucaacacgccugaaggaaucauucccagcauguucgaaccagagcgugaaaagguggaugccauugauggugaauaccgcuuaagaggagaagcgaggaaaacuuuuguggaccuaaugagaagaggagaccuaccagucuggcuagccuacagaguggcagcugaagguaucaacuacgcagacagaagauggugcuuugauggagucaaaaacaaccaaaucuuggaagaaaauguggaaguggaaauuuggacaaaagaaggagaaaggaagaaauuaaaacccagaugguuggaugcuaggaucuacucugacccacuggcgcucaaagaauucaaggaauucgcagcuggaagaaagucccugacccugaaucuaaucacagagauggguaggcucccaaccuucaugacccagaaagcaaggaacgcauuagacaacuuagcaguccugcauacggcugaagcaggcggaagggcguacaaucaugcucuuagugaacugccggagacccuggagacauugcuuuuacugacacucuuggccacagucacgggcggaaucuuccuauucuugaugagcggaaaaggcauagggaagaugacccugggaaugugcugcauaaucacggccaguguucuccuaugguaugcacaaauacagccacacuggauagcagcuucaauaauacuggaguuuuuucucauagucuugcucauuccagaaccagaaaagcagagaacaccccaagauaaccaauuaacuuauguugucauagccauccuuacagugguggccgcaacuauggcaaaugagauggguuuccuggaaaaaacaaagaaagauuucggauugggaagcauugcaacccagcaaccugagagcaacauccuggacauagaucuacguccugcaucagcuuggacucuauaugcuguggcaacaaccuucaucacaccaauguugagacacagcauugaaaauuccucagugaaugugucucuaacggccauugccaaccaagccacaguguuaaugggucuugggaaaggauggccauugucaaaaauggacaucggaguuccccuucucgcuaucgggugcuauucacaagucaaccccauaacucucacggcagcccuucucuuauugguagcacauuaugccaucauagggccaggacuccaagcgaaagcaacuagagaagcucagaaaagagcagcagcgggcauuaugaaaaacccaacuguggauggaauaacagugauugaccuagauccaauacccuaugauccaaaguuugaaaagcaguugggacaaguaaugcucuuaguccucugcgugacucaaguauugaugaugaggacuacaugggcuuugugugaagcucuaaccuuagcgaccgggcccaucuccacacugugggaaggaaauccagggagauuuuggaauacaacuauugcagugucaauggcuaacauuuuuagagggaguuacuuggccggagccggacuucucuuuucuaucaugaagaacacggcuaauacaagaaggggaacuggcaacacaggagagacgcuuggagaaaaauggaaaaaccgauugaaugcauuggggaagagugaauuccaggucuauaagaaaaguggaauccaggagguggauagaaccuuagcaaaagaaggcaucgaaagaggagaaacggaccaucacgcugugucgcgaggcucggcgaaacugagaugguucgucgagagaaaccuggucacaccagaagggaaaguaguggaccucgguugcggcagggggggcuggucauacuauugugggggacuaaagaauguaaaagaagucaaaggccuaacaaaaggaggaccaggacacgaagaacccauucccaugucaacauaugguuggaaucuggugcgucuucaaaguggaguugauguuuuuuuuacuccgccagaaaagugugacacguugcugugugacauaggggagucgucaccaaaccccacgguugaggcaggacgaacacucagaguucuaaaccuaguggaaaauuggcugaacaacaacacccaguuuugcauaaagguucucaacccauauaugcccucagucauagaaaaaauggaagcgcugcaaaggaaauacggaggagcuuuggugaggaauccacucucacgaaauuccacacacgagauguacuggguauccaaugcuuccgggaacauagugucaucagugaacaugauuucaagaauguugauuaacagauucacaaugagacauaagaaggccacauacgagccagauguugaccucggaagcggaacccgcaacaucggaauugaaagugagauaccaaauuuagacauaauugggaaaagaauagaaaagauaaaacaagagcaugaaacaucauggcacuaugaccaagaccacccauacaaaacgugggccuaccauggcagcuacgaaacaaagcagacuggaucagcaucauccauggugaacggagugguuaggcugcuaacaaaaccuugggaugucaucccuauggugacacagauggcaaugacugacacgacuccauuuggacaacagcgcguuuucaaagagaaaguggacacgagaacccaagaaccgaaagaaggcacgaaaaaacuaaugaaaaucacggcagaauggcucuggaaagaacuaggaaagaaaaagacaccuaggaugugcaccagagaagaauucacaagaaaggugagaagcaaugcagccuuaggugccauauucacugaugagaacaaguggaagucggcacgugaggcuguugaagauaguggauuuugggaacugguugacaaggaaaggaaucuucaucuugaaggaaagugugagacauguguguacaacaugaugggaaagagagagaagaagcuaggggaguucggcaaagcaaaaggcagcagagccauaugguacauguggcuuggagcacgcuucuuagaguuugaagcccuaggauucuugaaugaagaucacugguuuuccagagagaacucccugaguggaguggaaggagaagggcugcacaaacuaggcuacauuuuaagagacgugagcaagaaagaaggaggagcaauguacgccgaugacaccgcaggaugggacacaagaaucacacuagaggacuuaaaaaaugaagaaauggugacaaaccacauggaaggagaacacaagaaacuugcugaagccauuuucaaauuaacguaccaaaacaagguggugcgugugcaaagaccaacaccaagaggcacaguaauggacauuauaucgagaagagaccaaagagguagcggacaaguugucacguacggccuuaauacuuucaccaacauggaagcccaacugaucagacagauggagggagaaggagucuucaaaagcauccagcaccugacagucacagaagaaauugcaguaaaaaacugguuagcaagaguggggcgugagagguuaucaagaauggccaucaguggagaugauuguguugugaaacccuuagaugacagguuugcaagcgcucuaacagcucuaaaugacaugggaaagguuaggaaagacauacaacaaugggaaccuucaagaggauggaacgauuggacacaagugcccuuuuguucacaccauuuccaugaguuaaucaugaaggacggucgugugcucguaguuccauguagaaaccaagaugaacugauugguagggcccgaauuucccagggagccggguggucuuugcgggaaacagccuguuuggggaagucuuaugcccaaauguggagccugauguacuuccacagacgugaccuuaggcuggcggcaaaugccauuugcucggcagucccaucacauuggguuccaacaagucgaacaaccugguccauacacgccacacaugaguggaugacaacagaagauaugcugacagucuggaacaggguguggauucaagaaaacccauggauggaagacaaaacuccaguagaaucaugggaggaaaucccauauuuggggaaaagagaagaccaauggugcggcucauugauugggcuaacaagcagggccaccugggcaaagaacauccaaacagcaauaaaucaaguuagaucccuaauaggcaaugaggaauacacagacuacaugccauccaugaaaagguucagaagagaagaggaagaggcaggagucuugugguag

SEQ ID NO: 6362 - RNA, 9876 nt, Artificial Sequence
  derived and/or modified CDS sequence (wt) from DENV-2__AB189123__SS-prME
acugcagguguaauuauuaugaugauuccaacagugauggcauuccauuuaaccacacgcaacggagaaccacacaugaucgucaguagacaagagaaagggaaaagucuucuguuuaaaacagagaacggugugaacauguguacccucauggccauggaccuuggugaauugugugaagacacaaucacuuauaauuguccucuucucaggcagaaugaaccagaagacauagacuguuggugcaacucuacgucuacauggguaacuuaugggacaugcaccgccacaggagaacacagaagggaaaaaagaucaguggcacucgcuccacaugugggaaugggacuggagacacgaacugaaacauggaugucaucagaaggggccuggaaacaugcccagagaauugaaacuugggucuugagacauccaggcuucaccauaauggcagcaauccuggcauauaccauaggaacgacauauuuucaaagaguccugauuuucaucuuacugacagcugucgcuccuucaaugacaaugcguuguauaggaauaucaaauagagacuuuguggaagggguuucaggaggaagcuggguugacauagucuuagaacauggaagcugugugacgacgauggcgaaaaauaaaccaacauuggauuuugaacugauaaaaacggaagccaaacaucccgccacucuaaggaaguauuguauagaggcaaagcugaccaacacaacaacagcaucucgcugcccaacacaaggagaaccuagccuaaaugaagaacaggacaaaagguuugucugcaaacacuccaugguagacagaggauggggaaauggaugcggauuauuuggaaagggaggcaucgugaccugugcaauguucacaugcaaaaagaacauggaaggaaaagucgugcaaccagaaaacuuggaguacaccauugugauaacaccucauucaggggaagagaaugcagucggaaacgacacaggaaaacacggcaaggaaauuaaaguaacaccacagaguuccauuacagaagcagaacugaccggcuauggcacugucacgauggaaugcucuccgagaacgggccucgacuuuaaugagaugguguugcugcaaauggaaaacaaggcuuggcuggugcacaggcaaugguucuuagaccugccguuaccauggcugcccggagcagacacacaaggaucaaauuggauacagaaggagacauuggucacuuucaaaaauccccaugcgaagaaacaggauguuguuguuuuaggaucccaagaaggggcuaugcauacagcacucacaggggcuacggaaauccagaugucaucaggaaacuuacuguucacaggacaucuuaagugcaggcugagaauggacaaacuacagcucaaaggaaugucauauucuauguguacaggaaaguuuaaaguugugaaggaaauagcagaaacacaacauggaacaauaguuaucagaguacaauaugaaggggacgguucuccgugcaagaucccuuuugaaauaauggauuuggaaaaaagacaugucuuaggucgcuugaucacagucaacccaauuguuacagaaaaagacagcccagucaacauagaagcagaaccuccauucggagacagcuacaucauuauaggaguagaaccgggacaacugaagcucaacugguuuaagaaaggaaguucuauuggccaaauguuugagacaacaaugagaggagcgaagagaauggccauuuuaggugacacagcuugggauuuuggaucccugggaggaguguucacaucuauaggaaaggcccuccaccaagucuuuggagcaaucuauggggcugccuucagugggguuucauggacuaugaaaauccucauaggagucgucaucacauggauaggaaugaauucacgcagcaccucacugucugugucacuagucuuagugggggucgugacacuguauuugggagucauggugcaggccgauagugguugcguugugaguuggaaaaacaaagaacugaaaugugguagugggauuuuuaucacagacaacgugcacacauggacagaacaauacaaauuccaaccagaauccccuucaaagcuggcuucagcuauccagaaggcucaugaagagggcauuuguggaauccgcucaguaacaagauuggagaaucugauguggaaacaaauaacaccagaacugaaucacauucuaucagaaaaugagguaaaauugacuaucaugacaggagacauuaaaggaaucaugcaggcaggaaaacgaucccugcggccucaacccacugagcugaaguacucuuggaaagcauggggcaaagcgaaaaugcucuccacagagcuucauaaccacaccuuucucauugauggccccgaaacagcagaaugucccaacacaaacagagcuuggaacucauuagaaguugaggacuauggcuuuggaguauucaccaccaacauauggcugaaacugaaagaaaggcaggauguauuuugugacucaaaacucaugucagcagccauaaaagacaacagggccguccacgccgauauggguuauuggauagaaagcgcacucaaugacacauggaagauugagaaagccucuuuuauugaaguuaaaagcugccacuggccaaagucacacacucucuggaguaauggagugcuagaaagugagaugauaauuccaaagaauuuugcaggaccagugucacaacacaacuacagaccagguuaucauacacaaacggcaggacccuggcaucuagguaagcuugagauggacuuugauuucugcgaaggaaccacagugguagugacugaggacuguggaaauagaggacccucuuuaagaacaacuacugcuucuggaaaacucauaacagaauggugcugccgaucuugcacauuaccaccgcuaagguacagaggugaggauggaugcugguauggaauggaaaucagaccauugaaagagaaagaagagaacuuggucaacucuuuggucacagccggacauggacagauugacaacuucucacuaggagucuugggaauggcauuguuccuggaagaaaugcucaggacccgaguaggaacgaaacaugcaauauuacuaguugcaguuucuuucgugacauugaucacagggaacauguccuuucgagauuuggggagagugaugguuauggugggcgcuacuaugacggaugacauaggcaugggcgugacuuaucuugcccuauuagcagccuucaaagucagaccaacuuuugcagcuggacuacucuugagaaagcugaccuccaaggaauuaaugaugaccaccauaggaaucguacuccucucucagagcaccauaccagagacuauacuugaacugacugacgcgcuagcuuuggggaugaugguucucaaaauagugagaaacauggaaaaguaucaacuagcagugacuaucauggccaucuugugcgucccaaaugcagugauauuacaaaacgcauggaaagugagcugcacaacacuggcagugguguccguuuccccacugcuuuuaacauccucacagcagaaagcggauuggauaccacuggcguugacgaucaaaggccucaauccaacagccauuuucuuaacaacccucucaagaacuagcaagaaaaggagcuggccacuaaaugaggcuauuauggcagucgggauggugagcauuuuagccaguucucucuuaaagaaugauauucccaugacaggaccauuaguagcuggagggcuucucacuguguguuacgugcucacuggaagaucggcugauuuggaacuggagagagcugcugacguaagaugggaagaacaggcagaaauaucaggaaguaguccaauucugucaauaacaauaucggaagaugguagcaugucgauaaaaaaugaagaagaagaacaaacacugaccauacucauuaggacaggacugcuggugauaucaggacuuuuucccgugucaauaccaaucacggcagcugcaugguaccugugggaagugaaaaaacaacgagccggaguauugugggaugucccuucacccccaccugugggaaaggccgaacuggaagauggagccuauagaaucaagcagaaagggauucuaggauacucgcagaucggagccggaguuuacaaagaaggaacauuccacacaauguggcaugucacacguggugcuguccuaaugcauaaagggaagagaauugaaccaucaugggcggacgucaagaaagaccuaauaucguauggaggaggcuggaagcuagaaggagaauggaaggaaggagaagaaguccagguccuggcauuagagccuggaaagaauccaagagccguccaaacaaaacccggucucuucaaaacuaacaccggaaccauaggcgccguaucucuggacuuuucuccuggaaccucaggaucuccaaucguugacaaaaaaggaaaaguugugggccuuuauggcaacggugucgucacaaggaguggaacauaugugagugccauagcccagacugaaaaaaacauugaagacaauccagagauugaagaugacaucuuucgaaagaaaagauugaccaucauggaccuccacccaggagcgggaaaaacgaagagauaccuuccagcaauagucagagaagccauaaaacgaggcuugaggacacuaauccuggcccccacuagaguuguggcggcugaaauggaagaagcucucagaggacuuccaauaagauaucaaaccccagcuaucagagccgagcacacugggcgggagauuguggaucuaaugugucacgccacauuuaccaugaggcugcugucaccaauuagaguaccaaauuacaaccugaucaucauggaugaagcccauuucacagacccagcaagcauagcagcuagaggauauauuucaacucgaguugagaugggugaagcagcugggauuuucaugacagcuacuccuccuggaagcagagacccauuuccucagagcaaugcaccaaucauggaugaagaaagggaaaucccugagcguucguggaauucuggacaugaguggguuacggauuuuaaagggaagacuguuugguuuguuccaaguauaaaagcaggaaaugauauagcagcuugccugagaaagaauggaaagaaagugauacaacucagcaggaagaccuuugauucugaauauaucaagacuaggaccaaugauugggacuuuguggucacgacagacauuucagaaaugggugcuaacuucaaggcugagaggguuauagaccccaggcgcugcaugaaaccagucauacuaacagacggugaagagcggguuauccuggcaggacccaugccagugacccacucuauugcagcacaaagaagagggagaguaggaagaaauccaaaaaaugaaaaugaccaguacauauacaugggggaaccucuggaaaaugaugaagacugugcacacuggaaagaagcuaagaugcuucuagauaacaucaacacgccugaaggaaucauucccagcauguucgaaccagagcgugaaaagguggaugccauugauggugaauaccgcuuaagaggagaagcgaggaaaacuuuuguggaccuaaugagaagaggagaccuaccagucuggcuagccuacagaguggcagcugaagguaucaacuacgcagacagaagauggugcuuugauggagucaaaaacaaccaaaucuuggaagaaaauguggaaguggaaauuuggacaaaagaaggagaaaggaagaaauuaaaacccagaugguuggaugcuaggaucuacucugacccacuggcgcucaaagaauucaaggaauucgcagcuggaagaaagucccugacccugaaucuaaucacagagauggguaggcucccaaccuucaugacccagaaagcaaggaacgcauuagacaacuuagcaguccugcauacggcugaagcaggcggaagggcguacaaucaugcucuuagugaacugccggagacccuggagacauugcuuuuacugacgcucuuggccacagucacgggcggaaucuuccuauucuugaugagcggaaaaggcauagggaagaugacccugggaaugugcugcauaaucacggccaguguucuccuaugguaugcacaaauacagccacacuggauagcagcuucaauaauacuggaguuuuuucucauagucuugcucauuccagaaccagaaaagcagagaacaccccaagauaaccaauuaacuuauguugucauagccauccuuacagugguggccgcaacuauggcaaaugagauggguuuccuggaaaaaacaaagaaagauuucggauugggaagcauugcaacccagcaaccugagagcaacauccuggacauagaucuacguccugcaucagcuuggacucuauaugcuguggcaacaacuuucauuacaccaauguugagacacagcauugaaaauuccucagugaaugugucucugacggccauugccaaccaagccacaguguuaaugggucuugggaaaggauggccauugucaaaaauggacaucggaguuccccuucucgcuaucgggugcuauucacaagucaaccccauaacucucacggcagcccuucucuuauugguagcacauuaugccaucauagggccaggacuccaagcgaaagcaacuagagaagcucagaaaagagcagcagcgggcaucaugaaaaacccaacuguggauggaauaacagugauugaccuagauccaauacccuaugauccaaaguuugaaaagcaguugggacaaguaaugcucuuaguccucugcgugacucaaguauugaugaugaggacuacaugggcuuugugugaagcucuaaccuuagcgaccgggcccaucuccacacugugggaaggaaauccagggagauuuuggaauacaacuauugcagugucaauggcuaacauuuuuagagggaguuacuuggccggagccggacuucucuuuucuaucaugaagaacacggcuaauacaagaaggggaacuggcaacacaggagagacgcuuggagaaaaauggaaaaaccgauugaaugcauuggggaagagugaauuccagaucuauaagaaaaguggaauccaggagguggauagaaccuuagcaaaagaaggcaucgaaagaggagaaacggaccaucacgcugugucgcgaggcucggcgaaacugagaugcuucgucgagagaaaccuggucacaccagaagggaaaguaguggaccucgguugcggcagggggggcuggucauacuauugugggggauugaagaauguaaaagaagucaaaggccuaacaaaaggaggaccaggacacgaagaacccauucccaugucaacauaugguuggaaucuggugcgucuucaaaguggaguugauguuuuuuuuacuccgccagaaaagugugacacguugcugugugacauaggggagucgucaccaaaccccacgguugaggcaggacgaacacucagaguucuaaaccuaguggaaaauuggcugaaaaacaacacccaguuuugcauaaagguucucaacccauauaugcccucagucauagaaaaaauggaagcgcugcaaaggaaauacggaggagcuuuggugaggaauccacucucacgaaauuccacacacgagauguacuggguauccaaugcuuccgggaacauagugucaucagugaacaugauuucaagaauguugauuaacagauucacaaugagacauaagaaggccacauacgagccagauguugaccucggaagcggaacccgcaacaucggaauugaaagugagauaccaaauuuagacauaauugggaaaagaauagaaaagauaaaacaagagcaugaaacaucauggcacuaugaccaagaccacccauacaaaacgugggccuaccauggcagcuacgaaacaaaacagacuggaucagcaucauccauggugaacggagugguuaggcugcuaacaaaaccuugggaugucaucccuauggugacacagauggcaaugacugacacgacuccauuuggacaacagcgcguuuucaaagagaaaguggacacgagaacccaagaaccgaaagaaggcacgaaaaaacuaaugaaaaucacggcagaauggcucuggaaagaacuaggaaagaaaaagacaccuaggaugugcaccagagaagaauucacaagaaaggugagaagcaaugcagccuuaggugccauauucacugaugagaacaaguggaagucggcacgugaggcuguugaagauaguggauuuugggaacugguugacaaggaaaggaaucuucaucuugaaggaaagugugagacauguguguacaacaugaugggaaagagagagaagaagcuaggggaguucggcaaagcaaaaggcagcagagccauaugguacauguggcuuggagcacgcuucuuagaguuugaagcccuaggauucuugaaugaagaucacugguuuuccagagagaacucccugaguggaguggaaggagaagggcugcacaaacuaggcuacauuuuaagagacgugagcaagaaagaaggaggagcaauguacgccgaugacaccgcaggaugggacacaagaaucacacuagaggacuuaaaaaaugaagaaauggugacaaaccacauggaaggagaacacaagaaacuugcugaagccauuuucaaauuaacguaccaaaacaagguggugcgugugcaaagaccaacaccaagaggcacaguauuggacauuauaucgagaagagaccaaagagguagcggacaaguugucacguacggccuuaauacuuucaccaacauggaagcccaacugaucagacagauggagggagaaggagucuucaaaagcauccagcaccugacagucacagaagaaauugcaguaaaaaacugguuagcaagaguggggcgugagagguuaucaagaauggccaucaguggagaugauuguguugugaaacccuuagaugacagguuugcaagcgcucuaacagcucuaaaugacaugggaaagguuaggaaagacauacaacaaugggaaccuucaagaggauggaacgauuggacacaagugcccuuuuguucacaccauuuccaugaguuaaucaugaaggacggucgugugcucguaguuccauguagaaaccaagaugaacugauugguagggcccgaauuucccagggagccggguggucuuugcgggaaacagccuguuuggggaagucuuaugcccaaauguggagccugauguacuuccacagacgugaccuuaggcuggcggcaaaugccauuugcucggcagucccaucacauuggguuccaacaagucgaacaaccugguccauacacgccacacaugaguggaugacaacagaagauaugcugacagucuggaacaggguguggauucaagaaaacccguggauggaagacaaaacuccaguagaaucaugggaggaaaucccauauuuggggaaaagagaagaccaauggugcggcucauugauugggcuaacaagcagggccaccugggcaaagaacauccaaacagcaauaaaucaaguuagaucccuaauaggcaaugaggaauacacagacuacaugccauccaugaaaagguucagaagagaagaggaagaggcaggagucuugugguag

SEQ ID NO: 6363 - RNA, 9876 nt, Artificial Sequence
  derived and/or modified CDS sequence (wt) from DENV-2__AB189124__SS-prME
acugcagguguaauuauuaugaugauuccaacagugauggcauuccauuuaaccacacgcaacggagaaccacacaugaucgucaguagacaagagaaagggaaaagucuucuguuuaaaacagagaacggugugaacauguguacccucauggccauggaccuuggugaauugugugaagacacaaucacuuauaauuguccucuucucaggcagaaugaaccagaagacauagacuguuggugcaacucuacgucuacauggguaacuuaugggacaugcaccgccacaggagaacacagaagggaaaaaagaucaguggcacucgcuccacaugugggaaugggacuggagacacgaacugaaacauggaugucaucagaaggggccuggaaacaugcccagagaauugaaacuugggucuugagacauccaggcuucaccauaauggcagcaauccuggcauauaccauaggaacgacauauuuucaaagaguccugauuuucaucuuacugacagcugucgcuccuucaaugacaaugcguuguauaggaauaucaaauagagacuuuguggaagggguuucaggaggaagcuggguugacauagucuuagaacauggaagcugugugacgacgauggcgaaaaauaaaccaacauuggauuuugaacugauaaaaacggaagccaaacaucccgccacucuaaggaaguauuguauagaggcaaagcugaccaacacaacaacagcaucucgcugcccaacacaaggagaaccuagccuaaaugaagaacaggacaaaagguuugucugcaaacacuccaugguagacagaggauggggaaauggaugcggauuauuuggaaagggaggcaucgugaccugugcaauguucacaugcaaaaagaacauggaaggaaaagucgugcaaccagaaaacuuggaguacaccauugugauaacaccucauucaggggaagagaaugcagucggaaacgacacaggaaaacacggcaaggaaauuaaaguaacaccacagaguuccauuacagaagcagaacugaccggcuauggcacugucacgauggaaugcucuccgagaacgggccucgacuuuaaugagaugguguugcugcaaauggaaaacaaggcuuggcuggugcacaggcaaugguucuuagaccugccguuaccauggcugcccggagcagacacacaaggaucaaauuggauacagaaggagacauuggucacuuucaaaaauccccaugcgaagaaacaggauguuguuguuuuaggaucccaagaaggggcuaugcauacagcacucacaggggcuacggaaauccagaugucaucaggaaacuuacuguucacaggacaucuuaagugcaggcugagaauggacaaacuacagcucaaaggaaugucauauucuauguguacaggaaaguuuaaaguugugaaggaaauagcagaaacacaacauggaacaauaguuaucagaguacaauaugaaggggacgguucuccgugcaagaucccuuuugaaauaauggauuuggaaaaaagacaugucuuaggucgcuugaucacagucaacccaauuguuacagaaaaagacagcccagucaacauagaagcagaaccuccauucggagacagcuacaucauuauaggaguagaaccgggacaacugaagcucaacugguuuaagaaaggaaguucuauuggccaaauguuugagacaacaaugagaggagcgaagagaauggccauuuuaggugacacagcuugggauuuuggaucccugggaggaguguucacaucuauaggaaaggcccuccaccaagucuuuggagcaaucuauggggcugccuucagugggguuucauggacuaugaaaauccucauaggagucgucaucacauggauaggaaugaauucacgcagcaccucacugucugugucacuagucuuagugggggucgugacacuguauuugggagucauggugcaggccgauagugguugcguugugaguuggaaaaacaaagaacugaaaugugguagugggauuuuuaucacagacaacgugcacacauggacagaacaauacaaauuccaaccagaauccccuucaaagcuggcuucagcuauccagaaggcucaugaagagggcauuuguggaauccgcucaguaacaagauuggagaaucugauguggaaacaaauaacaccagaacugaaucacauucuaucagaaaaugagguaaaauugacuaucaugacaggagacauuaaaggaaucaugcaggcaggaaaacgaucccugcggccucaacccacugagcugaaguacucuuggaaagcauggggcaaagcgaaaaugcucuccacagagcuucauaaccacaccuuucucauugauggccccgaaacagcagaaugucccaacacaaacagagcuuggaacucauuagaaguugaggacuauggcuuuggaguauucaccaccaacauauggcugaaacugaaagaaaggcaggauguauuuugugacucaaaacucaugucagcagccauaaaagacaacagggccguccacgccgauauggguuauuggauagaaagcgcacucaaugacacauggaagauugagaaagccucuuuuauugaaguuaaaagcugccacuggccaaagucacacacucucuggaguaauggagugcuagaaagugagaugauaauuccaaagaauuuugcaggaccagugucacaacacaacuacagaccagguuaucauacacaaacggcaggacccuggcaucuagguaagcuugagauggacuuugauuucugcgaaggaaccacagugguagugacugaggacuguggaaauagaggacccucuuuaagaacaacuacugcuucuggaaaacucauaacagaauggugcugccgaucuugcacauuaccaccgcuaagguacagaggugaggauggaugcugguauggaauggaaaucagaccauugaaagagaaagaagagaacuuggucaacucuuuggucacagccggacauggacagauugacaacuucucacuaggagucuugggaauggcauuguuccuggaagaaaugcucaggacccgaguaggaacgaaacaugcaauauuacuaguugcaguuucuuucgugacauugaucacagggaacauguccuuucgagauuuggggagagugaugguuauggugggcgcuacuaugacggaugacauaggcaugggcgugacuuaucuugcccuauuagcagccuucaaagucagaccaacuuuugcagcuggacuacucuugagaaagcugaccuccaaggaauuaaugaugaccaccauaggaaucguacuccucucucagagcaccauaccagagacuauacuugaacugacugacgcgcuagcuuuggggaugaugguucucaaaauagugagaaacauggaaaaguaucaacuagcagugacuaucauggccaucuugugcgucccaaaugcagugauauuacaaaacgcauggaaagugagcugcacaacacuggcagugguguccguuuccccacugcuuuuaacauccucacagcagaaagcggauuggauaccacuggcguugacgaucaaaggccucaauccaacagccauuuucuuaacaacccucucaagaacuagcaagaaaaggagcuggccacuaaaugaggcuauuauggcagucgggauggugagcauuuuagccaguucucucuuaaagaaugauauucccaugacaggaccauuaguagcuggagggcuucucacuguguguuacgugcucacuggaagaucggcugauuuggaacuggagagagcugcugacguaagaugggaagaacaggcagaaauaucaggaaguaguccaauucugucaauaacaauaucggaagaugguagcaugucgauaaaaaaugaagaagaagaacaaacacugaccauacucauuaggacaggacugcuggugauaucaggacuuuuucccgugucaauaccaaucacggcagcugcaugguaccugugggaagugaaaaaacaacgagccggaguauugugggaugucccuucacccccaccugugggaaaggccgaacuggaagauggagccuauagaaucaagcagaaagggauucuaggauacucgcagaucggagccggaguuuacaaagaaggaacauuccacacaauguggcaugucacacguggugcuguccuaaugcauaaagggaagagaauugaaccaucaugggcggacgucaagaaagaccuaauaucguauggaggaggcuggaagcuagaaggagaauggaaggaaggagaagaaguccagguccuggcauuagagccuggaaagaauccaagagccguccaaacaaaacccggucucuucaaaacuaacaccggaaccauaggcgccguaucucuggacuuuucuccuggaaccucaggaucuccaaucguugacaaaaaaggaaaaguugugggccuuuauggcaacggugucgucacaaggaguggaacauaugugagugccauagcccagacugaaaaaaacauugaagacaauccagagauugaagaugacaucuuucgaaagaaaagauugaccaucauggaccuccacccaggagcgggaaaaacgaagagauaccuuccagcaauagucagagaagccauaaaacgaggcuugaggacacuaauccuggcccccacuagaguuguggcggcugaaauggaagaagcucucagaggacuuccaauaagauaucaaaccccagcuaucagagccgagcacacugggcgggagauuguggaucuaaugugucacgccacauuuaccaugaggcugcugucaccaauuagaguaccaaauuacaaccugaucaucauggaugaagcccauuucacagacccagcaagcauagcagcuagaggauauauuucaacucgaguugagaugggugaagcagcugggauuuucaugacagcuacuccuccuggaagcagagacccauuuccucagagcaaugcaccaaucauggaugaagaaagggaaaucccugagcguucguggaauucuggacaugaguggguuacggauuuuaaagggaagacuguuugguuuguuccaaguauaaaagcaggaaaugauauagcagcuugccugagaaagaauggaaagaaagugauacaacucagcaggaagaccuuugauucugaauauaucaagacuaggaccaaugauugggacuuuguggucacgacagacauuucagaaaugggugcuaacuucaaggcugagaggguuauagaccccaggcgcugcaugaaaccagucauacuaacagacggugaagagcggguuauccuggcaggacccaugccagugacccacucuagugcagcacaaagaagagggagaguaggaagaaauccaaaaaaugaaaaugaccaguacauauacaugggggaaccucuggaaaaugaugaagacugugcacacuggaaagaagcuaagaugcuucuagauaacaucaacacgccugaaggaaucauucccagcauguucgaaccagagcgugaaaagguggaugccauugauggugaauaccgcuuaagaggagaagcgaggaaaacuuuuguggaccuaaugagaagaggagaccuaccagucuggcuagccuacagaguggcagcugaagguaucaacuacgcagacagaagauggugcuuugauggagucaaaaacaaccaaaucuuggaagaaaauguggaaguggaaauuuggacaaaagaaggagaaaggaagaaauuaaaacccagaugguuggaugcuaggaucuacucugacccacuggcgcucaaagaauucaaggaauucgcagcuggaagaaagucccugacccugaaucuaaucacagagauggguaggcucccaaccuucaugacccagaaagcaaggaacgcauuagacaacuuagcaguccugcauacggcugaagcaggcggaagggcguacaaucaugcucuuagugaacugccggagacccuggagacauugcuuuuacugacgcucuuggccacagucacgggcggaaucuuccuauucuugaugagcggaaaaggcauagggaagaugacccugggaaugugcugcauaaucacggccaguguucuccuaugguaugcacaaauacagccacacuggauagcagcuucaauaauacuggaguuuuuucucauagucuugcucauuccagaaccagaaaagcagagaacaccccaagauaaccaauuaacuuauguugucauagccauccuuacagugguggccgcaacuauggcaaaugagauggguuuccuggaaaaaacaaagaaagauuucggauugggaagcauugcaacccagcaaccugagagcaacauccuggacauagaucuacguccugcaucagcuuggacucuauaugcuguggcaacaacuuucauuacaccaauguugagacacagcauugaaaauuccucagugaaugugucucugacggccauugccaaccaagccacaguguuaaugggucuugggaaaggauggccauugucaaaaauggacaucggaguuccccuucucgcuaucgggugcuauucacaagucaaccccauaacucucacggcagcccuucucuuauugguagcacauuaugccaucauagggccaggacuccaagcgaaagcaacuagagaagcucagaaaagagcagcagcgggcaucaugaaaaacccaacuguggauggaauaacagugauugaccuagauccaauacccuaugauccaaaguuugaaaagcaguugggacaaguaaugcucuuaguccucugcgugacucaaguauugaugaugaggacuacaugggcuuugugugaagcucuaaccuuagcgaccgggcccaucuccacacugugggaaggaaauccagggagauuuuggaauacaacuauugcagugucaauggcuaacauuuuuagagggaguuacuuggccggagccggacuucucuuuucuaucaugaagaacacggcuaauacaagaaggggaacuggcaacacaggagagacgcuuggagaaaaauggaaaaaccgauugaaugcauuggggaagagugaauuccagaucuauaagaaaaguggaauccaggagguggauagaaccuuagcaaaagaaggcaucgaaagaggagaaacggaccaucacgcugugucgcgaggcucggcgaaacugagaugguucgucgagagaaaccuggucacaccagaagggaaaguaguggaccucgguugcggcagggggggcuggucauacuauugugggggauugaagaauguaaaagaagucaaaggccuaacaaaaggaggaccaggacacgaagaacccauucccaugucaacauaugguuggaaucuggugcgucuucaaaguggaguugauguuuuuuuuacuccgccagaaaagugugacacguugcugugugacauaggggagucgucaccaaaccccacgguugaggcaggacgaacacucagaguucuaaaccuaguggaaaauuggcugaaaaacaacacccaguuuugcauaaagguucucaacccauauaugcccucagucauagaaaaaauggaagcgcugcaaaggaaauacggaggagcuuuggugaggaauccacucucacgaaauuccacacacgagauguacuggguauccaaugcuuccgggaacauagugucaucagugaacaugauuucaagaauguugauuaacagauucacaaugagacauaagaaggccacauacgagccagauguugaccucggaagcggaacccgcaacaucggaauugaaagugagauaccaaauuuagacauaauugggaaaagaauagaaaagauaaaacaagagcaugaaacaucauggcacuaugaccaagaccacccauacaaaacgugggccuaccauggcagcuacgaaacaaaacagacuggaucagcaucauccauggugaacggagugguuaggcugcuaacaaaaccuugggaugucaucccuauggugacacagauggcaaugacugacacgacuccauuuggacaacagcgcguuuucaaagagaaaguggacacgagaacccaagaaccgaaagaaggcacgaaaaaacuaaugaaaaucacggcagaauggcucuggaaagaacuaggaaagaaaaagacaccuaggaugugcaccagagaagaauucacaagaaaggugagaagcaaugcagccuuaggugccauauucacugaugagaacaaguggaagucggcacgugaggcuguugaagauaguggauuuugggaacugguugacaaggaaaggaaucuucaucuugaaggaaagugugagacauguguguacaacaugaugggaaagagagagaagaagcuaggggaguucggcaaagcaaaaggcagcagagccauaugguacauguggcuuggagcacgcuucuuagaguuugaagcccuaggauucuugaaugaagaucacugguuuuccagagagaacucccugaguggaguggaaggagaagggcugcacaaacuaggcuacauuuuaagagacgugagcaagaaagaaggaggagcaauguacgccgaugacaccgcaggaugggacacaagaaucacacuagaggacuuaaaaaaugaagaaauggugacaaaccacauggaaggagaacacaagaaacuugcugaagccauuuucaaauuaacguaccaaaacaagguggugcgugugcaaagaccaacaccaagaggcacaguaauggacauuauaucgagaagagaccaaagagguagcggacaaguugucacguacggccuuaauacuuucaccaacauggaagcccaacugaucagacagauggagggagaaggagucuucaaaagcauccagcaccugacagucacagaagaaauugcaguaaaaaacugguuagcaagaguggggcgugagagguuaucaagaauggccaucaguggagaugauuguguugugaaacccuuagaugacagguuugcaagcgcucuaacagcucuaaaugacaugggaaagguuaggaaagacauacaacaaugggaaccuucaagaggauggaacgauuggacacaagugcccuuuuguucacaccauuuccaugaguuaaucaugaaggacggucgugugcucguaguuccauguagaaaccaagaugaacugauugguagggcccgaauuucccagggagccggguggucuuugcgggaaacagccuguuuggggaagucuuaugcccaaauguggagccugauguacuuccacagacgugaccuuaggcuggcggcaaaugccauuugcucggcagucccaucacauuggguuccaacaagucgaacaaccugguccauacacgccacacaugaguggaugacaacagaagauaugcugacagucuggaacaggguguggauucaagaaaacccguggauggaagacaaaacuccaguagaaucaugggaggaaaucccauauuuggggaaaagagaagaccaauggugcggcucauugauugggcuaacaagcagggccaccugggcaaagaacauccaaacagcaauaaaucaaguuagaucccuaauaggcaaugaggaauacacagacuacaugccauccaugaaaagguucagaagagaagaggaagaggcaggagucuugugguag

SEQ ID NO: 6364 - RNA, 9876 nt, Artificial Sequence
  derived and/or modified CDS sequence (wt) from DENV-2__AB122020__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaauugugugaagauacaaucacguacaaguguccccuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugaaacauggaugucaucagaaggggccuggaagcauguucagagaauugaaaccuggaucuugagacauccaggcuuuaccauaauggcagcaauccuggcauacaccauaggaacgacacacuuccaaagggccuugauuuucaucuuacugacagcugucgcuccuucaaugacaaugcgcugcauaggaauaucaaauagagacuucguagaagggguuucaggaggaagcuggguugacaucguuuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaaaucguacagccagaaaauuuggaauacaccaucgugauaacaccucacucaggagaagagcacgcuguagguaaugacacaggaaagcauggcaaggaaaucaaaauaacaccacagaguuccaccacagaagcagaacugacaggcuauggcacugucacgauggagugcucuccgagaacgggccucgacuucaaugagauggugcugcugcagauggaagacaaagcuuggcuggugcacaggcaaugguuccuagaccugccguuaccauggcuacccggagcggauacacaaggaucaaauuggauacagaaagagacauuggucacuuucaaaaauccccacgccaagaaacaggaugucguugucuuagggucucaagaaggggccaugcacacggcacucacaggggcuacagaaauccagaugucaucaggaaacuuacuguucacgggacaucucaagugcaggcugagaauggacaaacuacagcucaaaggaaugucauacucuauguguacaggaaaguuuaaaaucgugaaggaaauagcagaaacacaacauggaacaauaguuaucagaguacaauaugaaggggacgguucuccauguaagaucccuuuugagauaacagauuuggaaaaaagacacgucuuaggacgccugauuacaguuaacccaaucguaacagaaaaagauagcccagucaacauagaagcagaaccuccauucggagacagcuacaucaucguaggaguagagccgggacaacugaaacucaauugguuuaagaagggaaguuccaucggccaaauguuugagacaacaaugagaggagcaaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggagucgugacacuguaccugggagcuauggugcaggcugauagugguugcauugugagcuggaaaaauaaagaacugaaauguggcagcgggaucuucaucacagauaacguacacacauggacagaacaauauaaguuccaaccagaauccccuucaaaacuagcuucagcuauccaaaaagcucaugaagaaggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgauccuugcggccucagcccacugagcugaaguacucauggaaaacauggggaaaggcgaaaaugcucucuacagagucucacaaucagaccuuucuuauugauggcccugaaacagcagaaugccccaacacaaacagagcuuggaacucacuggaaguugaagacuaugguuuuggaguuuuuaccaccaauauauggcuaaaauugagagaaaaacaggauguauuuugugacucaaaacucaugucagcggccauuaaagacaacagagccguccaugccgauauggguuauuggauagaaagugcacucaaugacacauggaagauggagaaagccuccuucauugaaguuaaaagcugccacuggccaaagucacacacccucuggagcaauggaguauuagaaagugagaugauaauuccaaaaaauuuugccgggccagugucacaacacaacuacagaccaggcuaccauacacaaacagcaggaccuuggcaucuagguaagcuugagauggacuuugauuucugcgaaggaacuacagugguggugacugaggacuguggaaauagaggacccucuuuaagaacgaccacugccucuggaaagcucauaacagaauggugcugccgauccugcacacuaccaccucuaagauacagaggugaggauggaugcugguacgggauggaaaucagaccuuugaaagagaaagaggagaacuuggucaacuccuuggucacagccggacaugggcagauugacaacuuuucacuaggagucuugggaauggcacuguuccuggaagaaaugcuuaggacccgaguaggaacgaaacaugcaauacugcuaguugcacuaucuuuugugacauugauuacugggaacaugucuuuuagagaccugggaagagugauggucauggugggcgcuaccaugacggaugacauagguaugggagugacuuaucuugcccuacuagcagcuuucaaaguuagaccaacuuuugcagcuggacuacucuugagaaaacugaccuccaaggaauugaugauggccaccauaggaaucgcacuccuuucccaaagcaccuugccagagaccauucuagaacugacugaugcguuagccuugggcaugaugguccucaaaauagugagaaauauggaaaaauaccaauuggcagugacuaucauggcuauuucgugugucccaaaugcagugauauugcaaaacgcauggaaggugaguugcacaauauuggcagcgguguccguuucuccacugcuccuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauuccuaugacagguccauuaguggcuggagggcuccucaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaagugaagaaacaacgggcuggaguauugugggacgucccuucacccccaccagugggaaaagccgaacuggaagauggagccuauagaaucaagcaaagagggauucuuggauauucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaaucccagagcuguccaaacgaaaccuggaauuuucaaaaccaacaccggaaccauaggcgcuguaucucuggacuuuuccccuggaacgucaggaucuccaauugucgacagaaaaggaaaaguugugggucuuuacgguaaugguguugucacaaggaguggagcauacguaagugccauagcccagaccgaaaaaagcauugaagacaauccagagaucgaagaugacauuuuccgaaagaaaagauugaccaucauggaccuccauccaggggcaggaaagacaaaaagauaccuuccagccauaguuagagaagccauaaaacguggcuugagaacauuaauccuggcucccacuagagucguggcagcugaaauggaggaagcucuuagaggacuuccaauaagauaccaaaccccagccaucagagccgagcacaccgggcgggagaucguggaccuaaugugucaugccacauuuacuaugaggcugcuaucaccagucagagugccaaauuacaaccugauuaucauggacgaagcccacuucacagacccagcaagcauagcagcuagaggauacauuucaacucgaguagagaugggugaagcagccgggauuuucaugacagccacuccuccgggaagcagagacccauuuccucagagcaaugcaccaaucauggaugaggaaagagaaaucccugagcguucauggaauucaggacaugaaugggucacggauuuuaaagggaagacuguuugguuuguuccaaguauaaaagcaggaaaugacauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagacccuagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucucgaaaaugaugaagacugugcacacuggaaagaagcuaaaaugcuccuagauaacaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauguggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagaaacgcacuggacaacuuggcugugcugcauacggcugagguagguggaagggcguacaaucaugcucucagugaacugccggagacccuggagacacugcuucuacugacacuccuggcaacagucacaggaggaaucuucuuauucuuaaugagcggaaaagguauagggaagaugacucugggaauguguugcauaaucacagcuagcauucuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauuuggaagcauuacaacccaggaaucugagagcaacauccuggacauagaucuacguccugcaucagcauggacgcuguaugccguggcuacaacauuugucacaccaauguugcgacauagcauugaaaauuccucaguaaaugucucccuaacagccauugcuaaccaagcuacagugcuaaugggucuugggaaaggauggccauugucaaagauggacaucggaguuccccuccuugccauuggaugcuacucacaagucaacccuauaacccucacagcagcucuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaacaccaccauugcagugucaauggcuaacaucuuuagggggagcuacuuggccggagcuggacuucucuuuuccaucaugaagaacacaacaaacacaagaagaggaacuggcaacguaggagagacacuuggagaaaaauggaaaagccgauuaaaugcacugggaaaaagugaauuucagaucuacaagaaaaguggaauccaggaaguggauagaacccuagcaaaagaaggcaucaaaagaggagaaacggaccaccaugcugugucacgaggaucagcaaaacugagaugguucgucgagagaaacauggucacaccggaagggaaggugguggaucuugguugcggcagagggggcuggucauacuauugugggggacuaaagaauguaagagaagucaaaggccuaacaaaaggaggaccaggacacgaagaacccauccccaugucaacauauggguggaaucuagugcgucugcaaagugggguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguccucaauccauauaugcccucagucauagaaaaaauggaaacacuacaaaggaaauauggaggagccuuagugaggaauccacucucacgaaacuccacgcaugaaauguacuggguaucuaaugcuaccgggaacauagugucaucagugaacaugauuucaaggauguugauuaacagauucacaaugaaacauaagaaagccaccuacgagccagauguugaccuaggaaguggaacccgcaacauuggaauugaaagugagauaccaaaucuagacauaauaggaaagagaauagagaaaauaaagcaagagcaugaaacaucauggcauuaugaccaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacagcgcguuuucaaagagaaaguggacacgagaacucaagaaccgaaggaaggcacaaagaaacugaugaaaauuacggcagaguggcuuuggaaagaacuaggaaaggaaaagacaccuaggauguguaccagagaagaauucacaagaaaagugagaagcaaugcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuucugaaugaagaucacugguucuccagagggaacucccugaguggaguggaaggagaagggcugcacaggcuaggcuacauuuuaagagaagugggcaagaaggaaggaggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaaaagaccaaagaggcagugggcaagucggcaccuauggccuuaauacuuucaccaauauggaagcccaauuaauuagacagauggaaggagaaggaaucuucaaaagcauucagcaccugaccgccacagaagaaaucgcuguacagaacugguuagcaagaguggggcgugaaaggcuaucaagaauggccaucaguggagaugacuguguuguaaaaccuauagaugacagauuugcaagugcuuuaacagcucuaaaugacaugggaaaaguuaggaaagauauacaacaaugggaaccuucaagaggauggaacgauuggacacaggugccuuucuguucacaccauuuucaugaguuagucaugaaagauggucgcgugcucguagucccaugcagaaaccaagaugaacugauuggcagagcccgaauuucccagggagccggguggucuuugaaggagacggcuuguuuggggaagucuuacgcccaaauguggacccugauguacuuccacagacgugaccucagauuggcggcaaaugccauuugcucggcagucccgucacauuggguuccaacaagucgaacaaccugguccauacacgccaagcaugaauggaugacgacggaagacaugcuggcagucuggaacaggguguggauccaagaaaacccauggauggaagacaaaacuccaguggaaucaugggaagaagucccauaccuggggaaaagggaagaccaauggugcggcucauugauugggcuaacaagcagggcuaccugggcaaagaacauccagacagcaauaaaucaagucagaucccuuauaggcaaugaggaauacacagacuacaugccauccaugaagagauucagaagggaagaggaagaggcagguguccugugguag

SEQ ID NO: 6365 - RNA, 9876 nt, Artificial Sequence
  derived and/or modified CDS sequence (wt) from DENV-2__LC121816__SS-prME
acuguaggcaugaucaucaugcugauuccaacagcaauggcguuccauuuaaccacacgcaauggagaaccacacaugaucgucagcagacaagagaaagggaaaagucucuuguuuaaaacagaggauggugugaacauguguacccucauggccauggaccuuggugaacugugugaagacacagucacuuauaacuguccucuucucaggcagaaugaaccagaagacauagacugcuggugcaacuccacguccacauggguaacuuaugggacaugcacugccacaggagaacacagaagggaaaaaagaucaguggcacucgucccacaugugggaaugggauuggagacacgaacugaaacauggaugucaucagaaggggccuggaaacacgcccagaggauugaaaccuggaucuugagacauccagguuuuaccauaauggcagcaaucuuggcacacaccauaggaacaacauauuuccaaagagucuugauuuucaucuuacugacagcugucgcuccuucaaugacaaugcgcugcauaggaauaucaaacagagacuuuguggaagggguuucaggaggaagcuggguugacauagucuuagaacauggaagcugugugacaacgauggcaaaaaacaaaccaacauuggacuuugagcugauaaaaacagaagccaagcaaccugccacucuaaggaaguacuguauagaggcaaagcugaccaacacaacaacagcaucucgaugcccaacacaaggggaacccagucuaaacgaagagcaggacaaaagguuugucugcaaacauuccaugguagacagaggauggggaaauggauguggauuauuuggaaaaggaggcaucgugaccugugccauguucacaugcaaaaaaaacauggaagggaaaaucgugcaaccagaaaaccuggaauacaccauugugauaacaccucacucaggggaagagaaugcaguuggaaaugacacaggaaaacauggcaaggaagucaaaguaacaccacagaguucuauuacagaagcagaacugacaggcuauggcaccgucacgauggagugcucuccgagaacgggccuugacuucaaugagaugguguugcugcaaauggaaaacaaagcuugguuggugcacaggcaaugguucuuagaccugccguuaccauggcugcccggagcggacacacaaggaucaaauuggauacagaaggagacauuggucaccuucaaaaauccccaugcaaagaaacaggauguuguuguuuuaggaucucaagaaggggcuaugcauacagcacuuacaggggccacggaaauccaaaugucaucaggaaaccuacuguucacaggacaucucaagugcaggcugagaauggacaaacuacagcucaaaggaaugucauacucuauguguacaggaaaguuuaaaguuguaaaggaaauagcagaaacacaacauggaacaauaguuaucagaguacaauaugaaggggaugguucuccauguaaaaucccuuuugagauaauggaccuggaaaaaagacaugucuuaggucgccugauuacagucaacccaauugucacagaaagagacagcccagucaacauagaagcagaaccuccauuuggagacagcuacaucauuauaggaguagaaccgggacaacugaagcucagcugguuuaagaaaggaagcucaaucggccaaauguucgagacaacaaugagaggagcgaagagaauggccauuuuaggugacacagccugggauuuuggaucccugggaggaguguucacaucuauaggaaaggcccuccaccagguuuuuggagcaaucuauggggcugccuucagcggggucucauggaccaugaaaauccucauaggaguugucaucacauggauaggaaugaauucacgcagcaccucacugucugugucguuaguauuagugggaguuguuacauuguauuugggagucauggugcaggcugauagugguuguguugugaguuggaaaaacaaagaacugaaauguggcagcgggaucuuuaucacagacaauguacacacauggacagaacaauacaaauuccaaccagaaucccccucaaagcuggcuucagccauucaaaaagcuuaugaagagggcauuuguggaauccgcucaguaacaagacuggagaaucuaauguggaaacaaauaacuccagaacugaaccacauucuaucagaaaaugagguaaaguugacuaucaugacaggagacaucaaaggaaucaugcaggcaggaaagcggucccugcggccucagcccacugagcugaaguauucauggaaaacauggggcaaagcgaaaaugcucuccacagagcaccauaaccagacccuucucauugauggccccgaaacagcagaaugucccaacacaaacagagcuuggaacucacuagaaguugaagacuauggcuuugggguauucaccaccaauauauggcugaaguugaaagaaaggcaggauguguuuugugacucaaaacucaugucggcagccauaaaagacaacagagccguccaugccgauauggguuauuggauagaaagcgcgcuuaaugacacauggaagauagaaaaagccuccuucaucgaaguuaaaagcugccacuggccaaaaucacacacucucuggaguaauggagugcuagaaagugagaugauaauuccaaagaauuuugcuggaccaguaucacaacacaauuacagaccaggcuaucacacacaaacggcaggacccuggcaucuaggcaagcuugagauggacuuugauuuuugugaaggaaccacagugguggugacugaggacuguggaaauagaggacccucucuaagaacaacuaccgcuucuggaaaacucauaacagaaugguguugccgauccugcacauuaccaccgcuaagauacagaggcgaggauggauguugguacggaauggaaaucagaccauugaaagagaaagaagagaaccuggucaacucuuuggucacagccggacacggacagauugacaacuucucguuaggagucuugggaauggcauuguuccuggaagaaaugcucaggacccgaguaggaacaaaacaugcauuauuacuaguugcaguuucuuucaugacauuaaucacagggaauaugucuuuccgagaccuggggagagugaugguuauggugggggcugcuaugacggacgacauaggcaugggcgugacuuaucuugccuuauuagcagccuucaaaguuagaccaacuuuugcagcuggacuacuuuuaagaaagcugaccuccaaggaauugaugaugaccaccauaggaauuguacuucucucccagagcaccauaccagagacuauacuugaacugacugaugcguuggccuuaggcaugaugauucucaaaauagugagaaauauggagaaguaucaauuagcagugacuaucauggcuauuuuauguguuccaaaugcagugauacuacaaaaugcauggaaagugagcugcacaauacuggcagugguguccguuaccccacugcucuuaacauccucacggcagaaagcggacuggauaccauuggcauugacgaucaagggucucaauccaacagccauuuucuuaacaacccuuucaagaaccaacaagaaaaggaguuggccacuaaaugaggcuaucauggcagucgggauggugagcauuuuagccaguucucuccugaagaaugacauucccaugacaggaccacuaguggcuggagggcuucucacuguguguuacgugcucacuggaagaucggcugauuuggaacuggagagagccgcugacguaagaugggaagaucaagcagagauaucgggaaguaguccaauucugucaauaacaauaucggaagauggcagcaugucaauaaaaaaugaagaagaagaacaaacacugaccauccucauuagaacaggauugcuggugauaucaggacuuuuucccguaucaauaccaauuacggcagcagcaugguaccugugggaagugaagaaacaacgggcuggaguguugugggauguuccuucacccccacccgugggaaaggccgaauuggaagauggagccuauagaaucaagcagaaagggauucuuggauacucccagaucggagcuggagucuacaaagaaggaacauuccacacaauguggcacgucacacguggugcuguucuaaugcacaaagggaagaggauugaaccaucaugggcggaugucaggaaagaccuaauaucguauggaggaggcuggaagcuagaaggagaauggaaggaaggagaagaaguccagguuuuggcauuggagccuggaaagaauccaagagccguccaaacaaaacccggucuuuuuaagacugacaccggaaccauaggcgccguaucucuagacuuuucuccuggaacgucaggaucuccaaucgucgacaaaaaaggaaaagucgugggucuuuaugguaauggaguugucacuagaaguggaacauaugugagcgccauagcccagacugaaaaaagcauugaagacaacccagagauugaagaugacaucuuucggaaaagaagauugaccauuauggaccuccacccaggagcgggaaagacgaaaagauaccuuccagcaauagucagagaggccauaaaacgaggcuugagaacauuaauccuggccccuacuagagucguggcagcugaaauggaggaagcucuuagaggacuuccaauaagauaccaaaccccagccauuagagcugagcacacugggcgagaaaucguggauuuaaugugucaugccacauuuaccaugaggcugcugucgccaguuagagugccaaauuacaaccugaucauuauggaugaagcccauuucacagacccagcgagcauagcagcuagaggauacauuucaacucgaguagagaugggugaagcagcugggauuuuuaugacagccacuccuccgggaagcagagacccauuuccucagagcaacgcaccaaucauggaugaggaaagggaaaucccugaacguucguggaauucuggacaugaauggguuacggauuuuaaagggaagacuguuugguuuguuccgaguauaaaagcaggaaaugauauagcagcuugucugagaaaaaauggaaagaaagugauacaacucaguaggaagaccuuugauucugaauacaucaagacuaggaccaaugauugggacuuuguggucacgacugacauuucagaaaugggugcuaacuucaaggcugaaaggguuauagaccccaggcgcugcaugaagccagucauacuaacagacggugaagagagggugaucuuggcaggacccaugccaguaacccacucuagugcagcacaaagaagagggagaauaggaaggaauccaaaaaaugaaaaugaccaauacauauacaugggggaaccucuggaaaaugaugaagacugugcacacuggaaagaagcuaagaugcuucuagacaacaucaacacgccugaaggaaucauccccagcauguuugaaccagagcgugagaagguggaugccauugauggugaguaccgcuuaagaggagaagccaggaaaaccuuuguggaccuaaugagaagaggagaccuaccagucuggcuggccuacagaguggcagccgaaggcauuaacuaugcagacagaaggugguguuuugauggagucaagaacaaccaaaucuuggaagaaaauguggaaguggaaaucuggacaaaagaaggagaaaggaagaaauugaaacccaggugguuggaugcuaggaucuauucugacccgcuggcgcucaaagaauucaaagaguuugcagccggaagaaaaucccugacccugaaucuaaucacagaaauggguaggcuuccaacuuuuaugacccagaaagcaaggaaugcacuggacaacuuagcaguccugcacacagcugaagcaggcggaagagcauacaaccaugcucucagugaacugccggagacccuggagacauugcuuuugcugacacuuuuggcuacagucacgggcggaaucuuucuauuuuugaugagcggaaaagguauagggaaaaugacucugggaaugugcugcauaaucacggccaguauucuccuaugguacgcacagauacagccacacuggauagcagcuucaauaauacuggaguuuuuucucauaguuuugcucauuccagaaccagaaaagcagagaacaccccaagacaaccaauuaacuuacguugucauagccauccucacagugguggccgcaaccauggcaaacgagauggguuuucuggaaaaaacgaagaaagauuucggauugggaagcauugcaacccagcagcccgagagcaacauccuggacauagaucuacgcccugcaucagcauggacccuguaugccguggccacaacauuuaucacaccaaugcugagacauaguauugaaaauuccucagugaaugugucucuaacagccauugccaaccaagccacaguacuaaugggucuugggaaaggauggccauugucaaaaauggauauuggaguuccucuucucgcuauugggugcuauucacaagucaaccccauaacucuuacagcagcccuucuuuuauugguagcacauuaugcuaucauagggccaggacuccaagcgaaagcaaccagagaagcgcagaaaagagcagcagcaggcaucaugaaaaacccaacuguggauggaauaacagugauugaccuagacccaauacccuaugauccaaaauuugagaaacagcugggacaagugaugcuccuaguccucugcgugacucaaguacugaugaugaggacuacaugggcuuugugugaggcucuaaccuuagcgaccgggcccauuuccacauugugggaaggaaauccagggagauuuuggaauacaacuauugcagugucaauggcuaacauuuuuagaggaaguuacuuggcuggagcuggacuucucuuuuccaucaugaagaacacaaccaacacaagaaggggaacuggcaacacaggagagacgcuuggagagaaauggaaaaaccgauugaacgcauuagggaagagugaauuccagacuuacaagaaaagcggaauccaggaaguggauagaaccuuggcaaaagagggcaucaaaagaggagaaacagaccaucacgcugugucgcgaggcucagcaaagcugagaugguucgucgagagaaaccuggucacaccagaagggaaaguaguggaccucgguugcggcagagggggcuggucauacuauugugggggccuaaagaauguaagagaagucaaaggccuaacaaaaggagggccaggacaugaagaaccuauucccaugucaacauauggguggaaucuagugcgucuucaaaguggaguugacguuuucuuuaccccgccagaaaaaugugauacauuguugugcgacauaggggagucgucaccaaaucccacgguugaagcaggacgaacacucagaguccuaaacuugguggaaaauuggcugaacaacaacacccaauuuugcauaaagguucucaacccauacaugcccucagucauagagaaaauggaagcgcugcaaaggaaauacggaggggcuuuggugaggaauccacucucaagaaauuccacacaugagauguauuggguauccaaugcuuccgggaacauagugucaucagugaacaugauuucaaggauguugaucaacagauucacaaugagacauaagaaggccacauacgagccagauguugaccucggaagcggaacccgcaacaucggaauugaaagugagacaccaaaccuagacauaauuggaaaaagaauagaaaaaauaagacaagagcaugaaacaucauggcacuaugaucaagaccacccauauaaaacgugggccuaccauggcagcuacgaaacaaaacagacuggaucagcaucauccauggugaauggagugguuagacugcugacaaaaccuugggacgucauccccauggugacacagauggcaaugacagacacgaccccauuuggacaacagcguguuuuuaaagagaaaguggacacgagaacccaagaaccaaaagaaggcacgaagaaacuaaugaaaaucacagccaaauggcucuggaaggaauuagggaagaaaaagacaccuaggaugugcacuagagaagaauucacaagaaaggugagaagcaacgcagcccuaggugccauauucacugaugagaacaaguggaagucugcacgugaggcuguugaagacaguagauuuugggaacugguugacaaggaaaggaaucuccaucuugaaggaaagugugaaacauguguguacaauaugaugggaaagagagagaagaaacuaggggaguucggcaaagcaaaaggcaguagagccauaugguacauguggcuuggagcacgcuucuuggaguuugaagcccuaggauucuugaaugaagaucauugguuuucuagagagaacucuuugaguggaguggaaggagaagggcugcacaagcuggguuacauccuaagagaugugagcaagaaagaaggaggagcaauguacgccgaugacacugcaggaugggacacaagaaucacacuagaggacuuaaaaaaugaagaaauggugacaaaccacauggaaggagaacacaagaaacuugcugaggccaucuucaaauuaacguaccaaaacaagguggugcgugugcaaagaccgacaccaagaggcacaguaauggauauuauaucaagaagagaccaaagaggaaguggacaaguuggcaccuauggccucaacacuuucaccaauaugggagcccaauuaaucagacagauggagggagaaggagucuuuaaaagcauccagcaccugacagcuacagaagaaaucgcagugcaagacugguuagcaagaguggggcgugagagguuaucaagaauggcuaucaguggagaugauuguguugugaaacccuuagaugacagguuugcaagugcuuuaacggcucuaaaugacaugggaaagguuaggaaagauauacaacaaugggaaccuucaagaggauggaacgauuggacacaggugccuuucuguucacaccauuuccaugaguuaaucaugaaagauggucguguacucguuguuccauguagaaaccaagaugaacugauuggcagagcccgaauuucccagggagccggguggucuuugcgggagacggccugucugggaaagucuuacgcccaaauguggagccugauguacuuucacagacgugaccucagacuggcggcaaacgcuauuugcucggcagucccaucacacuggguuccaacaagucgaacaaccugguccauacaugccaaacaugaauggaugacaacagaagacaugcugacggucuggaacaggguguggauucaagaaaacccauggauggaagacaaaacuccaguggaaucaugggaggaaaucccauacuugggaaaaagagaagaccaauggugcggcucauugauagggcuaacaagcagggcuaccugggcaaagaacauccaaacagcaauaaaccaagucagauccuuaauaggcaaugaggaguacacagacuauaugccauccaugaaaagauucagaagagaagaggaagaggcaggggucuugugguag

SEQ ID NO: 6366 - RNA, 9876 nt, Artificial Sequence
  derived and/or modified CDS sequence (wt) from DENV-2__LC111438__SS-prME
acugcagguauaauuauuaugaugauuccaacagugauggcguuccauuuaaccacacgcaacggagaaccacacaugaucgucagcagacaagagaaggggaaaagucuucuguuuaaaacagagaacggugugaacauguguacccucauggccauggaccuuggugaguugugugaagacacaaucacuuauaauuguccucuucucaggcaaaaugaaccagaagacauagacuguuggugcaacucuacgucuacaugggugacuuaugggacaugcaccgccacaggagaacacagaagggaaaaaagaucaguggcacucguuccacaugugggaaugggacuggagacacgaacugaaacauggaugucaucagaaggggccuggaaacaugcccagagaauugaaacuugggucuugagacacccaggcuucaccauaauggcagcaauccuggcauacaccauaggaacgacacauuuccaaagaguccuuauuuucaucuuacugacagcugucgcucccucaaugacaaugcguuguauaggaauaucaaauagagacuuuguggaagggguuucaggaggaagcuggguugacauagucuuggaacauggaagcugugugacgacgauggcgaaaaauaaaccaacauuggauuuugaacugauaaaaacagaagccaaacaucccgccacucuaaggaaguauuguauagaggcaaagcugacuaacacaacaacagcaucucgcugcccaacacaaggagaaccuagccuaaaugaagaacaggacaaaagauuugucugcaaacacuccaugguagacagaggauggggaaauggaugcggauuauuuggaaagggaggcaucgugaccugugcaauguucacaugcaaaaagaacauggaaggaaaagucgugcaaccagaaaacuuggaguacaccauugugauaacaccucacucaggggaagagaaugcagucggaaaugacacaggaaaacacggcaaggaaauuaaaguaacaccacagaguuccaucacagaagcagaacuaacaggcuauggcacugucacgauggaaugcucuccgagaacgggccucgacuucaaugagaugguguugcugcagauggaaaacaaggcuuggcuggugcacaggcaaugguucuuagaccugccguuaccauggcugcccggagcagacacacaaggaucaaacuggauacagaaggagacauuggucacuuucaaaaauccccaugcaaagaaacaggauguuguuguuuugggaucccaagaaggggcuaugcauacagcacucacaggggccacggaaauccagaugucaucaggaaacuuacuguucacaggacaucuuaagugcaggcugagaauggacaaacuacagcucaaaggaaugucauauucuauguguacaggaaaguuuaaaguugugaaggaaauagcagaaacacaacauggaacaauaguuaucagaguacaauaugaaggggacgguucuccgugcaagaucccuuuugaaauaauggauuuggaaaaaagacaugucuuaggucguuuaauuacagucaacccaauuguuacggaaaaagacagcccagucaacauagaagcagaaccuccauuuggagacagcuacaucauuauaggaguagaaccgggacaacugaagcucagcugguuuaagaaaggaaguuccauuggccaaauguuugagacaacaaugagaggagcgaagagaauggccauuuuaggugacacagcuugggauuucggaucccugggaggaguguucacauccauaggaaaggcccuccaccaagucuuuggagcaaucuauggggcugccuucagugggguuucauggacuaugaaaauccucauaggagucgucaucacauggauaggaaugaauucacgcagcaccucacugucugugucacuaguauuagugggggucgugacauuguauuugggaguuauggugcaggccgauagugguugcguugugaguuggaaaaacaaagaacugaaauguggcagugggauuuuuaucacagacaacgugcacacauggacagaacaauacaaauuccaaccagaaucuccuccaaagcuggcuucagcuauccagaaggcucaugaagagggcauuuguggaauccgcucaguaacaagacuggagaaucugauguggaaacaaauaacaccagaauugaaucacauucuaucagaaaaugagguaaaguugacuaucaugacaggagacauuaaaggaaucaugcaggcaggaaaacgaucccugcggccucaacccacugagcugaaguacucuuggaaagcauggggcaaagcgaaaaugcucuccacagagcuucauaaccacaccuuucucauugauggccccgaaacagcagaaugucccaacacaaacagagcuuggaauucacuagaaguugaagacuacggcuuuggaguauucaccaccaacauauggcugaaauugaaagaaaagcaggauguauuuugugacucaaaacucaugucagcagccauaaaagacaacagagccguccacgccgauauggguuauuggauagaaagcgcacucaaugacacauggaagauugagaaagccucuuuuauugaagucaaaagcugccacuggccaaagucacacacucucuggaguaauggagugcuagaaagugagaugauaauuccaaagaauuuugcaggaccagugucacaacacaauuacagaccaggcuaucauacacaaacggcaggacccuggcaucuagguagucuugagauggacuuugauuucugcgaaggaaccacagugguagugacugaggacuguggaaacagaggacccucuuuaagaacaaccacugcuucuggaaaacucauaacagaauggugcugccgaucuugcacauuaccaccgcuaagguacagaggugaggauggaugcugguauggaauggaaaucagaccauugaaagagaaagaagagaacuuggucaacucuuuggucacagccggacacggacagauugacaacuucucacuaggagucuugggaauggcacuguuccuggaagagaugcucaggacccgaguaggaacgaaacaugcaauauuacuaguugcaguuucuuucgugacauugaucacagggaacauguccuuucgagauuuggggagagugauggucauggugggcgcuacuaugacggaugacauaggcaugggcgugacuuaucuugcccuauuagcagccuucaaaaucagaccaacuuuugcagcuggacuacucuuaagaaagcugaccucuaaggaauugaugaugaccaccauaggaaucguacuccucucucagagcaccauaccagagacuauacuugaacugacugacgcguuggcuuuggggaugaugguucucaaaauagugagaaacauggaaaaguaucaacuagcagugacuaucauggccaucuugugcgucccaaaugcagugauauuacaaaaugcauggaaagugagcugcacaacacuggcagugguguccguuuccccacugcuuuuaacauccucacagcagaaagcagauuggauaccacuggcguugacgaucaaaggccuuaauccaacagccauuuucuuaacaacccucucaagaacuagcaagaaaaggagcuggccacuaaaugaggcuauuauggcagucgggauggugagcauuuuagccaguucucucuuaaagaaugauauucccaugacaggaccauuaguggcuggagggcuucucacuguguguuacgugcucacuggaagaucggcugauuuggaacuggagagagcugcugacguaagaugggaagaacaggcagagauaucaggaagcaguccaauucugucaauaacaauaucggaagaugguagcaugucgauaaaaaaugaagaagaagaacaaacacugaccauacucauuagaacaggacugcuggugauaucaggacuuuuucccgugucaauaccaaucacggcagcugcaugguaccugugggaagugaaaaaacaacgagccggaguauugugggaugucccuucacccccaccugugggaaaggccgaacuggaagauggagccuauagaaucaagcagaaagggauucuaggauacucgcagaucggagccggaguuuacaaagaaggaacauuccacacaauguggcaugucacacguggugcuguccuaaugcauaaagggaagagaauugaaccaucaugggcggacgucaagaaagaccuaauaucauauggaggaggcuggaagcuagaaggagaauggaaggaaggagaagaaguccagguccuggcauuagagccuggaaagaauccaagagccguccaaacaaaacccggucuuuuuaaaacuaacacuggaaccauaggugccguaucucuggacuuuucuccuggaacgucaggaucuccaaucgucgacaaaaaaggaaaaguugugggccuuuauggcaacggugucgucacaaggaguggaacauaugugagugccauagcccagacugaaaaaagcaucgaagacaauccagagauugaagaugacaucuuucgaaagaaaagauugaccaucauggaccuccacccaggagcgggaaaaacaaagagauaccuuccagcaauagucagagaagccauaaaacgaggcuugagaacacuaauccuggcccccaccagaguuguggcagcugaaauggaagaagcucucagaggacuuccaauaagauaccaaaccccagcuaucagagcugagcacacugggcgggagauuguggaucuaaugugucacgccacauuuaccaugaggcuguuaucaccaauuagagugccaaauuacaaccugaucaucauggaugaagcccauuucacagacccagcaagcauagcagccagaggauacauuucaacucgaguagagaugggugaagcagcugggauuuucaugacagcuacuccuccuggaagcagagacccauuuccucagagcaaugcaccaaucauggaugaagaaagggaaaucccugagcguucguggaacucuggacaugagugggucacggauuuuaaagggaagacuguuugguuuguuccaaguauaaaagcaggaaaugauauagcagcuugccugagaaagaauggaaagaaagugauacaacucagcaggaagaccuuugauucugaauauaucaagacuaggaccaaugauugggacuuuguggucacgacagacauuucagaaaugggugcuaacuucaaggcugagaggguuauagaccccagacgcugcaugaaaccagucauacuaacagacggcgaagagcgggugaucuuggcaggacccaugccagugacccacucuagugcagcacaaagaagagggagaguaggaagaaauccaaaaaaugaaaaugaccaguacauauacaugggggaaccucuggaaaaugaugaagacugugcacacuggaaagaagcaaagaugcuucuagauaacaucaacacgccugaaggaaucauucccagcauguucgaaccagagcgugaaaagguggaugccauugauggugaauaccgcuugagaggagaagcgaggaaaacuuuuguggaccuaaugagaagaggagaccuaccaguuuggcuagccuacagaguggcagcugaagguaucaacuacgcagacagaagauggugcuuugauggagucaagaacaaccaaaucuuggaagaaaauguggaaguggaaauuuggacaaaagaaggagaaaggaagaaauuaaaacccagaugguuggaugcuaggaucuacucugacccauuggcgcucaaagaauucaaggaauucgcagcuggaagaaaaucccuggcccugaaucuaaucacagagauggguaggcucccaaccuucaugacccagaaagcaaggaaugcacuggacaacuuagcaguccugcacacggcugaagcaggcggaagggcauacaaucaugcucuuagugaacugccggagacccuggagacauugcuuuuacugacacuuuuggccacagucacgggcggaaucuuccuguucuuaaugagcggaaagggaauagggaagaugaccaugggaaugugcugcauaaucacggccaguauccuccuaugguaugcacaaauacagccacacuggauagcagcuucaauaauacuggaguuuuuucucauagucuugcucauuccagaaccagagaagcagagaacaccccaagauaaccaauuaacuuauguugucauagccauccucacagugguggccgcuaccauggcaaacgagauggguuuccuggaaaaaacaaagaaagauuucggauugggaagcauugcaacccagcagccugagagcaacauccuggacauagaucuacguccugcaucagcuuggacucuauaugccguggcaacaacuuucaucacaccaauguugagacauagcauugaaaauuccucagugaaugugucucuaacagccauugccaaccaagccacaguguuaaugggccuugggaaaggauggccauugucaaaaauggacaucggaguuccccuucuugcuaucgggugcuauucacaagucaaccccauaacucucauggcagcccuucucuuauugguagcacauuaugcuaucauagggccaggacuccaagcgaaagcaacuagagaggcucagaaaagagcagcagcgggcaucaugaaaaacccaacuguggauggaauaacagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcuaccgggcccaucucuacacugugggaaggaaauccagggagauuuuggaauacaacuauugcagugucaauggcuaacauuuuuagagggaguuacuuggccggagccggacuucucuuuucuaucaugaagaacacggccaacacaagaaggggaacuggcaacacaggagagacgcuuggagagaaauggaaaaaccggcugaaugcauuggggaagagugaauuccagaucuacaagaaaaguggaauccaggaaguggauagaaccuuagcaaaagaaggcaucaaaagaggagaaacggaccaucacgcugugucgcgaggcucggcaaaacugagaugguucgucgagagaaaccuggucacaccagaagggaaaguaguggaccuuggcugcggcagggggggcuggucauacuauugugggggacuaaagaauguaaaagaagucaaaggccuaacaaaaggaggaccaggacaugaagaacccauucccaugucaacauaugguuggaaucuggugcgucuucaaaguggaguugauguuuuuuuuacuccgccagaaaagugugacacauuacugugugacauaggggagucgucaccaaaccccacgguugaggcaggacgaacacucagaguucuaaacuuaguggaaaauuggcugaacaacaacacccaauuuugcauaaagguucucaacccauauaugcccucaguuauagaaaaaauggaagcgcuacaaaggaaauacggaggagcuuuggugaggaauccacucucacgaaauuccacacacgagauguacuggguauccaacgcuuccgggaacauagugucaucagugaacaugauuucaagaauguugauuaacagauucacaaugagacauaagaaggccacauacgagccagauguugaccucggaagcggaacccgcaacaucggaauugaaagugagacaccaaauuuagacauaauugggaaaagaauagagaaaauaaaacaagagcaugaaacaucauggcacuaugaccaagaccauccauacaaaacgugggccuaucaugguagcuacgagacaaaacagacuggaucagcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccgaaagaaggcacgaaaaaacuaaugaaaaucacggcaaaauggcucuggaaagaacuaggaaagaaaaagacgccuaggaugugcaccagagaagaauucacaagaaaggugagaagcaaugcagccuuaggugccauauucacugaugagaacaaguggaagucggcacgugaggcuguugaagauaguggauuuugggaauugguugacaaggaaaggaaucuccaucuugaaggaaagugugagacauguguguauaacaugaugggaaagagagagaagaagcuaggggaguucggcaaagcaaaaggcagcagagccauaugguacauguggcuuggagcacguuucuuagaguuugaagcccuaggauucuugaaugaagaucacugguuuuccagagagaacucccugaguggaguggaaggagaagggcugcacaaacuaggcuacauuuuaagagacgugaguaagaaagaaggaggagcaauguacgccgaugacaccgcaggaugggacacaagaaucacacuagaggacuuaaaaaaugaagaaauagugacaaacuacauggaaggagaacacaagaaacuugcugaagccauuuucaaauuaacguaccaaaacaagguggugcgugugcaaagacccacaccaagaggcacaguaauggacauuauaucgagaagagaccaaagagguaguggacaaguugucaccuacggccucaauacuuucaccaacauggaagcccaacugaucagacagauggagggagaaggagucuuuaaaagcauccagcaccugacagucacagaagaaauugcaguggaaaacugguuaguaagaguggggcgugagagguuaucaagaauggccaucaguggagaugauugugucgugaaacccuuagaugacagguuugcaagcgcucuaacagcucuaaaugacaugggaaagguuaggaaagacauacaacaaugggaaccuucaagaggauggaacgauuggacacaagugcccuuuuguucacaccauuuccaugaguuaaucaugaaggacggucguguacucguaguuccauguagaaaccaagaugaacugauugguagggcccgaauuucccagggagcugggugguccuugcgggaaacagccuguuuggggaaguccuacgcccaaauguggagccugauguacuuccacagacgugaccuuaggcuggcggcaaaugccauuugcucggcagucccaucacauuggguuccaacaagucgaacaaccugguccauacacgccacacaugaguggaugacaacagaagacaugcugacagucuggaacaggguguggauucaagaaaacccauggauggaagacaaaacuccaguagaaucaugggaggaaaucccauauuuggggaaaagagaagaccaauggugcggcucauugauugggcuaacaagcagggccaccugggcaaagaacauccaaacagcaauaaaucaaguuagaucccuaauaggcaaugaggaauacacagacuacaugccauccaugaaaagauucagaagagaagaggaagaggcaggagucuugugguag

SEQ ID NO: 6367 - RNA, 9876 nt, Artificial Sequence
  derived and/or modified CDS sequence (wt) from DENV-2__KF744400__SS-prME
acugcaggcaugaucauuaugcugaucccaacagugauggcguuccauuuaaccacacguaacggagaaccacacaugaucgucaguagacaagagaaagggaaaagucuucuguuuaaaacagagaauggugugaacauguguacccucauggccauggaccuuggugaauugugugaagauacaaucacguacaaguguccucuucucaggcagaaugaaccagaagacauagauuguuggugcaacucuacauccacauggguaaccuaugggacguguaccaccacaggagaacacagaagagagaaaagaucaguggcacuagucccacaugugggaaugggauuggagacgcgaacugaaacauggaugucaucagaaggggccuggaaacaugcccagagaauugaaacuuggauuuugagacauccaggcuuuaccuuaauggcagcaauccuggcauacaccauaggaacgacacauuuccaaagagcccugaucuucaucuuacugacagcugucgcuccuucaaugacaaugcguugcauaggaauaucaaacagagauuuuguagaagggguuucaggaggaagcuggguugacauagucuuagaacauggaaguugugugacgacaauggccaaaaacaaaccaacauuggauuuugaacugauaaaaacagaagcaaaagaaccugccacucuaaggaaguacuguauagaggcaaaguuaaccaacacaacaacagaaucucgcugcccaacacaaggggaacccagccuaaaugaagagcaggauaaaagguucgucugcaaacacuccaugguagacagaggauggggaaauggauguggacuauuuggaaaaggaggcauugugaccugugcuauguuuacaugcaaaaagaacauggaaggaaaaaucgugcaaccagaaaacuuggaauauaccaucgugauaacuccucauucaggggaagagcacgcaguuggaaaugacacaggaaaacauggcaaggaaaucaaaauaacaccacagaguuccaccacagaagcagaguugacaggcuauggcacagucacgauggaguguucuccaagaacgggccucgauuucaaugagaugguguuguugcaaauggaaaacaaagcguggcuggugcaccggcaaugguuccuagaccugccguugccauggcugcccggagcggacacacaaggaucaaacuggauacagaaagagacauuagucacuuucaaaaacccacaugcgaagaaacaagauguuguuguuuuaggaucccaagaaggggccaugcacacagcacuuacaggggccacagauauccagaugucaucagggaacuuacuguucacaggacaccucaagugcaggcugaggauggacaaacuacagcucaaaggaaugucauacuccaugugcacaggaaaguuuaaaguugugaaggaaauagcagaaacacaacauggaacaauaguugucagaguacaauaugaaggggacgguucuccauguaagauuccuuuugagauaauggauuuggaaaaaagacaugucuugggucgccugauuacagucaacccaauugugacagaaaaggauagcccagucaacauagaagcagaaccuccauucggagacagcuacgucaucauaggaguggagccggggcaauugaaacugaauugguuuaagaaaggaaguucuaucggccaaauguuugagacaacaaugaggggagcgaagagaauggcuauucuaggugacacagcuugggauuuuggaucccugggaggaguauucacaucuauaggaaaggcucuccaccagguuuuuggagcaaucuacggggcugccuucagcggagucucguggaccaugaaaauccucauaggagucauuaucacauggauaggaaugaauucacguagcaccucacugucuguaucacuaguauuggugggggucgugacacuguacuugggagucguggugcaggccgauagugguugcguugugagcuggaaaaacaaagaacugaaaugugguagugggauuuucaucacagacaacgugcacacauggacagaacaauacaaguuccaaccagaaucuccuucaaaacuagcuucagcuauccagaaagcucaucaagagggcauuuguggaauccgcucaguaacaagacuggaaaauuugauguggaaacaaauaacaccggaauugaaucacauuuuaucagaaaaugaggugaagcugacuaucaugacaggagauaucaaaggaaucaugcaugcaggaaaacgaucucugcggccucagcccacugagcugagguauucauggaagacauggggcaaagcgaaaauccucuccacagagucccauaaccagaccuuucucauugauggccccgaaacagcagaaugccccaacacaaacagagcuuggaauucacuggaaguugaagacuauggcuuuggaguauucaccaccaauauauggcuaaagcugagagaaaagcaggaugccuuuugcgacccaaaacucaugucagcggccauaaaagacaacagagccguccaugccgacauggguuauuggauagaaagugcacuuaaugacacauggaagauagagaaagccucuuucauugaaguuaaaaacugccacuggccaaagucacacacccuuuggagcaauggagugcuagaaagugagaugauaauuccaaaaaauuucgcuggaccagugucacaacacaacuacagaccaggcuaccauacacaaacagcaggaccauggcauuuagguaagcuugagcuggacuuugauuucugcgagggaacuacaguaguggugacugaggacuguggaaauagagggcccuccuuaagaacaaccacugccucuggaaaacucauaacagaauggugcugcagaucuugcacauuaccaccacuaagauauaaaggugaggauggaugcugguacgggauggaaauuagaccauugaaagaaaaagaagagaauuuggucagcuccuuggucacagccggacaugggcagauugacaacuucucacuaggagucuugggaauggcauuguuucuggaagaaaugcucaggacccgagugggaaugaaacaugcaauacuacuaguugcaguuucuuuugugacauuaaucacagggaacauguccuuuagagaccugggaagagugaugguuauggugggcgcuacuaugacggaugacauagguaugggcgugacuuaucuugcccuacuagcagccuucaaagucagaccaacuuuugcagcuggacuacucuugagaaaguugaccucuaaggaauugaugaugacuaccauaggaaucguacuccucucccaaaguaccauaccagagaccauucuugaacugacugaugcuuuagccuugggcaugaugguccucaaaauagugaggaaaauggaaagguaucaacuggcagugacuaucauggccaucuugugcgucccaaauucagugauauuacaaaacgcauggaaagugagcugcacaauacuggcagugguguccguuuccccacugcuuuuaacauccucacagcagaaagcggacuggauaccauuagcauugacgauuaaaggucucaauccaacagcuauauuucuaacaacccuuucacgaaccagcaagaaaaggaguuggccacuaaaugaggcuaucauggcagucgggauggugagcauuuuagccaguucacuucuaaagaaugauauucccaugacaggaccacugguggcuggagggcuccucacagugugcuacgugcucacuggacgaucggccgaccuggaauuggagaaagcugcugacgucagaugggaagaucaggcagagauaucaggaagcaguccaauccugucaguaauaguaucagaagaugguagcaugucaauaaaaaacgaagaggaagaacaaauacugaccauacucauuagaacaggauugcuggugaucucaggacuuuuuccuguaucaauaccaauuacagcagcagcaugguaccugugggaagugaagaaacaacgggcuggaguacugugggaugucccuucacccccaccugugggaaaggcugaacuggaagauggagccuauagaaucaagcagaaagggauucucggauauucccagaucggagccggaguuuacaaagaaggaacauuccauacaauguggcaugucacacguggugcuguccuaaugcauaaaggaaagaggauugagccaucaugggcggacgucaaaaaagaccuaauaucauauggaggaggcuggaaauuggaaggagaauggaaggaaggagaagaaguccagguccuggcauuggagccuggaaaaaauccaagagccguccaaacaaaaccuggucuuuucaaaaccaaugcuggaaccauaggugccguaucucuggacuuuucuccuggaacgucaggaucaccaaucauugauaaaaaaggaaagguggugggucuuuaugguaauggcguuguuacaaggaauggaucauaugugagugcuauagcccagacggaaaaaagcauugaagacaauccagagauugaagaugacauuuuucgaaagaaaagauugaccaucauggaccuccacccaggagcaggaaaaacgaaaagauaccuuccggccauagucagagaagccauaaaacggggccugaggacacuaauucuggcccccacuagaguuguggcagcugaaauggaggaagcucuuagaggacuuccaauaagauaccaaaccccagccaucagagccgagcacaccgggcgggagauuguggaccuaaugugucaugccacauucacuaugaggcugcuaucgccaauuagaguaccaaauuacaaccugauuaucauggaugaagcccauuucacagacccagcaaguauagcggccagaggauacaucucaacucgaguggaaaugggugaggcagcugggauuuucaugacagccacuccuccagggagcagagacccuuuuccccagagcaaugcaccaaucauggaugaagaaagagaaaucccugaacguucguggaauuccggacaugaauggguuacggauuuuaaagggaagacuguuugguucguuccaaguauaaaagcgggaaaugacauagcugcuugccugagaaaaaauggaaagaaagugauacaacucagcaggaaaaccuuugauucugaguaugucaagacuagaaccaaugacugggacuuugugguuacgacugacauuucagaaaugggugccaacuucaaggcugagagggucauagaucccagacgcugcaugaaaccaguuauacuaacagauggugaagagcgggugauccuggcaggacccaugccagugacccacucuagugcagcacaaagaagagggagaauaggaagaaauccaaaaaaugaaaacgaccaguacauauacaugggggaaccucuggaaaaugacgaagacugugcacacuggaaagaagccaaaaugcuccuagauaacaucaauacaccugaaggaaucauuccuaguauguucgaaccagagcgcgaaaagguggaugcuauugauggugaauaccgcuugagaggagaagcacggaaaaccuuuguagaccuaaugagaagaggagaccuaccagucugguuggccuacaagguggcagcugaaggcaucaacuacgcagacagaaggugguguuuugauggaaucaggaacaaccaaaucuuggaagaaaacguggaaguggaaaucuggacaaaagaaggggaaaggaagaaauuaaaacccagaugguuggacgccaggaucuauucugacccccuagcgcuaaaagaauucaaggaauuugcagcuggaagaaagucccugacccugaaccuuaucacagaaaugggaaggcuuccaacuuucaugacucagaaggcaagagacgcauuggauaaccuggcagugcugcacacggcugaagcagguggaagggcguacaaucaugcucucagcgaacugccggagacccuggagacacuacuuuuacugacacuucuggcuacagucacgggaggaaucuuuuuauucuugaugagcggaagagguauagggaagaugaccuuaggaaugugcugcauaaucacggccagcauccuucuaugguacgcacaaauacagccacacuggauagcagcuucaauaauauuggaauuuuuucucauaguucugcuuauuccagaaccagaaaagcagagaacaccccaagauaaccaauuaaccuacguugucauagccauccucacagugguggccgcaaccauggcaaacgagauggguuuccuggaaaaaacgaagaaagaucucggauuaggaagcauugcaacccagcaacccgagagcaacauccuggacauagaccuacguccugcaucagcauggacgcuguaugccguggcuacaacauucaucacaccaauguugagacauagcauugaaaauuccucagugaacgugucccuaacagcuauugccaaccaagccacaguguuaaugggccuugggaaaggauggccacugucaaagauggacaucggaguuccccuucucgccauuggaugcuacucacaagucaaccccauaacacucacagcagcucuucucuuauugguagcacauuacgcuaucauagggccaggacuccaagcaaaagcaaccagggaagcccagaaaagagcagcagcgggcaucaugaaaaacccaacuguugacggaauaacagcaaucgacuuagauccaauacccuaugacccaaaguuugaaaagcaguugggacaaguaaugcuccuaguccucugugugacucaaguauugaugaugaggacuacaugggcucugugugaagcuuuaacccuagcgaccgggcccauuuccacauugugggaaggaaauccagggagguuuuggaauacuaccauugcagugucaauggccaacauuuuuagaggaaguuacuuggcuggagcuggacuucucuuuuccaucaugaagaacacaaccaacacaagaaggggaacuggcaacauaggagagacgcuuggagagaaauggaaaagccgguugaacgcauuggggaaaagugaauuccagaucuacaagaaaaguggaauccaggaaguggauagaaccuuagcaaaagaaggcauuaaaagaggagaaacggaccaccacgcugugucgcgaggcucagcaaaacugagaugguucgucgagagaaacauggucacaccagaagggaaaguaguggaccuugguugcggcagaggaggcuggucauacuauuguggaggacuuaagaauguaagagaagucaaaggccugacaaaaggaggaccagggcacgaagaacccaucccuaugucuacauacggguggaaccuagugcgucuucaaaguggaguugacguuuucuucacuccgccagaaaagugcgacacauugcugugugacauaggggagucgucaccaaaucccacgguagaagcgggacguacacucagaguccucaacuuaguggaaaauugguugaacaacaacacccaauuuugcauaaagguucucaacccauacaugcccucagucauagaaaaaauggaagcacuacaaaggaaauauggaggagcuuuagugaggaauccacucucacgaaacuccacacaugaaauguacuggguauccaaugccuccgggaacauagugucaucagugaacaugauuucaaggauguugaucaacagauucacaaugaagcacaagaaagccacuuacgagccagauguugacuuaggaagcggaaccugcaauaucggaauugaaagugagguaccaaaccuggacauaaucgggaaaagaauagaaaaaauaaaacaagagcaugaaacaucauggcacuaugaccaagaccacccauacaaaacaugggcuuaccaugguagcuaugaagcaaaacaaacuggaucagcaucauccauggugaacggaguggucagacugcugacaaaaccuugggacgucauccccauggugacacagauggcuaugacagacacgacuccauuuggacaacagcgcguuuuuaaagagaaaguggacacgagaacccaagaaccgaaagaaggcacgaagaaauuaaugaaaaucacggcagaauggcuuuggaaagaacuagggaagaaaaagacaccuaggauguguacuagagaagaauucacaagaaaggugagaagcaaugcagccuugggggccauauucacugaugagaacaaguggaagucggcacgugaggcugucgaagauaguagguuuugggagcugguugacaaggaaaggaaucuccaucuugaaggaaagugugaaacauguguguacaacaugaugggaaaaagagagaagaagcuaggggaguucggcaaggcaaaaggcagcagagccauaugguauauguggcuuggagcacgguuuuuagaguuugaagcccuaggauucuugaaugaagaucacugguucuccagagagaacucccugaguggaguggaaggagaagggcuguacaagcuaggcuacauuuuaagagacgugagcaagaaagaaggaggagcaauguaugccgaugacaccgcaggaugggacacaagaaucacacuggaagaucuaaaaaaugaagaaaugguaacaaaccacauggaaggagaacacaaaaaacuagcugaggcuauuuucaaauuaacguaccaaaacaagguggugcgugugcaaagaccaacaccaagaggcacaguaauggauaucauaucgagaagagaccaaagagguagcggacaaguugguaccuauggacucaacacuuucacuaacauggaagcccaacuaaucagacagauggaaggagaaggaaucuucaaaagcauucaacacuugacagccacagaagaaaucgccgugcaaaacuggcuaacaagaguagggcgcgaaagguuaucaagaauggccaucaguggagaugauuguguugugaaacccuuagaugacagauucgcaagugccuuaacagcucuaaaugacaugggaaaggucaggaaagacauacaacaaugggaaccuucaagaggguggaaugauuggacacaggugcccuucuguucacaucauuuccaugaguuaaucaugaaagacggucgcguacuuguaguuccauguagaaaccaggaugaauugauugguagagcccgaauuucccagggagcuggauggucuuugcgggaaacagccuguuuagggaagucuuaugcccaaauguggagcuugauguacuuccacagacgugaccucaggcuggcggcaaaugcuaucugcucggcggucccaucacauuggguuccaacaaguagaacaaccugguccauacaugccaaacaugaauggaugacaacggaagacaugcugacagucuggaacaggguguggauucaagaaaauccauggauggaagacaagacuccaguggaaucaugggaggaaaucccauacuuggggaaaagagaagaccaauggugugguucauugauugggcuaacaagcagggccaccugggcaaagaacauccaaacagcaauaaaucaaguuagaucccuuauaggcaaugaggaauacacagauuacaugccauccaugaaaagauucagaagagaagaggaagaggcaggaguccugugguag

SEQ ID NO: 6368 - RNA, 9876 nt, Artificial Sequence
  derived and/or modified CDS sequence (wt) from DENV-2__KF744401__SS-prME
acugcaggcaugaucauuaugcugaucccaacagugauggcguuccauuuaaccacacguaacggagaaccacacaugaucgucaguagacaagagaaagggaaaagucuucuguuuaaaacagagaauggugugaacauguguacccucauggccauggaccuuggugaauugugugaagauacaaucacguacaaguguccucuucucaggcagaaugaaccagaagacauagauuguuggugcaacucuacauccacauggguaaccuaugggacguguaccaccacaggagaacacagaagagagaaaagaucaguggcacuagucccacaugugggaaugggauuggagacgcgaacugaaacauggaugucaucagaaggggccuggaaacaugcccagagaauugaaacuuggauuuugagacauccaggcuuuaccuuaauggcagcaauccuggcauacaccauaggaacgacacauuuccaaagagcccugaucuucaucuuacugacagcugucgcuccuucaaugacaaugcguugcauaggaauaucaaacagagauuuuguagaagggguuucaggaggaagcuggguugacauagucuuagaacauggaaguugugugacgacaauggccaaaaacaaaccaacauuggauuuugaacugauaaaaacagaagcaaaagaaccugccacucuaaggaaguacuguauagaggcaaaguuaaccaacacaacaacagaaucucgcugcccaacacaaggggaacccagccuaaaugaagagcaggauaaaagguucgucugcaaacacuccaugguagacagaggauggggaaauggauguggacuauuuggaaaaggaggcauugugaccugugcuauguuuacaugcaaaaagaacauggaaggaaaaaucgugcaaccagaaaacuuggaauauaccaucgugauaacuccucauucaggggaagagcacgcaguuggaaaugacacaggaaaacauggcaaggaaaucaaaauaacaccacagaguuccaccacagaagcagaguugacaggcuauggcacagucacgauggaguguucuccaagaacgggccucgauuucaaugagaugguguuguugcaaauggaaaacaaagcguggcuggugcaccggcaaugguuccuagaccugccguugccauggcugcccggagcggacacacaaggaucaaacuggauacagaaagagacauuagucacuuucaaaaacccacaugcgaagaaacaagauguuguuguuuuaggaucccaagaaggggccaugcacacagcacuuacaggggccacagaaauccagaugucaucagggaacuuacuguucacaggacaccucaagugcaggcugaggauggacaaacuacagcucaaaggaaugucauacuccaugugcacaggaaaguuuaaaguugugaaggaaauagcagaaacacaacauggaacaauaguugucagaguacaauaugaaggggacgguucuccauguaagauuccuuuugagauaauggauuuggaaaaaagacaugucuugggucgccugauuacagucaacccaauugugacagaaaaggauagcccagucaacauagaagcagaaccuccauucggagacagcuacgucaucauaggaguggagccggggcaauugaaacugaauugguuuaagaaaggaaguucuaucggccaaauguuugagacaacaaugaggggagcgaagagaauggcuauucuaggugacacagcuugggauuuuggaucccugggaggaguauucacaucuauaggaaaggcucuccaccagguuuuuggagcaaucuacggggcugccuucagcggagucucguggaccaugaaaauccucauaggagucauuaucacauggauaggaaugaauucacguagcaccucacugucuguaucacuaguauuggugggggucgugacacuguacuugggagucguggugcaggccgauagugguugcguugugagcuggaaaaacaaagaacugaaaugugguagugggauuuucaucacagacaacgugcacacauggacagaacaauacaaguuccaaccagaaucuccuucaaaacuagcuucagcuauccagaaagcucaucaagagggcauuuguggaauccgcucaguaacaagacuggaaaauuugauguggaaacaaauaacaccggaauugaaucacauuuuaucagaaaaugaggugaagcugacuaucaugacaggagauaucaaaggaaucaugcaugcaggaaaacgaucucugcggccucagcccacugagcugagguauucauggaagacauggggcaaagcgaaaauccucuccacagagucccauaaccagaccuuucucauugauggccccgaaacagcagaaugccccaacacaaacagagcuuggaauucacuggaaguugaagacuauggcuuuggaguauucaccaccaauauauggcuaaagcugagagaaaagcaggaugccuuuugcgacccaaaacucaugucagcggccauaaaagacaacagagccguccaugccgacauggguuauuggauagaaagugcacuuaaugacacauggaagauagagaaagccucuuucauugaaguuaaaaacugccacuggccaaagucacacacccuuuggagcaauggagugcuagaaagugagaugauaauuccaaaaaauuucgcuggaccagugucacaacacaacuacagaccaggcuaccauacacaaacagcaggaccauggcauuuagguaagcuugagcuggacuuugauuucugcgagggaacuacaguaguggugacugaggacuguggaaauagagggcccuccuuaagaacaaccacugccucuggaaaacucauaacagaauggugcugcagaucuugcacauuaccaccacuaagauauaaaggugaggauggaugcugguacgggauggaaauuagaccauugaaagaaaaagaagagaauuuggucagcuccuuggucacagccggacaugggcagauugacaacuucucacuaggagucuugggaauggcauuguuucuggaagaaaugcucaggacccgagugggaaugaaacaugcaauacuacuaguugcaguuucuuuugugacauuaaucacagggaacauguccuuuagagaccugggaagagugaugguuauggugggcgcuacuaugacggaugacauagguaugggcgugacuuaucuugcccuacuagcagccuucaaagucagaccaacuuuugcagcuggacuacucuugagaaaguugaccucuaaggaauugaugaugacuaccauaggaaucguacuccucucccaaaguaccauaccagagaccauucuugaacugacugaugcuuuagccuugggcaugaugguccucaaaauagugaggaaaauggaaagguaucaacuggcagugacuaucauggccaucuugugcgucccaaauucagugauauuacaaaacgcauggaaagugagcugcacaauacuggcagugguguccguuuccccacugcuuuuaacauccucacagcagaaagcggacuggauaccauuagcauugacgauuaaaggucucaauccaacagcuauauuucuaacaacccuuucacgaaccagcaagaaaaggaguuggccacuaaaugaggcuaucauggcagucgggauggugagcauuuuagccaguucacuucuaaagaaugauauucccaugacaggaccacugguggcuggagggcuccucacagugugcuacgugcucacuggacgaucggccgaccuggaauuggagaaagcugcugacgucagaugggaagaucaggcagagauaucaggaagcaguccaauccugucaguaauaguaucagaagaugguagcaugucaauaaaaaacgaagaggaagaacaaacacugaccauacucauuagaacaggauugcuggugaucucaggacuuuuuccuguaucaauaccaauuacagcagcagcaugguaccugugggaagugaagaaacaacgggcuggaguacugugggaugucccuucacccccaccugugggaaaggcugaacuggaagauggagccuauagaaucaagcagaaagggauucucggauauucccagaucggagccggaguuuacaaagaaggaacauuccauacaauguggcaugucacacguggugcuguccuaaugcauaaaggaaagaggauugagccaucaugggcggacgucaaaaaagaccuaauaucauauggaggaggcuggaaauuggaaggagaauggaaggaaggagaagaaguccagguccuggcauuggagccuggaaaaaauccaagagccguccaaacaaaaccuggucuuuucaaaaccaaugcuggaaccauaggugccguaucucuggacuuuucuccuggaacgucaggaucaccaaucauugauaaaaaaggaaagguggugggucuuuaugguaauggcguuguuacaaggaauggaucauaugugagugcuauagcccagacggaaaaaagcauugaagacaauccagagauugaagaugacauuuuucgaaagaaaagauugaccaucauggaccuccacccaggagcaggaaaaacgaaaagauaccuuccggccauagucagagaagccauaaaacggggccugaggacacuaauucuggcccccacuagaguuguggcagcugaaauggaggaagcucuuagaggacuuccaauaagauaccaaaccccagccaucagagccgagcacaccgggcgggagauuguggaccuaaugugucaugccacauucacuaugaggcugcuaucgccaauuagaguaccaaauuacaaccugauuaucauggaugaagcccauuucacagacccagcaaguauagcggccagaggauacaucucaacucgaguggaaaugggugaggcagcugggauuuucaugacagccacuccuccagggagcagagacccuuuuccccagagcaaugcaccaaucauggaugaagaaagagaaaucccugaacguucguggaauuccggacaugaauggguuacggauuuuaaagggaagacuguuugguucguuccaaguauaaaagcgggaaaugacauagcugcuugccugagaaaaaauggaaagaaagugauacaacucagcaggaaaaccuuugauucugaguaugucaagacuagaaccaaugacugggacuuugugguuacgacugacauuucagaaaugggugccaacuucaaggcugagagggucauagaucccagacgcugcaugaaaccaguuauacuaacagauggugaagagcgggugauccuggcaggacccaugccagugacccacucuagugcagcacaaagaagagggagaauaggaagaaauccaaaaaaugaaaacgaccaguacauauacaugggggaaccucuggaaaaugacgaagacugugcacacuggaaagaagccaaaaugcuccuagauaacaucaauacaccugaaggaaucauuccuaguauguucgaaccagagcgcgaaaagguggaugcuauugauggugaauaccgcuugagaggagaagcacggaaaaccuuuguagaccuaaugagaagaggagaccuaccagucugguuggccuacaagguggcagcugaaggcaucaacuacgcagacagaaggugguguuuugauggaaucaggaacaaccaaaucuuggaagaaaacguggaaguggaaaucuggacaaaagaaggggaaaggaagaaauuaaaacccagaugguuggacgccaggaucuauucugacccccuagcgcuaaaagaauucaaggaauuugcagcuggaagaaagucccugacccugaaccuuaucacagaaaugggaaggcuuccaacuuucaugacucagaaggcaagagacgcauuggauaaccuggcagugcugcacacggcugaagcagguggaagggcguacaaucaugcucucagcgaacugccggagacccuggagacacuacuuuuacugacacuucuggcuacagucacgggaggaaucuuuuuauucuugaugagcggaagagguauagggaagaugaccuuaggaaugugcugcauaaucacggccagcauccuucuaugguacgcacaaauacagccacacuggauagcagcuucaauaauauuggaauuuuuucucauaguucugcuuauuccagaaccagaaaagcagagaacaccccaagauaaccaauuaaccuacguugucauagccauccucacagugguggccgcaaccauggcaaacgagauggguuuccuggaaaaaacgaagaaagaucucggauuaggaagcauugcaacccagcaacccgagagcaacauccuggacauagaccuacguccugcaucagcauggacgcuguaugccguggcuacaacauucaucacaccaauguugagacauagcauugaaaauuccucagugaacgugucccuaacagcuauugccaaccaagccacaguguuaaugggccuugggaaaggauggccacugucaaagauggacaucggaguuccccuucucgccauuggaugcuacucacaagucaaccccauaacacucacagcagcucuucucuuauugguagcacauuacgcuaucauagggccaggacuccaagcaaaagcaaccagggaagcccagaaaagagcagcagcgggcaucaugaaaaacccaacuguugacggaauaacagcaaucgacuuagauccaauacccuaugacccaaaguuugaaaagcaguugggacaaguaaugcuccuaguccucugugugacucaaguauuggugaugaggacuacaugggcucugugugaagcuuuaacccuagcgaccgggcccauuuccacauugugggaaggaaauccagggagguuuuggaauacuaccauugcagugucaauggccaacauuuuuagaggaaguuacuuggcuggagcuggacuucucuuuuccaucaugaagaacacaaccaacacaagaaggggaacuggcaacauaggagagacgcuuggagagaaauggaaaagccgguugaacgcauuggggaaaagugaauuccagaucuacaagaaaaguggaauccaggaaguggauagaaccuuagcaaaagaaggcauuaaaagaggagaaacggaccaccacgcugugucgcgaggcucagcaaaacugagaugguucgucgagagaaacauggucacaccagaagggaaaguaguggaccuugguugcggcagaggaggcuggucauacuauuguggaggacuuaagaauguaagagaagucaaaggccugacaaaaggaggaccagggcacgaagaacccaucccuaugucuacauacggguggaaccuagugcgucuucaaaguggaguugacguuuucuucacuccgccagaaaagugcgacacauugcugugugacauaggggagucgucaccaaaucccacgguagaagcgggacguacacucagaguccucaacuuaguggaaaauugguugaacaacaacacccaauuuugcauaaagguucucaacccauacaugcccucagucauagaaaaaauggaagcacuacaaaggaaauauggaggagcuuuagugaggaauccacucucacgaaacuccacacaugaaauguacuggguauccaaugccuccgggaacauagugucaucagugaacaugauuucaaggauguugaucaacagauucacaaugaagcacaagaaagccacuuacgagccagauguugacuuaggaagcggaacccgcaauaucggaauugaaagugagguaccaaaccuggacauaaucgggaaaagaauagaaaaaauaaaacaagagcaugaaacaucauggcacuaugaccaagaccacccauacaaaacaugggcuuaccaugguagcuaugaagcaaaacaaacuggaucagcaucauccauggugaacggaguggucagacugcugacaaaaccuugggacgucauccccauggugacacagauggcuaugacagacacgacuccauuuggacaacagcgcguuuuuaaagagaaaguggacacgagaacccaagaaccgaaagaaggcacgaagaaauuaaugaaaaucacggcagaauggcuuuggaaagaacuagggaagaaaaagacaccuaggauguguacuagagaagaauucacaagaaaggugagaagcaaugcagccuugggggccauauucacugaugagaacaaguggaagucggcacgugaggcugucgaagauaguagguuuugggagcugguugacaaggaaaggaaucuccaucuugaaggaaagugugaaacauguguguacaacaugaugggaaaaagagagaagaagcuaggggaguucggcaaggcaaaaggcagcagagccauaugguauauguggcuuggagcacgguuuuuagaguuugaagcccuaggauucuugaaugaagaucacugguucuccagagagaacucccugaguggaguggaaggagaagggcuguacaagcuaggcuacauuuuaagagacgugagcaagaaagaaggaggagcaauguaugccgaugacaccgcaggaugggacacaagaaucacacuggaagaucuaaaaaaugaagaaaugguaacaaaccacauggaaggagaacacaaaaaacuagcugaggcuauuuucaaauuaacguaccaaaacaagguggugcgugugcaaagaccaacaccaagaggcacaguaauggauaucauaucgagaagagaccaaagagguagcggacaaguugguaccuauggacucaacacuuucacuaacauggaagcccaacuaaucagacagauggaaggagaaggaaucuucaaaagcauucaacacuugacagccacagaagaaaucgccgugcaaaacuggcuaacaagaguagggcgcgaaagguuaucaagaauggccaucaguggagaugauuguguugugaaacccuuagaugacagauucgcaagugccuuaacagcucuaaaugacaugggaaaggucaggaaagacauacaacaaugggaaccuucaagaggguggaaugauuggacacaggugcccuucuguucacaucauuuccaugaguuaaucaugaaagacggucgcguacuuguaguuccauguagaaaccaggaugaauugauugguagagcccgaauuucccagggagcuggauggucuuugcgggaaacagccuguuuagggaagucuuaugcccaaauguggagcuugauguacuuccacagacgugaccucaggcuggcggcaaaugcuaucugcucggcggucccaucacauuggguuccaacaaguagaacaaccugguccauacaugccaaacaugaauggaugacaacggaagacaugcugacagucuggaacaggguguggauucaagaaaauccauggauggaagacaagacuccaguggaaucaugggaggaaaucccauacuuggggaaaagagaagaccaauggugugguucauugauugggcuaacaagcagggccaccugggcaaagaacauccaaacagcaauaaaucaaguuagaucccuuauaggcaaugaggaauacacagauuacaugccauccaugaaaagauucagaagagaagaggaagaggcaggaguccugugguag

SEQ ID NO: 6369 - RNA, 9876 nt, Artificial Sequence
  derived and/or modified CDS sequence (wt) from DENV-2__KF744402__SS-prME
acugcaggcaugaucauuaugcugauuccaacagugauggcguuccauuuaaccacacguaacggagaaccacacaugaucgucaguagacaagagaaagggaaaagucuucuguuuaaaacagaggauggugugaacauguguacccucauggccauggaccuuggugaauugugugaagauacaaucacguauaaguguccucuucucaggcagaaugaaccagaagacauagauuguuggugcaacucuacaucuacauggguaaccuaugggacguguaccaccacaggagaacacagaagagagaaaagaucaguggcacuagucccacaugugggaaugggauuggagacacgaacugaaacauggaugucaucagaaggggccuggaaacaugcccagagaauugaaacuuggauuuugagacauccaggcuuuaccuuaauggcagcaauccuggcauacaccauaggaacgacaaauuuccaaagagcucugaucuucaucuuauugacagcugucgcuccuucaaugacaaugcguugcauaggaauaucaaacagagauuuuguagaagggguuucaggaggaagcuggguugacauagucuuagaacauggaagcugugugacgacaauggccaaaaacaaaccaacauuggauuuugaacugauaaaaacagaagccaaacauccugccacuuuaaggaaguauuguauagaggcaaagcugaccaacacaacaacagaaucucgcugcccaacacaaggggaacccagccuaaaugaagagcaggauaaaagguucgucugcaaacacuccaugguagacagaggauggggaaauggauguggacuauuuggaaaaggaggcauugugaccugugcuauguucacaugcaaaaagaacauggaaggaaaaaucgugcaaccagaaaacuuggaauauaccaucgugauaacaccucacucaggggaagagcacgcaguuggaaaugacacaggaaaacacggcaaggaaauuaaaguaacaccacagaguuccaucacagaagcagaacugacaggcuauggcacagucacgauggagugcucuccgaggacgggccucgauuucaaugagaugguguuguugcaaauggaaaacaaagcuuggcuggugcaccggcaaugguuccuagaucugccguugccauggcugcccggagcggacacacaaggaucaaauuggauacagaaagagacauuagucacuuucaaaaauccccaugcgaagaaacaagauguuguuguuuuaggaucccaagaaggggcuaugcauacagcacucacaggggccacagaaauccagaugucaucaggaaacuuacuguucacaggacaucucaagugcagacugaggauggacaaacuacagcucaaaggaaugucauacuccauguguacaggaaaguuuaaaguugugaaggaaauagcagaaacacaacauggaacaauagucgucagaguacaauaugaaggggacgguucuccauguaagauucccuuugagauaauggauuuggaaaaaagacaugucuugggccgccugaucacagucaacccaauugugacagaaaaggauagcccagucaacauagaagcagaaccuccauucggagacagcuacgucaucauaggaguggagccggggcaauugaagcugaauugguuuaagaaaggaaguucuaucggccaaauguuugagacaacaaugaggggagcgaagagaauggcuauucuaggugacacagcuugggauuuuggaucucugggaggaguauucacaucuauaggaaaggcucuccaccagguuuuuggagcaaucuacggcgcugccuucagcggggucucguggacuaugaaaauccucauaggagucauuaucacauggauaggaaugaauucacguagcaccucacugucuguaucacuaauauuggugggagucguaacacuguaccugggagucguggugcaggccgauagugguugcguugugagcuggagaaacaaagaacugaaaugugguagugggauuuucaucacagacaacgugcacacguggacagaacaauacaaguuccaaccagaaucucccucaaaacuagcuucagcuauccagaaagcucaucaagagggcauuuguggaauccgcucaguaacaagacuggaaaauuugauguggaaacaaauaacaccggaauugaaucacauucuaucagaaaaugaggugaagcugaccaucaugacaggagauaucaaaggaaucaugcaugcaggaaaacgaucuuugcggccucagcccacugagcugagguauucguggaaaacauggggcagagcgaaaauccucucuacagagucccauaaccagaccuuccucauugauggccccgaaacagcagaaugccccaacacaaacagagcuuggaacucacuugaaguugaagacuauggcuuuggaguauucaccaccaauauauggcugaagcugaaagaaaggcaggauguauuuugugacucaaaacucaugucagcagccauaaaagacaacagggccguccaugccgacauggguuauuggauagaaagugcacucaaugacacauggaagauagagaaagccucuuucaucgaaguuaaaagcugccacuggccaaagucacacacccucuggagcaauggagugcuagaaagugagaugauaauuccaaagaauuuugcuggaccagugucacaacacaacuacagaccaggcuaccauacacaaacagcaggaccauggcauuuagguaagcuugagauggacuuugauuucugcgagggaacuacagugguggugacugaggacuguggaaauagaggacccuccuuaagaacaaccacugccucuggaaaacucauaacagaauggugcugcagaucuugcacauuaccaccgcuaagguacagaggugaggauggaugcugguauggaauggaaaucagaccauugaaagagaaagaagagaacuuggucaacucuuuggucacagccggacaugggcagauugacaacuucucauuaggagucuugggaauggcauuguuucuggaagaaaugcucaggacccgaguaggaacgaaacauacaauacuacuaguugcaguuucuuuugugacauugaucacagggaacauguccuuuagagaccuggggagagugaugguuauggugggcgcuacuaugacggauaacauagguaugggcgugacuuaucuugcccuacuagcagccuucaaagucagaccaacuuuugcagcuggacuacucuugagaaaguugaccucuaaggaauugaugaugacuaccauaggaauuguacuccucucucagagcaccauaccagagacuauacucgaacugacugacgcgcuggcuuuggggaugaugguucucaaaauagugagaaacauggaaaaguaucaacuagcagugacuaucauggccaucuugugcgucccaaaugcagugauauuacaaaacgcauggaaagugagcugcacaauauuggcagugguguccguuuccccacuguuauuaacauccucacagcagaaagcggauuggauaccauuagcauuaacgauuaaaggucucaauccaacagcuauauuucuaacaacccuuucacgaaccagcaagaaaaggagcuggccacuaaaugaggcuaucauggcagucgggauggugagcauuuuagccaguucacucuuaaaaaaugacauucccauuacaggaccauuaguagcuggagggcuucucacuguguguuacgugcucacuggaagaucggcugauuuggaacuggagagagcugcugacguaagaugggaagaacaggcagagauaucgggaaguaguccaauccugucaauaauaauaucagaggauggcagcaugucaauaaaaaacgaagaggaagaacaaacacugaccauacucauuagaacaggauugcuggugauaucaggacuuuuucccguaucaauaccaauuacggcagcagcaugguacuugugggaagugaagaaacaacgggcuggaguauugugggauguuccuucacccccaccugugggaaaagcugaacuggaagauggagccuacagaaucaagcaaaaagggauucucggauauucccagaucggagccggaguuuacaaagaaggaacauuccauacaauguggcaugucacacguggugcuguucuaaugcauaaaggaaagaggauugagccaucaugggcggacgucaaaaaagaccuaauaucauauggaggaggcuggaaacuagagggggaauggaaggaaggagaagaaguccagguccuggcauuggaaccuggaaaaaauccaagagccguccaaacaaaacccggucuuuucaaaaccaaugccggaaccauaggugccguaucucuggacuuuuccccuggaacgucaggaucaccaaucauugacaaaaaaggaaaggugguaggacuuuaugguaacggcguuguuacaaggaauggaucauaugugagugcuauagcccagacgggaaaaagcauugaagacaauccagagauugaagaugacauuuuucgaaagaaaagacugaccaucauggaccuccacccaggagcaggaaagacgaaaagauaccuuccagcaauagucagagaagccauaaaacgaggcuugaggacauuaauucuggcccccacuagaguuguggcagcugaaauggaggaagcucuuaggggacucccaauaagauaccaaacccccgccaucagagcugagcacacugggcgggagauuguggaucuaaugugucacgccacauuuaccaugaggcugcuauccccaauuagaguaccaaauuacaaccugauuaucauggaugaagcccauuucacagacccagcaaguauagcggccagaggauacauuucaacucgaguggaaaugggugaggcagcugggauuuucaugacagccacuccuccggggagcagagacccauuuccccagagcaaugcaccaaucauggaugaagaaagagaaaucccugaacguucguggaauuccggacaugaauggguuacggauuuuaaagggaagacuguuugguucguuccaaguauaaaagcaggaaaugacauagcagcuugccugagaaaaaauggaaagaaagugauacaacucagcaggaaaaccuuugauucugaguaugucaagacuagaaccaaugacugggacuuugugguuacaacugacauuucagaaaugggugccaacuucaaggcugagagggucauagaucccagacgcugcaugaaaccaguuauacuaacagauggugaagagcgggugauccuagcaggacccaugccagugacccacucuagugcagcacaaagaagagggagaauaggaagaaauccaaaaaaugaaaacgaccaguacauauacaugggggaaccucuggaaaacgacgaagaccacgcacacuggaaagaagcuaaaaugcuccuagauaacaucaauacaccugaaggaaucauuccuaguauguucgaaccagagcgcgaaaagguggaugccauugauggugaauaccgcuugagaggagaagcgaggaaaacuuuuguagaccuaaugagaagaggagaccuaccagucugguuggccuacaagguggcagcugaagguaucaacuacgcagacagaaggugguguuuugauggaaucaggaacaaccaaauccuggaagaaaauguggaaguggaaaucuggacaaaagaaggagaaaggaagaaauuaaaacccagauggcuggacgcuaggaucuauucugacccauuagcgcuaaaagaauucaaggaauucgcagcuggaagaaagucccugacccugaaccuaaucacagaaaugggaaggcuuccaacuuucaugacucagaaggcaagagacgcauuggacaaccuggcagugcugcacacggcugaagcagguggaagggcguacaaucaugcucuuagugaacugccggagacccuggagacauugcuuuuacugacacucuuggccacagucacgggcggaaucuuccuauucuugaugagcggaaaaggcauagggaagaugacccugggaaugugcugcauaaucacggccaguguucuccuaugguacgcacaaauacagccacacuggauagcagcuucaauaauacuggaauuuuuccucauaguucugcuuauuccagaaccagaaaagcagagaacaccccaagauaaccaauugaccuacguugucauagccauccucacagugguggccgcaaccauggcaaacgagauggguuuccuggaaaaaacgaagaaagacuucggauugggaagcauugcaacccagcaacccgagagcaacauccuggacauagaucuacguccugcaucagcauggacgcuguaugccguggccacaacauucaucacaccaauguugagacauagcauugaaaauuccucagugaacgugucccuaacagcuauugccaaccaagccacaguguuaaugggucuugggaaaggauggccacugucaaagauggacaucggaguuccccuucucgccauuggaugcuacucacaagucaaccccauaacacucacagcagcucuucucuuauugguagcacauuacgcuaucauagggccaggacuccaagcaaaagcaaccagagaagcucagaaaagagcagcagcgggcaucaugaaaaauccaacuguugauggaauaacaguaaucgacuuagauccaauacccuaugauccaaaguuugaaaaacaguugggacaaguaaugcuccuaguccucugugugacucaaguauugaugaugaggacuacaugggcucugugugaagcuuuaaccuuagcgacagggcccauuuccacauugugggaaggaaauccagggagguuuuggaauacaacuauugcaguaucaauggcuaacauuuuuagagggagcuaccuggccggagccggacuucucuuuuccaucaugaagaacacaaccaacacaagaaggggaacuggcaacauaggagagacgcuuggagaaaaauggaaaagccgguugaacgcauuggggaaaagugaauuccagaucuacaagaaaaguggaauccaggaaguggauagaacauuagcaaaagaaggcauuaaaagaggagaaacggaccaucacgcugugucgcgaggcucagcaaaacugagaugguucgucgagagaaauauggucacaccagaagggaaaguaguggaccuugguuguggcagaggaggcuggucauacuauugugggggacuaaagaaugugagagaagucaaaggccuaacaaagggaggaccaggacacgaagaacccauucccaugucaacauaugguuggaaccuggugcgucuucaaaguggaguugauguuuuuuuuacuccgccagaaaagugugacacacuacugugugacauaggggagucgucaccaaaccccacgguugaggcaggacgaacacucagaguucuaaaccuaguggaaaauuggcugaacaacaacacccaauuuugcaucaagguucucaacccauauaugcccucaguuauagaaaaaauggaagcgcugcaaaggaaauacggaggagcuuuggugaggaauccacucucacgaaauuccacacacgagauguacuggguauccaaugcuuccgggaacauagugucaucagugaacaugauuucaagaauguugauuaacagauucacaaugagacauaagaaggccacauacgagccagauguugaccucggaagcggaacccguaacaucggaauugaaagugagguaccaaaccuggacauaauugggaaaagaauagaaaaaauaaaacaagagcaugaaacaucauggcacuaugaccaagaucacccauacaaaacaugggcuuaucaugguagcuaugaaacaaaacaaacuggaucagcaucauccauggugaacggaguggucagacugcugacaaaaccuugggacgucauccccauggugacacagauggcuaugacagacacgacuccauuuggacaacagcgcgucuuuaaagagaaaguggacacgagaacccaagaaccgaaagaaggcacaaagaaauuaaugaaaauuacggcagaauggcuuuggaaagaacuagggaagaaaaagacaccuaggauguguacuagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugaaacauguguguacaacaugaugggaaaaagagagaagaagcuaggggaguucggcaaggcaaaaggcagcagagccauaugguauauguggcucggagcacguuuuuuagaguuugaagcccuaggauucuugaaugaagaucacugguucuccagagagaacucccugaguggaguggaaggagaagggcugcacaagcuaggcuacaucuuaagagacgugagcaagaaagagggaggagcaauguaugccgaugacaccgcaggaugggacacaagaaucacacuggaagaucuaaaaaaugaagaaaugguaacaaaccacauggaaggagaacacaagaaacuagcugaggcuauuuucaaauuaacguaccaaaacaagguggugcgugugcaaagaccaacaccaagaggcacaguaauggauaucauaucgagaagagaccaaagagguagcggacaaguugguaccuacggccucaacacuuucacuaacauggaagcccaacuaaucagacagauggaaggagaaggagucuucaaaagcauucagcaccugacggccacagaagaaaucgccgugcaaaacuggcuagcaagaguagggcgcgaaagguuaucaagaauggccaucaguggagaugacuguguugugaaacccuuagaugacagauucgcaagugcucuaacagcuuuaaaugacaugggaaaggucaggaaagacauacaacaaugggaaccuucaagaggguggaaugauuggacacaggugcccuucuguucacaucauuuccaugaguuaaucaugaaagacggucgcguacuuguaguuccauguagaaaccaagaugaauugauugguagagcccgaauuucccagggagccggguggucuuugcgggaaacagccuguuuggggaagucuuacgcccaaauguggagccugauguacuuccacagacgugaccucaggcuggcggcaaaugcuaucugcucggcggucccaucacauuggguuccaacaaguagaacaaccugguccauacaugccaaacaugaauggaugacaacggaagacaugcugacagucuggaacaggguguggauucaagaaaauccauggauggaagacaagacuccaguggaaucaugggaggaaaucccauacuuggggaaaagagaagaccaauggugcggcucauugauugggcuaacaagcagggccaccugggcaaagaacauccaaacagcaauaaaucaaguuagaucccuuauaggcaaugaggaauacacagauuacaugccauccaugaaaagauucagaagagaagaggaagaggcaggaguccugugguag

SEQ ID NO: 6370 - RNA, 9876 nt, Artificial Sequence
  derived and/or modified CDS sequence (wt) from DENV-2__KF744408__SS-prME
acugcaggcaugaucauuaugcugauuccaacagugauggcguuccauuuaaccacacguaacggagaaccacacaugaucgucaguagacaagagaaagggaaaagucuucuguucaaaacagaggauggugugaacauguguacccucauggccauggaccuuggugaauugugugaagauacaaucacguauaaguguccucuucucaggcagaaugaaccagaagacauagauuguuggugcaacucuacauccacauggguaaccuaugggacguguaccaccacaggagaacacagaagagagaaaagaucaguggcacuagucccacaugugggaaugggauuggagacacgaacugaaacauggaugucaucagaaggggccuggaaacaugcccagagaauugaaacuuggauuuugagacauccaggcuuuaccuuaauggcagcaauccuggcauacaccauaggaacgacaaauuuccaaagagcccugaucuucaucuuacugacagcugucgcuccuucaaugacaaugcguugcauaggaauaucaaacagagauuuuguagaagggguuucaggaggaagcuggguugacauagucuuagaacauggaagcugugugacgacaauggccaaaaacaaaccgacauuggauuuugaacugauaaaaacggaagccaaacaucccgccacuuuaaggaaguauuguauagaggcaaagcugaccaacacaacaacagcaucucgcugcccaacacaaggggaacccagccuaaaugaagagcaggauaaaagguucgucugcaaacacuccaugguagacagaggauggggaaauggauguggacuauuuggaaaaggaggcauugugaccugugcaauguuuacaugcaaaaagaacauggaaggaaaaaucgugcaaccagaaaacuuggaauauaccaucgugauaacaccucacucaggggaagagcacgcaguuggaaaugacacagggaaacauggcaaggaaaucaaaauaacaccacagaguuccaucacagaagcagaacugacaggcuauggcacugucacgauggaaugcucuccgagaacgggccucggcuuuaaugagaugguguugcugcaaauggaagacaaggcuuggcuggugcaccggcaaugguuccuagaucugccguugccauggcugcccggagcggacacacaaggaucaaauuggauacagaaagagacauuagucacuuucaaaaauccccaugcgaagaaacaagauguuguuguuuuaggaucccaagaaggggcuaugcauacagcacucacaggggccacagaaauccagaugucaucagggaacuuacuguucacaggacaucucaaguguaggcugaggauggacaaacuacagcucaaaggaaugucauacuccaugugcacaggaaaguuuaaaguugugaaggaaauagcagaaacacaacauggaacaauagucgucagaguacaauaugaaggggacgguucuccauguaagauuccuuuugagauaauggauuuggaaaaaagacaugucuuaggucgccugaucacagucaacccaauugugacagaaaaggauagcccagucaacauagaagcagaaccuccauucggagacagcuacgucaucauaggaguagagccggggcaacugaagcucagcugguuuaagaaaggaaguucuaucggccaaauguuugagacaacaaugaggggagcgaagagaauggcuauucuaggugacacagcuugggauuuuggaucccugggaggaguauucacaucuauaggaaaggcccuccaccaggucuuuggagcaaucuauggggcugccuuuagcgggguuucauggacuaugaaaauccucauaggagucauuaucacauggauaggaaugaauucacguagcaccucacugucuguaucacuaguauuggugggagucgugacacuguaucugggaguuguggugcaggccgauagugguugcguugugagcuggagaaacaaagaacugaaaugugguagugggauuuucaucacagacaacgugcacacguggacagaacaauacaaguuccaaccagaaucccccucaaaacuagcuucagcuauccagaaagcucaucaagagggcauuuguggaauccgcucaguaacgagacuggaaaauuugauguggaaacaaauaacaccggaauugaaucacauucuaucagaaaaugaggugaaguugacuaucaugacaggagauaucaaaggaaucaugcaggcaggaaaacgaucuuugcggccucagcccacugagcugagguauucauggaaaacauggggcaaagcgaaaauccucucuacagagucccauaaccagaccuuccucauugauggccccgaaacagcagaaugccccaacacaaacagagcuuggaacucacuugaaguugaagacuauggcuuuggaguauucaccaccaauauauggcuaaggcugagagaaaagcaggaugcauuuugcgacucaaaacucaugucagcggccauaaaagacaacagagccguccaugccgacauggguuauuggauagaaagugcacucaaugacacauggaagauagagaaagccucuuucaucgaaguuaaaagcugccacuggccaaagucacacacccucuggagcaauggagugcuagaaagugagaugauaauuccaaagaauuucgcuggaccagugucacaacacaauuacagaccaggcuaccauacacaaacggcaggacccuggcaucuagguaagcuugagauggauuuugauuucugcaagggaacuacagugguagugacugaggacuguggaaauagaggacccucuuuaagaacaacuacugcuucuggaaaacucauaacagaauggugcugccgaucuugcacauuaccaccgcuaagguacagaggugaggauggaugcugguauggaauggaaaucaggccauugaaagagaaagaagagaaccuggucaacucuuuggucacagccggacaugggcagauugacaacuucucauuaggagucuugggaauggcauuguuucuggaagaaaugcucaggacccgaguaggaacgaaacaugcaauacuacuaguugcaguuucuuuugugacauugaucacagggaacauguccuuuagagaccugggaagagugaugguuauggugggcgcuacuaugacggaugacauagguaugggcgugacuuaucuugcccuacuagcagccuucaaagucagaccaacuuuugcagcuggacuacucuugagaaaguugaccucuaaggaauugaugaugacuaccauaggaaucguacuccucucccaaagcaccauaccagagacuauacucgaacugacugacgcgcuggcuuuggggaugaugguucucaaaauagugagaaacauggaaaaguaucaacuggcagugacuauuauggcuaucuugugcgucccaaaugcagugauauuacaaaacgcauggaaagugagcugcacaauauuggcagugguguccguuuccccacugcuauuaacauccucacagcagaaagcggauuggauaccauuagcauuaacgauuaaaggucucaauccaacagcuauauuucuaacaacccuuucacgaaccagcaagaaaaggagcuggccacuaaaugaggcuaucauggcagucgggauggugagcauuuuagccaguucacuucuaaaaaaugacauucccaugacaggaccauugguggcuggagggcuccucacaguaugcuaugugcucacuggacgaucggccgauuuggaauuggagaaagcugcugacgucagaugggaagaucaggcagagauaucaggaaguaguccaauccuaucaauaauaauaucagaagauggcagcaugucaauaaaaaacgaagaggaagaacaaacacugaccauacucauuagaacaggacugcuggugaucucaggacuuuuuccuguaucaauaccaaucacggcagcagcaugguaccugugggaagugaagaaacaacgggcuggaguauugugggaugucccuucacccccaccugugggaaaagcugaacuggaagauggagccuacagaaucaagcaaaaagggauucucggauauucccagaucggagccggaguuuacaaagaaggaacauuccauacaauguggcacgucacacguggugcuguucuaaugcauaaaggaaagaggauugagccaucaugggcggacgucaaaaaagaccuaauaucauauggaggaggcuggaaacuagaaggagaauggaaggaaggagaagaaguccagguccuggcauuggaaccuggaaaaaauccaagagccguccaaacaaaacccggucuuuucaaaaccaaugccggaaccauaggugccguaucucuggacuuuuccccuggaacgucaggaucaccaaucauugacaaaaaaggaaaggugguaggacuuuaugguaacggcguuguuacaaggaauggaucauaugugagugcuauagcccagacggaaaaaagcauugaagacaauccagagauugaagaugacauuuuucgaaagaaaagauugaccaucauggaccuccacccaggagcaggaaagacgaaaagauaccuuccggccauagucagagaagccauaaaacgaggcuugaggacacuaauccuggcccccacuagaguuguggcagcugaaauggaggaagcucuuaggggacucccaauaagauaccaaacccccgccaucagagccgagcacaccgggcgggagauuguggaccuaaugugucaugccacauuuaccaugaggcugcuaucgccaauuagaguaccaaauuacaacuugauuaucauggaugaagcccauuucacagacccagcaaguauagcagcuagaggauacauuucaacucgaguugagaugggugaggcagcugggauuuucaugacagccacuccuccggggagcagagacccauuuccccagagcaaugcaccaaucauggaugaagaaagagaaaucccugaacguucguggaauuccggacaugaauggguuacggauuuuaaagggaagacuguuugguucguuccaaguauaaaagcaggaaaugacauagcagcuugccugagaaaaaauggaaagaaagugauacaacucagcaggaaaaccuuugauucugaguaugucaagacuagaaccaaugacugggacuuugugguuacaacugacauuucagaaaugggugccaacuucaaggcugagagggucauagaucccagacgcugcaugaaaccaguuauacuaacagacggugaagagcgggugauccuagcaggacccaugccagugacccauucuagugcagcacaaagaagagggagaauaggaagaaauccaaaaaaugaaaacgaccaguacauauauaugggggaaccucuggaaaacgacgaagacugugcacacuggaaagaagcuaaaaugcuccuagauaacaucaauacaccugaaggaaucauuccuaguauguucgaaccagagcgcgaaaagguggaugcuauugauggugaauaccgcuugagaggagaagcacggaaaaccuuuguagaccuaaugagaagaggagaccuaccagucugguuggccuacaagguggcagcugaaggcaucaacuacgcagacagaaggugguguuuugauggaaucaggaacaaccaaauccuggaagaaaauguggaaguggaaaucuggacaaaagaaggagaaaggaagaaauuaaaacccagauggcuggacgcuaggaucuauucugacccauuagcgcuaaaagaauucaaggaauuugcagcuggaagaaagucccugacccugaaccuaaucacagaaaugggaaggcuuccaacuuucaugacucagaaagcaaggaacgcacuagacaacuuagcaguccugcauacggcugaagcaggcggaagggcguacaaucaugcucuuagugaacugccggagacccuggagacauugcuuuuacugacacucuuggccacagucacgggcggaaucuuccuauucuugaugagcggaaaaggcauagggaagaugaccuuaggaaugugcugcauaaucacggccaguguucuccuaugguacgcacaaauacagccacacuggauagcagcuucaauaauacuggaauuuuuccucauaguucugcuuauuccagaaccagaaaagcagagaacaccccaagauaaccaauugaccuacguugucauagccauccucacagugguggccgcaaccauggcaaacgagauggguuuccuggaaaaaacgaagaaagaucucggauuaggaagcauuacaacccagcaacccgagagcaacauccuggacauagaucuacguccugcaucagcauggacgcuguaugccguggccacaacauucaucacaccaauguugagacauagcauugaaaauuccucagugaacgugucccuaacagcuauugccaaccaagccacaguguuaaugggucuugggaaaggauggccacugucaaagauggacaucggaguuccccuucucgccauuggaugcuacucacaagucaaccccauaacacucacagcagcucuucucuuauugguagcacauuacgcuaucauagggccaggacuccaagcaaaagcaaccagagaagcucagaaaagagcagcagcgggcaucaugaaaaauccaacuguugauggaauaacaguaaucgaccuagauccaauacccuaugauccaaaguuugaaaagcaguugggacaaguaaugcuccuaguccucugugugacucaaguauugaugaugaggacuacaugggcucugugugaagcuuuaaccuuagcgacagggcccauuuccacauugugggaaggaaauccagggagguuuuggaacacuaccauugcagugucaauggcuaacauuuuuagagggagcuaccuggccggagccggacuucucuuuuccaucaugaagaacacaaccaacacaagaaggggaacuggcaacauaggagagacgcuuggagaaaaauggaaaagccgguugaacgcauuggggaaaagugaauuccagaucuacaagaaaaguggaauccaggaaguggauagaacauuagcaaaagaaggcauuaaaagaggagaaacggaccaucacgcugugucgcgaggcucagcaaaacugagaugguucgucgagagaaauaugaucacaccagaagggaaaguaguggaccuugguugcggcagaggaggcuggucauacuauugugggggacuaaagaauguaagagaagucaaaggccugacaaagggaggaccaggacacgaagaacccauucccaugucaacauaugguuggaaccuggugcgucuucaaaguggaguugauguuuuuuuuacuccgccagaaaagugugacacacuacugugugacauaggggagucgucaccaaaccccacgguugaggcaggacgaacacucagaguucuaaaccuaguggaaaauuggcugaacaacaacacccaauuuugcaucaagguucucaacccauauaugcccucaguuauagaaaaaauggaagcgcugcaaaggaaauacggaggagcuuuggugaggaauccacucucacgaaacuccacacaugagauguacuggguauccaaugccuccgggaacauagugucaucagugaacaugauuucaaggauguugaucaacagauucacaaugaaacacaagaaagccaccuacgagccagauguugaccuaggaagcggaacccgcaacauuggaauugaaagugagguaccaaaccuggacauaauugggaaaagaauagaaaaaauaaaacaagagcaugaaacaucauggcacuaugaccaagaucacccauacaaaacaugggcuuaccaugguagcuacgaaacaaaacaaacuggaucagcaucauccauggugaacggaguggucagacugcugacaaaaccuugggacgucauccccauggugacacagauggcuaugacagacacgacuccauuuggacaacagcguguuuuuaaagagaaaguggacacgagaacccaagaaccgaaagaaggcacaaagaaauuaaugaaaaucacggcagaauggcuuuggaaagaacuagggaagaaaaagacaccuaggauguguacuagagaagaguucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugaaacauguguguacaacaugaugggaaaaagagagaagaagcuaggggaguucggcaaggcaaaaggcagcagagccauaugguauauguggcuuggagcacguuuuuuagaguuugaagcccuaggauucuugaaugaagaucacugguucuccagagagaacucccugaguggaguggaaggagaagggcugcacaagcuaggcuacaucuuaagagacgugagcaagaaagagggaggagcaauguaugccgaugacaccgcaggaugggacacaagaaucacacuggaagaucuaaaaaaugaagaaaugguaacaaaccacauggaaggagaacacaagaaacuagcugaggcuauuuucaaauuaacguaccaaaacaagguggugcgugugcaaagaccaacaccaagaggcacaguaauggauaucauaucaagaagagaccaaagagguagcggacaaguugguaccuacggacucaacacuuucacuaauauggaagcccaacuaaucagacagauggaaggagaaggagucuuuaaaagcauucagcaccugacggccacagaagaaauugccgugcaaaacuggcuagcaagaguagggcgcgaaagguuaucaagaauggccaucaguggagaugacuguguagugaaacccuuagaugacagauucgcaagugcuuuaacagcucuaaaugacaugggaaaagucaggaaagacauacaacaaugggaaccuucaaaaggguggaacgauuggacacaggugcccuuuuguucacaccauuuccaugaguuaaucaugaaagacggucgcguacuuguaguuccaugcagaaaccaagaugaauugauugguagggcccgaauuucccagggagcuggauggucuuugcgggaaacagccuguuuggggaagucuuacgcccaaauguggagccugauguacuuccacagacgugaccuuaggcuggcggcaaaugccauuugcucggcagucccaucacauuggguuccaacaaguagaacaaccugguccauacaugccaaacaugaauggaugacaacggaagacaugcugacagucuggaacaggguguggauucaagaaaauccauggauggaagacaagacuccaguggaaucaugggaggaaaucccauacuuggggaaaagagaagaccaauggugcgguucauugauugggcuaacaagcagggccaccugggcaaagaacauccaaacagcaauaaaucaaguuagaucccuuauaggcaaugaggaauacacagauuacaugccauccaugaaaagauucagaagagaagaggaagaggcaggaguccugugguag

SEQ ID NO: 6371 - RNA, 9876 nt, Artificial Sequence
  derived and/or modified CDS sequence (wt) from DENV-2__JX669476__SS-prME
acagcaggcgugauuguuauguugauuccaacagcaauggcguuccauuuaaccacacguaauggagaaccacacaugaucguugguaggcaagagaaagggaaaagucuucuguucaaaacagaggaugguguuaacauguguacccucauggccauagaccuuggugaguugugugaagauacaaucacguacaaguguccccuccucagacaaaaugaaccagaagacauagauuguuggugcaacucaacguccacauggguaacuuaugggacauguaccaccacaggagaacacagaagagaaaaaagaucaguggcgcucguuccacauguggguaugggacuggagacacgaacugaaacauggaugucaucagaaggggccuggaagcauguucagagaauugaaaccuggaucuugagacauccagguuuuaccauaauggcagcgauccuggcauacaccauaggaacgacacacuuccaaagggccuugauuuucaucuuacugacagcugucgcuccuucaaugacaaugcgcugcauaggaauaucaaauagagacuucguagaagggguuucaggaggaagcuggguugacaucguuuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaaaucguacagucagaaaauuuggaauacaccaucgugauaacaccucacucaggagaagagcacgcuguagguaaugacacaggaaagcacggcaaggaaaucaaaauaacaccacagaguuccaccacagaagcagaacugacaggcuauggcacugucacgauggagugcucuccgagaacgggccucgacuucaaugagauggugcugcugcagauggaagacaaagcuuggcuggugcacaggcaaugguuccuagaccugccguugccauggcuacccggagcggauacacaaggaucaaauuggauacagaaagagacauuggucacuuucaaaaauccccacgccaagaaacaggaugucguugucuuagggucucaagaaggggccaugcacacggcacucacaggggcuacagaaauccagaugucaucaggaaacuuacuguucacgggacaucucaagugcaggcugaggauggacaaacuacagcucaaaggaaugucauacucuauguguacagggaaguuuaaaaucgugaaggaaauagcagaaacacaacauggaacaauaguuaucagaguacaauaugaaggggacgguucuccauguaagaucccuuuugagauaacagauuuggaaaaaagacacgucuuaggacgccugauuacaguuaacccaaucguaacagaaaaagauagcccagucaacauagaagcagaacccccauucggagacagcuacaucaucguaggaguagagccgggacaacugaaacucaauugguuuaagaagggaaguuccaucggccaaauguuugagacaacaaugagaggagcaaagagaauggccauuuuaggugacacagccugggauuuuggaucucugggaggaguguuuacaucuauaggaaaggcucuccaucaaguuuucggagcaaucuauggggcugcuuuuaguggggucucauggacuaugaaaauccucauaggagucaucaucacauggauaggaaugaauucacguagcaccucacugucugugucgcuaguauuggugggagucgugacacuguaccugggagcuauggugcaggcugauagugguugcauugugagcuggaaaaauaaagaacugaaauguggcagcgggaucuucauuacagauaacguacacacauggacagagcaauauaaguuccaaccagaauucccuucaaaacuagcuucagcuauucaaaaagcucaugaagaaggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaaagauccuugcggccucagcccacugagcugaaguacucauggaaaacauggggaaaggcgaaaaugcucucuacagagucucacaaccagaccuuucuuauugauggcccugaaacagcagaaugccccaacacaaacagagcuuggaacucacuggaaguugaagacuaugguuuuggaguuuuuaccaccaauauauggcuaaaauugagagaaaaacaggauguauuuugugacucaaaacucaugucagcggccauuaaagacaacagagccguccaugccgauauggguuauuggauagaaagugcacucaaugacacauggaagguggagaaagccuccuucauugaaguuaaaagcugccacuggccaaagucacacacccucuggagcaauggaguauuagaaagugagaugauaauuccaaaaaauuuugccgggccagugucacaacauaacuacagaccaggcuaccauacacaaacagcaggaccuuggcaucuagguaagcuugagauggacuuugauuucugcgaaggaacuacagugguggugacugaggacuguggaaauagaggacccucuuuaagaacgaccacugccucuggaaagcucauaacagaauggugcugccgauccugcacacuaccaccucuaagauacagaggugaggauggaugcugguacgggauggaaaucagacccuugaaagagaaagaagagaacuuggucaacuccuuggucacagccggacaugggcagauugacaacuuuucacuaggagucuugggaauggcacuguuccuggaagaaaugcuuaggacccgaguaggaacgaaacaugcaauacugcuaguugcacuaucuuucgugacauugauaacugggaacaugucuuuuagagaccugggaagagugauggucauggugggcgcuaccaugacggaugacauagguaugggagugacuuaucuugcccuacuagcagcuuucaaaguuagaccaacuuuugcagcuggacuacucuugagaaaacugaccuccaaggaauugaugauggccaccauaggaaucgcacuccuuucccaaagcaccuugccagagaccauucuagaacugacugaugcguuagccuugggcaugauggcccucaaaauagugagaaauauggaaaaauaccaauuggcagugacuaucauggcuauuucgugugucccaaaugcagugauauugcaaaacgcauggaaggugaguugcacaauauuggcagcgguguccguuucuccacugcuccuaacauccucacagcagaaaacggauuggauaccauuggcauugacgauaaaaggucucaacccaacagccauuuuucuaacaacucuuucgagaaccagcaagaaaaggagcuggccgcuaaaugaagcuaucauggcagucgggauggugagcauuuuagccaguucucuccuaaagaaugauauuccuaugacagguccauuaguggcuggagggcuccucaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucauuagaacgggauuguuggugaucucaggagucuuuccaguaucgauaccaauuacggcagcagcaugguaccugugggaagugaagaaacaacgggcuggaguauugugggacgucccuucacccccaccaguggaaaaggccgaacuggaagauggagccuauagaaucaagcaaagagggauucuuggauauucucagauuggagccggaguuuacaaagaaggaacauuccauacaauguggcacgucacacguggugcuguucugaugcauagagggaagaggauugaaccaucaugggcagaugucaagaaagauuuaauaucauauggaggaggcuggaagcuagaaggagaauggaaggaaggagaggaaguccaaguccuggcauuggaaccuggaaaaaaucccagagcuguccaaacgaaaccuggaauuuucaaaaccaacaccggaaccauaggcgcuguaucucuggacuuuuccccuggaacgucaggaucuccaauugucgacagaaaaggaaaaguugugggucuuuacgguaaugguguugucacaaggaguggagcauacguaagugccauagcccagaccgaaaaaagcauugaagacaauccagagaucgaagaugacauuuuccgaaagaaaagauugaccaucauggaccuccauccaggggcaggaaagacaaaaagauaccuuccagccauaguuagagaagccauaaaacguggcuugagaacauuaauccuggcucccacuagagucguggcagcugaaauggaggaagcucuuagaggacuuccaauaagauaccaaaccccagccaucagagccgagcacaccgggcgagagaucguggaccuaaugugucaugccacauuuacuaugaggcugcuaucaccagucagagugccaaauuacaaccugauuaucauggacgaagcccacuucacagacccagcaagcauagcagcuagaggauacauuucaacucgaguagagaugggugaagcagccgggauuuucaugacagccacuccuccggggagcagagacccauuuccucagagcaaugcaccaaucauggaugaggaaagagaaaucccugagcguucauggaauucaggacaugaaugggucacggauuuuaaagggaagacuguuugguuuguuccaaguauaaaagcaggaaaugacauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagagggucauagacccuagacgcugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucucgaaaaugaugaagacugugcacacuggaaagaagcuaaaaugcuccuagauaacaucaacacacccgaaggaaucauuccuagcauguucgaaccagagcgugaaaagguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauguggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagaaacgcacuggacaacuuggcugugcugcauacggcugagguagguggaagggcguacacucaugcucucagugaacugccggagacucuggagacacugcuucuacugacacuccuggcagcagucacaggaggaaucuucuuauucuuaaugagcggaaaagguauagggaagaugacucugggaauguguugcauaaucacagcuagcauucuccuaugguaugcacagauacaaccacauuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgaaauggguuuccuggaaaaaaccaagaaagaccucggauuuggaagcauuacaacccaggaaucugagagcaacauccuggacauagaucuacguccugcaucagcauggacgcuguaugccguggcuacaacauuugucacaccaauguugcgacauagcauugaaaauuccucaguaaaugucucccuaacagccauugcuaaccaagccacagugcuaaugggucuugggaaaggauggccauugucaaagauggacauuggaguuccccuccuugccauuggaugcuacucacaagucaacccuauaacccucacagcagcucuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaacaccaccauugcagugucaauggcuaacaucuuuagggggagcuacuuggccggagcuggacuucucuuuuccaucaugaagaacacaacaaacacaagaagaggaacuggcaacguaggagagacacuuggagaaaaauggaaaagccgauuaaaugcacugggaaaaagugaauuucagaucuacaagaaaaguggaauccaggaaguggauagaacccuagcaaaagaaggcaucaaaagaggagaaacggaccaccaugcugugucacgaggaucagcaaaauugagaugguucgucgagagaaacauggucacaccggaagggaaggugguggaucuugguugcggcagagggggcuggucauacuauugcgggggacuaaagaauguaagagaagucaaaggccuaacaaaaggaggaccaggacacgaagaacccauccccaugucaacauauggguggaaucuagugcgucugcaaaguggggucgacguuuucuucaccccgccagaaaagugugauacauuguugugugacauaggggagucgucaccaaaucccacgauagaagcaggacgaacacucagaguccucaacuuaguggaaaauuggcugaacaauaacacccaauuuugcauaaagguccucaauccauauaugcccucagucauagaaaaaauggaaacacuacaaaggaaauauggaggagccuuagugaggaauccacucucacgaaacuccacgcaugaaauguacuggguaucuaaugcuaccgggaacauagugucaucagugaacaugauuucaaggauguugauuaacagauucacaaugaaacauaagaaagccaccuacgagccagauguugaccuaggaaguggaacccgcaacauuggaauugaaagugagauaccaaaccuagacauaauaggaaagagaauagagaaaauaaaacaagagcaugaaauaucauggcauuaugaccaagaccacccauacaaaacgugggcuuaccauggcagcuaugaaacaaaacaaacugggucagcaucaucuauggugaacggaguggucagacugcugacaaaaccuugggacgucgucccuauggugacacagauggcaaugacagacacgacuccauuuggacaacagcgcguuuucaaagagaaaguggacacgagaacucaagaaccgaaggaaggcacaaagaaacugaugaaaauuacggcagaguggcuuuggaaagaacuaggaaaggaaaagacaccuagaauguguaccagagaagaauucacaagaaaagugagaagcaaugcagccuugggggccguauucacugaugagaacaaauggaaaucggcacgugaggcuguugaagaugauagguuuugggagcuaguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuucugaaugaagaucacugguucuccagagggaacucccugaguggaguggaaggagaagggcugcacaggcuaggcuacauuuuaagagaggugggcaagaaggaaggaggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaaaagaccaaagaggcagugggcaagucgguaccuauggccuuaauacuuucaccaauauggaagcccaauuaauuagacagauggaaggagaaggaaucuucaaaagcauucagcaccugaccgccacagaagaaaucgcuguacagaacugguuagcaagaguggggcgugaaaggcuaucaagaauggccaucaguggagaugacuguguuguaaaaccuauagaugacagauuugcaagugcuuuaacagcucuaaaugacaugggaaaaguuaggaaagauauacaacaaugggaaccuucaagaggauggaacgauuggacacaggugccuuucuguucacaccauuuucaugaguuagucaugaaagauggucgcgugcucguagucccaugcagaaaccaagaugaacugauuggcagagcccgaauuucccagggagccggguggucuuugaaggagacggcuuguuuggggaagucuuacgcccaaauguggacccugauguacuuccacagacgugaccucagacuggcggcaaaugccauuugcucggcagucccgucacauuggguuccaacaagucgaacaaccugguccauacacgccaagcaugaauggaugacgacggaagacaugcugacagucuggaacaggguguggauccaagaaaacccauggauggaagacaaaacuccaguggaaucaugggaagaagucccauaccugggaaaaagggaagaccaauggugcggcucauugauugggcuaacaagcagggcuaccugggcaaagaauauccagacagcaauaaaucaagucagaucccuuauaggcaaugaaggauacacagacuacaugccauccaugaagagauucagaagagaagaggaagaggcagguguccugugguag

SEQ ID NO: 6372 - RNA, 9876 nt, Artificial Sequence
  derived and/or modified CDS sequence (wt) from DENV-2__JX475906__SS-prME
acuguaggcaugaucaucaugcugauuccaacagcgauggcguuccauuuaaccacacgcaauggagaaccacacaugaucgucagcagacaagagaaagggaaaagucucuuguuuaaaacagaggauggugugaacauguguacccucauggccauggaccuuggugaacugugugaagacacagucacuuauaacuguccucuucucaggcagaaugaaccagaagacauagacugcuggugcaacuccacguccacauggguaacuuaugggacaugcacugccacaggagaacacagaagggaaaaaagaucaguggcacucgucccacaugugggaaugggauuggagacacgaacugaaacauggaugucaucagaaggggccuggaaacacgcccagagaauugaaaccuggaucuugagacauccagguuuuaccauaauggcagcaaucuuggcauacaccauaggaacaacauauuuccaaagaguccugauuuucaucuuacugacagcugucgcuccuucaaugacaaugcgcuguauaggaauaucaaacagagacuuuguggaagggguuucaggaggaagcuggguugacauagucuuagaacauggaagcugugugacaacgauggcaaaaaacaaaccaacauuggacuuugagcugauaaaaacagaagccaagcaaccugccacucuaaggaaguacuguauagaggcaaagcugaccaacacaacaacagcaucucgaugcccaacacaaggggaacccagccuaaacgaagagcaggacaaaagguuugucugcaaacauuccaugguagacagaggauggggaaauggauguggauuauuuggaaaaggaggcaucgugaccugugccauguucacaugcaaaaaaaacauggaagggaaaaucgugcaaccagaaaaccuggaauacaccauugugauaacaccucacucaggggaagagaaugcaguuggaaaugacacaggaaaacauggcaaggaagucaaaguaacaccacagaguuccauuacagaagcagaacugacaggcuauggcaccgucacgauggagugcucuccgagaacgggccuugacuucaaugagaugguguugcugcaaauggaaaacaaagcuugguuggugcacaggcaaugguucuuagaccugccguuaccauggcugcccggagcggacacacaaggaucaaauuggauacagaaggagacauuggucaccuucaaaaauccccaugcgaagaaacaggauguuguuguuuuaggaucucaagaaggggcuaugcauacagcacuuacaggggccacggaaauccagaugucaucaggaaaccuacuguucacaggacaucucaagugcaggcugagaauggacaaacuacagcucaaaggaaugucauacucuauguguacaggaaaguuuaaaguuguaaaggaaauagcagaaacacaacauggaacaauaguuaucagaguacaauaugaaggggaugguucuccauguaaaaucccuuuugagauaauggaccuggaaaaaagacaugucuuaggucgccugauuacagucaacccaauugucacagaaaaagacagcccagucaacauagaagcagaaccuccauucggagacagcuacaucauuauaggaguagaaccgggacaacugaagcucagcugguuuaagaaaggaagcucaaucggccaaauguucgagacaacaaugagaggagcgaagagaauggcuauuuuaggugacacagccugggauuuuggaucccugggaggaguguucacaucuauaggaaaggcccuccaccaaguuuuuggagcaaucuauggggcugccuucaguggggucucauggaccaugaaaauccucauaggaguugucaucacauggauaggaaugaauucacgcagcaccucacuguccgugucguuaguauuagugggagucgugacauuguauuugggagucauggugcaggcugauagugguuguguugugaguuggaaaaacaaagaacugaaauguggcagcgggaucuuuaucacagacaauguacacacauggacagaacaauacaaauuccaaccagaaucccccucaaagcuggcuucagccauccaaaaagcucaugaagagggcauuuguggaauccgcucaguaacaagacuggagaaucuaauguggaaacaaauaacaccagaacugaaccacauucuaucagaaaaugagguaaaguugacuaucaugacaggagacaucaaaggaaucaugcaggcaggaaagcggucccugcggccucagcccacugagcugaaguauucauggaaaacauggggcaaagcgaaaaugcucuccacagagccucauaaccagaccuuucucauugauggccccgaaacagcagaaugucccaacacaaacagagcuuggaacucacuagaaguugaagacuauggcuuugggguauucaccaccaacauauggcugaaguugaaagaaaggcaggauguguuuugugacucaaaacucaugucggcagccauaaaagacaacagagccguccaugccgauauggguuauuggauagaaagcgcgcuuaaugacacauggaagauagaaaaagccuccuucaucgaaguuaaaagcugccacuggccaaaaucacacacucucuggagcaauggagugcuagaaagugagaugauaauuccaaagaauuuugcuggaccaguaucacaacacaauuacagaccaggcuaucacacacaaacggcaggacccuggcaucuaggcaagcuugagauggacuuugauuuuugugaaggaaccacagugguggugacugaggacuguggaaauagaggacccucucuaagaacaacuaccgcuucuggaaaacucauaacagaaugguguugccgauccugcacauuaccaccgcuaagauacagaggugaggauggaugcugguacggaauggaaaucagaccauugaaagagaaagaagagaaccuggucaacucuuuggucacagccggacacggacagauugacaacuucucgcuaggagucuugggaauggcauuguuccuggaagaaaugcucaggacccgaguaggaacaaaacaugcauuauuacuaguugcaguuucuuucaugacauugaucacagggaauaugucuuuccgagaccuggggagagugaugguuauggugggggcugcuaugacggacgacauagguaugggcgugacuuaucuugccuuauuagcagccuucaaaguuagaccaacuuuugcagcuggacuacuuuuaagaaagcugaccuccaaggaauugaugaugaccaccauaggaauuguacuucucucccagagcaccauaccagagacuauacuugaacugacugaugcguuggccuugggcaugaugauucucaaaauagugagaaauauggagaaguaucaauuagcagugaccaucauggcuauuuuauguguuccaaaugcagugauacuacaaaaugcauggaaagugagcugcacaauacuggcagugguguccguuuccccacugcucuuaacauccucacggcagaaagcggacuggauaccauuggcauugacgaucaagggucucaauccaacagccauuuuccuaacaacccuuucaagaaccaacaagaaaaggaguuggccacuaaaugaggcuaucauggcagucgggauggugagcauuuuagccaguucucuccuaaagaaugacauucccaugacaggaccacuaguggcuggagggcuucucacuguguguuacgugcucacuggaagaucggcugauuuggaacuggagagagcugccgacguaagaugggaagaucaggcagagauaucgggaaguaguccaauucugucaauaacaauaucggaagauggcagcaugucaauaaaaaaugaagaggaagaacaaacacugaccauacucauuagaacaggauugcuggugauaucaggacuuuuucccguaucaauaccaaucacggcagcagcaugguaccugugggaagugaagaaacaacgggccggaguguugugggauguuccuucacccccacccgugggaaaggccgaauuggaagauggagccuauagaaucaagcagaaagggauucuuggauacucccagaucggagcuggagucuacaaagaaggaacauuccacacaauguggcacgucacacguggugcuguucuaaugcauaaagggaagaggauugaaccaucaugggcggaugucaggaaagaccuaauaucguauggaggaggcuggaagcuagaaggagaauggaaggaaggagaagaaguccagguuuuggcauuggagccuggaaagaauccaagagccguccaaacaaaacccggucuuuuuaagacuaacaccggaaccauaggcgcuguaucucuagacuuuucuccuggaacgucaggaucuccaaucgucgacaaaaaaggaaaagucgugggucuuuaugguaaugguguugucacuagaaguggaacauaugugagcgccauagcccaggcugaaaaaagcauugaagacaauccagagauugaagaugacaucuuucggaaaagaagauugaccauuauggaccuccacccaggagcgggaaagacgaaaagauaccuuccagcaauagucagagaggccauaaaacgaggcuugagaacauuaauccuggccccuacuagagucguggcagcugaaauggaggaagcucuuagaggacuuccaauaagauaccaaaccccagccaucagagcugagcacacugggcgagaaaucguggauuuaaugugucaugccacauuuaccaugaggcugcugucaccaguuagagugccaaauuacaaccugaucauuauggaugaagcccauuucacagacccagcgagcauagcagcuagaggauacauuucaacucgaguagagaugggugaagcagcugggauuuuuaugacagccacuccuccgggaagcagagacccauuuccucagagcaaugcaccaaucauggaugaggaaagggaaaucccugaacguucguggaauucuggacaugaauggguuacggauuuuaaagggaagacuguuugguuuguuccgaguauaaaagcaggaaaugauauagcagcuugccugaggaaaaauggaaagaaagugauacaacucaguaggaagaccuuugauucugaauacaucaagacuaggaccaaugauugggacuuuguggucacgacugacauuucagaaaugggugcuaacuucaaggcugaaaggguuauagaccccaggcgcugcaugaaaccagucauacuaacagacggugaagagcgggugaucuuggcaggacccaugccagugacccacucuagugcagcacaaagaagagggagaauaggaaggaauccaaaaaaugaaaaugaccaguacauauacaugggggaaccucuggaaaaugaugaagacugugcacacuggaaagaagcuaagaugcuucuagacaacaucaacacgccugaaggaaucauucccagcauguuugaaccagagcgugaaaagguggaugccauugauggugaguaccgcuuaagaggagaagcgaggaaaaccuuuguggaccuaaugagaagaggagaccuaccagucuggcuggccuacagaguggcagccgaaggcauuaacuaugcagacagaaggugguguuuugauggagucaagaacaaccaaaucuuggaagaaaauguggaaguggaaaucuggacaaaagaaggagaaaggaagaaauugaaacccaggugguuggaugcuaggaucuauucugacccgcuggcgcucaaagaauucaaagaguuugcagccggaagaaaaucccugacccugaaucuaaucacagaaauggguaggcuuccaacuuuuaugacccagaaagcaaggaaugcacuggauaacuuagcaguccugcacacagcugaagcaggcggaagagcguacaaucaugcucucagugaacugccggagacccuggagacauugcuuuugcugacgcuuuuggcuacagucacgggcggaaucuuuuuauuuuugaugagcggaaaagguauagggaaaaugacucugggaaugugcugcauaaucacggccaguauucuccuaugguacgcacagauacagccacacuggauagcagcuucaauaauacuggaguuuuuucucauaguuuugcuuauuccagaaccagaaaagcagagaacaccccaagacaaccaauuaacuuacguugucauagccauccucacagugguggccgcaaccauggcaaacgagaugggguuucuggaaaaaacgaagaaagauuucggauugggaagcauugcaacccagcagcccgagagcaacauccuggacauagaucuacgcccugcaucagcauggacccuguaugccguggccacaacauuuaucacaccaaugcugagacauaguauugaaaauuccucagugaaugugucucuaacagccauugccaaccaagccacagugcuaaugggucuugggaaaggauggccauugucaaaaauggacauuggaguuccucuucucgccauugggugcuauucacaagucaaccccauaacucucacagcagcccuucuuuuauugguagcacauuaugccaucauagggccaggacuccaagcgaaagcaaccagagaagcgcagaaaagagcagcagcaggcaucaugaaaaacccaacuguggauggaauaacagugauugaccuagacccaauacccuaugauccaaaauuugagaaacagcugggacaagugaugcuccuaguccucugcgugacucaaguacugaugaugaggacuacaugggcuuugugugaggcucuaaccuuagcgaccgggcccauuuccacauugugggaaggaaauccagggagauuuuggaauacaacuauugcagugucaauggcuaacauuuuuagaggaaguuacuuggcuggagcuggacuucucuuuuccaucaugaagaacacaaccaacacaagaaggggaacuggcaacacaggagagacgcuuggagagaaauggaaaaaccgauugaaugcauuagggaagagugaauuccagauuuacaagaaaagcggaauucaggaaguggauagaaccuuggcaaaagagggcaucaaaagaggagaaacagaccaucacgcugugucgcgaggcucagcaaagcugagaugguucgucgagagaaaccuggucacaccagaagggaaaguaguggaccucgguugcggcagagggggcuggucauacuauugugggggccuaaagaauguaagagaagucaaaggccuaacaaaaggagggccaggacaugaagaaccuauucccaugucaacauauggguggaaucuagugcgucuucaaaguggaguugauguuuucuuuacuccgccagaaaagugugauacauuguugugugacauaggggagucgucaccaaaucccacgguugaagcaggacgaacacucagaguccuaaacuugguggaaaauuggcugaacaacaacacccaauuuugcauaaagguucucaacccauacaugcccucagucauagagaaaauggaagcgcugcaaaggaaauacggaggagcuuuggugaggaauccacucucaagaaauuccacacaugagauguauuggguauccaaugcuuccgggaacauagugucaucagugaacaugauuucaaggauguugauuaacagauucacaaugagacauaagaaggccacauacgagccagauguugaccucggaagcggaacccgcaacaucggaauugaaagugagacaccaaaccuagacauaauuggaaaaagaauagaaaaaauaaaacaagagcaugaaacaucauggcacuaugaucaagaccacccauauaaaacgugggccuaccauggcagcuacgaaacaaaacagacuggaucagcaucauccauggugaauggagugguuagacugcugacaaaaccuugggacgucauccccauggugacacagauggcaaugacagacacgaccccauuuggacaacagcguguuuuuaaagagaaaguggacacgagaacccaagaaccaaaagaaggcacgaagaaacuaaugaaaaucacggccgaauggcucuggaaggaauuaggaaagaaaaagacaccuaggaugugcacuagagaagaauucacaagaaaggugagaagcaaugcagcccuaggugccauauucacugaugagaacaaguggaagucugcacgugaggcuguugaagacaguagauuuugggaacugguugacaaggaaaggaaucuccaucuugaaggaaagugugaaacauguguguacaauaugaugggaaagagagagaagaaacuaggggaauucggcaaagcaaaaggcaguagagccauaugguacauguggcuuggagcacgcuucuuggaguuugaagcccuaggauucuugaaugaagaucacugguuuucuagagagaacucuuugaguggaguggaaggagaagggcugcacaagcuggguuacauucuaagagaugugagcaagaaagaaggaggagcaauguacgccgaugacacugcaggaugggacacaagaaucacacuagaggacuuaaaaaaugaagaaauggugacaaaccacauggaaggagaacacaagaaacuugcugaggccaucuucaaauuaacguaccaaaacaagguggugcgugugcaaagaccgacaccaagaggcacaguaauggauauuauaucgagaagagaccaaagaggaaguggacaaguuggcaccuauggccucaacacuuucaccaauaugggagcccaauuaaucagacagauggagggagaaggagucuuuaaaagcauccagcaccugacagcuacagaagaaauugcagugcaagacugguuagcaagaguggggcgugagagguuaucaagaauggcuaucaguggagaugauuguguugugaaacccuuagaugacagguuugcaagcgcuuuaacggcucuaaaugacaugggaaagguuaggaaagacauacaacaaugggaaccuucaagaggauggaacgauuggacacaggugccuuucuguucacaccauuuccaugagcuaaucaugaaagauggucguguacucguuguuccauguagaaaccaagaugaacugauuggcagagcccgaauuucccagggagccggguggucuuugcgggagacggccugucugggaaagucuuacgcccaaauguggagccugauguacuuucacagacgugaccucaggcuggcggcaaacgcuauuugcucggcagucccaucacacuggguuccaacaagucgaacaaccugguccauacacgccaaacaugaauggaugacaacagaagacaugcugacagucuggaacaggguguggauucaagaaaacccauggauggaagacaaaacuccaguggaaucaugggaggaaaucccauacuugggaaaaagagaagaccaauggugcggcucauugauagggcuaacaagcagggcuaccugggcaaagaacauccaaacagcaauaaaccaagucagauccuuaauaggcaaugaggaauacacagacuauaugccauccaugaaaagauucagaagagaagaggaagaggcaggggucuugugguag

SEQ ID NO: 6373 - RNA, 9876 nt, Artificial Sequence
  derived and/or modified CDS sequence (wt) from DENV-2__JX669477__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaguugugugaagauacaaucacguacaaguguccccuccucagacaaaaugaaccagaagacauagauuguuggugcaacucuacguccacauggguaacuuaugggacauguaccaccacaggagaacacagaagagaaaaaagaucaguggcgcuuguuccacauguggguaugggacuggagacacgaacugaaacauggaugucaucagaaggggccuggaagcauguucagagaauugaaaccuggaucuugagacauccagguuuuaccauaauggcagcgauccuggcauacaccauaggaacgacacacuuccaaagggccuugauuuucaucuuacugacagcugucgcuccuucaaugacaaugcgcugcauaggaauaucaaauagagacuucguagaagggguuucaggaggaagcuggguugacaucguuuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaaugaagagcaggacaaaagguucaucugcaaacacuccaugguagacagaggauggggaaauggauguggacuauuuggaaagggaggcauugugaccugugcuauguuuacaugcaaaaagaacauggaaggaaaaaucguacagccagaaaauuuggaauacaccaucgugauaacaccucacucaggagaagagcacgcuguagguaaugacacaggaaagcauggcaaggaaaucaaaauaacaccacagaguuccaccacagaagcagaacugacaggcuauggcacugucacgauggagugcucuccgagaacgggccuugacuucaaugagauggugcugcugcagauggaagacaaagcuuggcuggugcacaggcaaugguuccuagaccugccguugccauggcuacccggagcggauacacaaggaucaaauuggauacagaaagagacauuggucacuuucaaaaauccccacgccaagaaacaggaugucguugucuuagggucucaagaaggggccaugcacacggcacucacaggggcuacagaaauccagaugucaucaggaaacuuacuguucacgggacaucucaagugcaggcugagaauggacaaacuacagcucaaaggaaugucauacucuauguguacaggaaaguuuaaaaucgugaaggaaauagcagaaacacaacauggaacaauaguuaucagaguacaauaugaaggggacgguucuccaugcaagaucccuuuugagauaacagauuuggaaaaaagacacgucuuaggacgccugauuacaguuaacccaaucguaacagaaaaagauagcccagucaacauagaagcagaacccccauucggagacagcuacaucaucguaggaguagagccgggacaacugaaacucaauugguuuaagaagggaaguuccaucggccaaauguuugagacaacaaugagaggagcaaagagaauggccauuuuaggugacacagccugggauuuuggaucccugggaggaguguuuacaucuauaggaaaggcucuccaucaaguuuuuggagcaaucuauggggcugcuuuuaguggggucucauggacuaugaaaauccucauaggagucaucaucacauggauaggaaugaauucacguagcaccucacugucugugucgcuaguauuggugggagucgugacacuguaccugggagcuauggugcaggcugauagugguugcauugugagcuggaaaaauaaagaacugaaauguggcagcgggaucuucauuacagauaacguacacacauggacagagcaauauaaguuccaaccagaauccccuucaaaacuagcuucagcuauccaaaaagcucaugaagaaggcauuuguggaauucgcucaguaacaagauuggagaaucugauguggaaacaaauaacaccagaauugaaucauauucuaucagaaaaugagguaaaguugaccauuaugacaggagacauuaaaggaaucaugcaggcaggaaaacgauccuugcggccucagcccacugagcugaaguacucauggaaaacauggggaaaggcgaaaaugcucucuacagagucucacaaucagaccuuucuuauugauggcccugaaacagcagaaugccccaacacaaacagagcuuggaacucacuggaaguugaagacuaugguuuuggaguuuuuaccaccaauauauggcuaaaauugagagaaaaacaggauguauuuugugacucaaaacucaugucagcggccauuaaagacaacagagccguccaugccgacauggguuauuggauagaaagugcacucaaugacacauggaagauggagaaagccuccuucauugaaguuaaaagcugccacuggccaaagucacacacccucuggagcaauggaguauuagaaagugagaugauaauuccaaaaaauuuugccgggccagugucacaacacaacuacagaccaggcuaccauacacaaacagcaggaccuuggcaucuagguaagcuugagauggacuuugauuucugcgaaggaacuacagugguggugacugaggacuguggaaauagaggacccucuuuaagaacgaccacugccucuggaaagcucauaacagaauggugcugccgauccugcacacuaccaccucuaagauacagaggugaggauggaugcugguacgggauggaaaucagaccuuugaaagagaaagaagagaacuuggucaacuccuuggucacagccggacaugggcagauugacaacuuuucacuaggagucuugggaauggcacuguuccuggaagaaaugcuuaggacccgaguaggaacgaaacaugcaauacugcuaguugcacuaucuuucgugacauugauuacugggaacaugucuuuuagagaccugggaagagugauggucauggugggcgcuaccaugacggaugacauagguaugggagugacuuaucuugcccuacuagcagcuuucaaaguuagaccaacuuuugcagcuggacuacucuugagaaaacugaccuccaaggaauugaugauggccaccauaggaaucgcacuccuuucccaaagcaccuugccagagaccauucuagaacugacugaugcguuagccuugggcaugauggcccucaaaauagugagaaauauggaaaaauaccaauuggcagugacuaucauggcuauuucgugugucccaaauacagugauauugcaaaacgcauggaaggugaguugcacaauauuggcagcgguguccguuucuccacugcuccuaacauccucacagcagaaagcggauuggauaccacuggcauugacgauaaaaggucucaacccaacagccauuuuucuaacaacucuuucgagaaccagcaagaaaaggagcuggccgcuaaaugaagcuaucauggcagucgggauggugagcauuuuagccaguucucuccuaaagaaugauauuccuaugacagguccauuaguggcuggagggcuccucaccguauguuacgugcucacuggacgaucggccgauuuggaacuggagagagcugccgauguaaaaugggaagaucaggcagaaauaucaggaagcagcccaauucugucaauaacaauaucagaagauggcagcaugucgauaaaaaaugaagaggaagaacaaacacugaccauacucauuagaacgggauuguuggugaucucaggagucuuuccaguaucgauaccaauuacggcagcagcaugguaccugugggaagugaagaaacaacgggcuggaguauugugggacgucccuucacccccaccagugggaaaagccgaacuggaagauggagccuauagaaucaagcaaagagggauucuuggauauucucagauuggagccggaguuuacaaagaaggaacauuccauacaauguggcacgucacacguggugcuguucugaugcauagagggaagaggauugaaccaucaugggcagaugucaagaaagaucuaauaucauauggaggaggcuggaagcuagaaggagaauggaaggaaggagaggaaguccaaguccuggcauuggaaccuggaaaaaaucccagagcuguccaaacgaaaccuggaauuuucaaaaccaacaccggaaccauaggcgcuguaucucuggacuuuuccccuggaacgucaggaucuccaauugucgacagaaaaggaaaaguugugggucuuuacgguaaugguguugucacaaggaguggagcauacguaagugccauagcccagaccgaaaaaagcauugaagacaauccagagaucgaagaugacauuuuccgaaagaaaagauugaccaucauggaccuccauccaggggcaggaaagacaaaaagauaccuuccagccauaguuagagaagccauaaaacguggcuugagaacauuaauccuggcucccacuagagucguggcagcugaaauggaggaagcucuuagaggacuuccaauaagauaccaaaccccagccaucagagccgagcacaccgggcgagagaucguggaccuaaugugucaugccacauuuacuaugaggcugcuaucaccagucagagugccaaauuacaaccugauuaucauggacgaagcccacuucacagacccagcaagcauagcagcuagaggauacauuucaacucgaguagagaugggugaagcagccgggauuuuuaugacagccacuccuccgggaagcagagacccauuuccucagagcaaugcaccaaucauggaugaggaaagagaaaucccugaacguucauggaauucaggacaugaaugggucacggauuuuaaagggaagacuguuugguuuguuccaaguauaaaagcaggaaaugacauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagacccuagacgcugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucucgaaaaugaugaagacugugcacacuggaaagaagcuaaaaugcuccuagauaacaucaacacacccgaaggaaucauuccuaguauguucgaaccagagcgugaaaaaguggaugccauugauggugaauaccgcuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauguggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagaaacgcacuggacaacuuggcugugcugcauacggcugagguagguggaaaggcgcacacucaugcucucagugaacugccggagacucuggagacacugcuucuacugacacuccuggcagcagucacaggaggaaucuucuuauucuuaaugagcggaaaaggcauagggaagaugacucugggaauguguugcauaaucacagcuagcauucuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaaugagauggguuuccuggaaaaaaccaagaaagaccucggauuuggaagcauuacaacccaggaaucugagagcaacauccuggacauagaucuacguccugcaucagcauggacguuguaugccguggccacaacauuugucacaccaauguugcgacauagcauugaaaauuccucaguaaaugucucccuaacagccauugcuaaccaagcuacagugcuaaugggucuugggaaaggauggccauugucaaagauggacaucggaguuccccuccuugccauuggaugcuacucacaagucaacccuauaacccucacagcagcucuucuuuuauugguagcgcauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaacaccaccauugcagugucaauggcuaacaucuuuagggggagcuacuuggccggagcuggacuucucuuuuccaucaugaagaacacaacaaacacaagaagaggaacuggcaacguaggagagacacuuggagaaaaauggaaaagccgauuaaaugcacugggaaaaagugaauuucagaucuacaagaaaaguggaauccaggaaguggauagaacccuagcaaaagaaggcaucaaaagaggagaaacggaccaccaugccgugucacgaggaucagcaaaacugagaugguucgucgagagaaacauggucacaccggaagggaaggugguggaucuugguugcggcagagggggcuggucauacuauugugggggacuaaagaauguaagagaagucaaaggccuaacaaaaggaggaccaggacacgaagaacccauccccaugucaacauauggguggaaucuagugcgucugcaaaguggggucgacguuuucuucacuccgccagaaaagugugauacauuguugugugacauaggggagucgucaccaaaucccacgauagaagcaggacgaacacucagaguccucaauuuaguggaaaauuggcugaacaauaacacccaauuuugcauaaagguccucaauccauauaugcccucagucauagaaaaaauggaaacacuacaaagaaaauauggaggagccuuagugaggaauccacucucacgaaacuccacgcaugaaauguacuggguaucuaaugccaccgggaacauagugucaucagugaacaugauuucaaggauguugauuaacagauucacaaugaaacauaagaaagccaccuacgagccagauguugaccuaggaaguggaacccgcaacauuggaauugaaagugagauaccaaaucuagacauaauaggaaagagaauagagaaaauaaaacaagagcaugaaacaucauggcauuaugaccaagaccacccauacaaaacgugggcuuaccauggcagcuaugaaacaaaacaaacuggaucagcaucaucuauggugaacggaguggucagacugcugacgaaaccuugggacgucgucccuauggugacacagauggcaaugacagacacgacuccauuuggacaacagcgcguuuucaaagagaaaguggacacgagaacucaagaaccgaaggaaggcacaaagaaacugaugaaaaucacggcagaguggcuuuggaaagaacuaggaaaagaaaagacaccuagaauguguaccagagaagaauucacaagaaaagugagaagcaaugcagccuugggggccguauucacugaugaaaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagagaacucccugaguggaguggaaggagaagggcugcacaggcuaggcuacauuuuaagagaugugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaaaagaccaaagaggcagugggcaagucgguaccuauggccuuaauacuuucaccaauauggaagcccaauuaauuagacagauggaaggagaaggaaucuucagaagcauucagcaccugaccgccacagaagaaaucgcuguacagaacugguuagcaagaguggggcgugaaaggcuaucaagaauggccaucaguggagaugacuguguuguaaaaccuauagaugacagauuugcaagugcuuuaacagcucuaaaugacaugggaaaaguuaggaaagauauacaacaaugggaaccuucaagaggauggaacgauuggacacaggugccuuucuguucacaccauuuucaugaguuagucaugaaagauggucgcgugcucguagucccaugcagaaaccaagaugaacugauuggcagagcccgaauuucccagggagccggguggucuuugaaggagacggcuuguuuggggaagucuuacgcccaaauguggacccugauguacuuccacagacgugaccucagauuggcggcaaaugccauuugcucggcagucccgucacauuggguuccaacaagucgaacaaccugguccauacacgccaagcaugaauggaugacgacggaagacaugcuggcagucuggaacaggguguggauccaagaaaacccauggauggaagacaaaacuccaguggaaucaugggaagaagucccauaccuggggaaaagggaagaccaauggugcggcucauugauugggcuaacaagcagggccaccugggcaaagaauauccagacagcaauaaaucaagucagaucccuuauaggcaaugagggauacacagacuacaugccauccaugaagagauucagaagggaagaggaagaggcagguguccugugguag

SEQ ID NO: 6374 - RNA, 9876 nt, Artificial Sequence
  derived and/or modified CDS sequence (wt) from DENV-2__JX669478__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaguugugugaagauacaaucacguacaaguguccccuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugaaacauggaugucaucagaaggggccuggaagcauguucagagaauugaaaccuggaucuugagacauccagguuuuaccauaauggcagcgauccuggcauacaccauaggaacgacacacuuccaaagggcccugauuuucaucuuacugacagcugucgcuccuucaaugacaaugcgcugcauaggaauaucaaauagagacuucguagaagggguuucaggaggaagcuggguugacaucguuuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaaaucguacagccagaaaauuuggaauacaccaucgugauaacaccucacucaggagaagagcacgcuguagguaaugacacaggaaagcauggaaaggaaaucaaaauaacaccacagaguuccaccacagaagcagaacugacaggcuauggcacugucacgauggagugcucuccgagaacgggccucgacuucaaugagauggugcugcugcagauggaagacaaagcuuggcuggugcacaggcaaugguuccuagaccugccguugccauggcuacccggagcggauacacaaggaucaaauuggauacagaaagagacauuggucacuuucaaaaauccccacgccaagaaacaggaugucguugucuuagggucucaagaaggggccaugcacacggcacucacaggggcuacagaaauccagaugucaucaggaaacuuacuguucacgggacaucucaagugcaggcugagaauggacaaacuacagcucaaaggaaugucauacucuauguguacaggaaaguuuaaaaucgugaaggaaauagcagaaacacaacauggaacaauaguuaucagaguacaauaugaaggggacgguucuccauguaagaucccuuuugagauaacagauuuggaaaaaagacacgucuuaggacgccugauuacaguuaacccaaucguaacagaaaaagauagcccagucaacauagaagcagaacccccauucggagacagcuacaucaucguaggaguagagccgggacaacugaaacuuaauugguuuaagaagggaaguuccaucggccaaauguuugagacaacaaugagaggagcaaagagaauggccauuuuaggugacacagccugggauuuuggaucccugggaggaguguuuacaucuauaggaaaggcucuccaucaaguuuucggagcaaucuauggggcugcuuuuaguggggucucauggacuaugaaaauccucauaggagucaucaucacauggauaggaaugaauucacguagcaccucacugucugugucgcuaguauuggugggagucgugacacuguaccugggagcuauggugcaggcugauagugguugcauugugagcuggaaaaauaaagaacugaaauguggcagcgggaucuucauuacagauaacguacacacauggacagagcaauauaaguuccaaccagaauccccuucaaaacuagcuucagcuauccaaaaagcucaugaagaaggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgauccuugcggccucagcccacugagcugaaguacucauggaaaacauggggaaaggcgaaaaugcucucuacagagucucacaaucagaccuuucuuauugauggcccugaaacagcagaaugccccaacacaaacagagcuuggaacucacuggaaguugaagacuaugguuuuggaguuuuuaccaccaauauauggcuaaaauugagagaaaaacaggauguauuuugugacucaaaacucaugucagcggccauuaaagacaacagagccguccaugccgauauggguuauuggauagaaagugcacucaaugacacauggaagauggagaaagccuccuucauugaaguuaaaagcugccacuggccaaagucacacacccucuggagcaauggaguauuagaaagugagaugauaauuccaaaaaauuuugccgggccagugucacaacacaacuacagaccaggcuaccauacacaaacagcaggaccuuggcaucuagguaagcuugagauggacuuugauuucugcgaaggaacuacagugguggugacugaggacuguggaaauagaggacccucuuuaagaacgaccacugccucuggaaagcucauaacagaauggugcugccgauccugcacacuaccaccucuaagauacagaggugaggauggaugcugguacgggauggaaaucagaccuuugaaagagaaagaagagaacuuggucaacuccuuggucacagccggacaugggcagauugacaacuuuucacuaggagucuugggaauggcacuguuccuggaagaaaugcuuaggacccgaguaggaacgaaacaugcaauacugcuaguugcacuaucuuucgugacauugauuacugggaacaugucuuuuagagaccugggaagagugauggucauggugggcgcuaccaugacggaugacauagguaugggagugacuuaucuugcccuacuagcagcuuucaaagucagaccaacuuuugcagcuggacuacucuugagaaaacugaccuccaaggaauugaugauggccaccauaggaaucgcacuccuuucccaaagcacccugccagagaccauucuagaacugacugaugcguuagccuugggcaugauggcccucaaaauagugagaaauauggaaaaauaccaauuggcagugacuaucauggcuauuucgugugucccaaaugcagugauauugcaaaacgcauggaaggugaguugcacaauauuggcagcgguguccguuucuccacugcuccuaacauccucacagcagaaagcggauuggauaccacuggcauugacgauaaaaggucucaacccaacagccauuuuucuaacaacucuuucgagaaccagcaagaaaaggagcuggccgcuaaaugaagcuaucauggcagucgggaugguaagcauuuuagccaguucucuccuaaaaaaugauauuccuaugacagguccauuaguggcuggagggcuacucaccguauguuacgugcucacuggacgaucggccgauuuggaacuggagagagcugccgauguaaaaugggaagaucaggcagaaauaucaggaagcagcccaauucugucaauaacaauaucagaagauggcagcaugucgauaaaaaaugaagaggaagaacaaacacugaccauacucauuagaacgggauuguuggugaucucaggagucuuuccaguaucgauaccaaucacggcagcagcaugguaccugugggaagugaagaaacaacgggcuggaguauugugggacgucccuucacccccaccagugggaaaagccgaacuggaagauggagccuauagaaucaagcaaagagggauuuuuggauauucucagauuggagccggaguuuacaaagaaggaacauuccauacaauguggcacgucacacguggcgcuguucugaugcauagagggaagaggauugaaccaucaugggcagaugucaagaaagaucuaauaucauauggaggaggcuggaagcuagaaggagaauggaaggaaggagaggaaguccaaguccuggcauuggaaccuggaaaaaaucccagagcuguccaaacgaaaccuggaauuuucaaaaccaacaccggaaccauaggcgcuguaucucuggacuuuuccccuggaacaucaggaucuccaauugucgacagaaaaggaaaaguugugggucuuuacgguaaugguguugucacaaggaguggagcauacguaagugccauagcccagaccgaaaaaagcauugaagacaauccagagaucgaagaugacauuuuccgaaagaaaagauugaccaucauggaccuccauccaggggcaggaaagacaaaaagauaccuuccagccauaguuagagaagccauaaaacguggcuugagaacauuaauccuggcucccacuagagucguggcagcugaaauggaggaagcucuuagaggacuuccaauaagauaccaaaccccagccaucagagccgagcacaccgggcgagagaucguggaccuaaugugucaugccacauuuacuaugaggcugcuaucaccagucagagugccaaauuacaaccugauuaucauggacgaagcccacuucacagacccagcaagcauagcagcuagaggauacauuucaacucgaguagagaugggugaagcagccgggauuuuuaugacagccacuccuccgggaagcagagacccauuuccucagagcaaugcaccaaucauggaugaggaaagagaaaucccugagcguucauggaauucaggacaugaaugggucacggauuuuaaagggaagacuguuugguuuguuccaaguauaaaagcaggaaaugacauagcagcuugucuuagaaaaaauggaaagaaagugauacaacucaguaggaagacuuuugacucugaguauguuaagacuagagccaaugauugggacuuuguggucacaacugacauuucagaaaugggugccaacuucaaggcugagaggguuauagacccuagacgcugcaugaaaccaguuauacuaacagauggcgaagagcgugugaucuuggcaggaccuaugccagugacccacucuagugcagcgcaaagaagagggagaauaggaagaaauccaaaaaaugaaaaugaccaguacauauacaugggggaaccucucgaaaaugaugaagacugugcacacuggaaagaagcuaaaaugcuccuagauaacaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauguggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagaaacgcacuggacaacuuggcugugcugcauacggcugagguagguggaaaggcguacacucaugcucucagugaacugccggagacucuggagacacugcuucuacugacacuccuggcagcagucacaggaggaaucuucuuauucuuaaugagcggaaaagguauagggaagaugacucugggaaugugcugcauaaucacagcuagcauucuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauuuggaagcauuacaacccaggaaucugagagcaacauccuggacauagaucuacguccugcaucagcauggacgcuguaugccguggcuacaacauuugucacaccaauguugcgacauagcauugaaaauuccucaguaaaugucucccuaacagccauugcuaaccaagcuacagugcuaaugggucuugggaaaggauggccauugucaaagauggacaucggaguuccccuccuugccauugggugcuacucacaagucaacccuauaacccucacagcagcucuucuuuuauugguagcacauuaugccauuauagggccaggacuucaagcaaaagcaaccagagaagcucagaaaagagcagcagcaggcaucaugaaaaauccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaacaccaccauugcagugucaauggcuaacaucuuuagggggagcuacuuggccggagcuggacuucucuuuuccaucaugaagaacacaacaaacacaagaagaggaacuggcaacguaggagagacacuuggagaaaaauggaaaagccgauuaaaugcacugggaaaaagugaauuucagaucuacaagaaaaguggaauccaggaaguggauagaacccuagcaaaagaaggcaucaaaagaggagaaacggaccaccaugcugugucacgaggaucagcaaaacugagaugguucgucgagagaaacauggucacaccggaagggaaggugguggaucuugguugcggcagagggggcuggucauacuauugugggggacuaaagaauguaagagaagucaaaggccuaacaaaaggaggaccaggacacgaagaacccauccccaugucaacauauggguggaaucuagugcgucugcaaaguggggucgacguuuucuucaccccgccagaaaagugugauacauuguugugugacauaggggagucgucaccaaaccccacgauagaagcaggacgaacacucagaguccucaacuuaguggaaaauuggcugaacaacaacacccaauuuugcauaaagguccucaauccauauaugcccucagucauagaaaaaauggaaacacuacaaaggaaauauggaggagccuuagugaggaauccacucucacgaaacuccacgcaugaaauguacuggguaucuaaugcuaccgggaacauagugucaucagugaacaugauuucaaggauguugauuaacagauucacaaugaaacauaagaaagccaccuacgagccagauguugaccuaggaaguggaacccgcaacauuggaauugaaagugagauaccaaaucuagacauaauaggaaagagaauagagaaaauaaaacaagagcaugaaacaucauggcauuaugaccaagaccacccauacaaaacgugggcuuaccauggcagcuaugaaacaaaacaaacuggaucagcaucaucuauggugaacggaguggucagacugcugacaaaaccuugggacgucaucccuauggugacacagauggcaaugacagacacgacuccauuuggacaacagcgcguuuucaaagagaaaguggacacgagaacucaagaaccgaaggaaggcacaaagaaacugaugaaaauuacggcagaguggcuuuggaaagaacuaggaaaggaaaagacaccuagaauguguaccagagaagaauucacaagaaaagugagaagcaaugcagccuugggggccguauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuuuuuagaguuugaagcccuaggauuucugaaugaagaucacugguucuccagagggaacucccugaguggaguggaaggagaagggcugcacaggcuaggcuacauuuuaagagaggugggcaagaaggaaggaggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaaaggaccaaagaggcagugggcaagucgguaccuauggccuuaauacuuucaccaauauggaagcccaauuaauuagacagauggaaggagaaggaaucuucaaaagcauucagcaccugaccgccacagaagaaaucgcuguacagaacugguuagcaagaguggggcgugaaaggcuaucaagaauggccaucaguggagaugacuguguuguaaaaccuauagaugacagauuugcaagugcuuuaacagcucuaaaugacaugggaaaaguuaggaaagauauacaacaaugggaaccuucaagaggauggaacgauuggacacaggugccuuucuguucacaccauuuucaugaguuagucaugaaagauggucgcgugcucguagucccaugcagaaaccaagaugaacugauuggcagagcccgaauuucccagggagcuggguggucuuugaaggagacggcuuguuuggggaagucuuacgcccaaauguggacccugauguacuuccacagacgugaccucagauuggcggcaaaugccauuugcucggcagucccgucacauuggguuccaacaagucgaacaaccugguccauacacgccaagcaugaauggaugacgacggaagacaugcuggcagucuggaacaggguguggauccaagaaaacccauggauggaagacaaaacuccaguggaaucaugggaagaagucccauaccuggggaaaagggaagaccaauggugcggcucauugauugggcuaacaagcagggcuaccugggcaaagaauauccagacagcaauaaaucaagucagaucccuuauaggcaaugagggauacauagacuacaugccauccaugaagagauucagaagggaagaggaagaggcagguguccugugguag

SEQ ID NO: 6375 - RNA, 9876 nt, Artificial Sequence
  derived and/or modified CDS sequence (wt) from DENV-2__JX669480__SS-prME
acagcaggcgugauuauuauguugauuccaacagcaauggcguuccauuuaaccacacguaauggagaaccacacaugaucguugguaggcaagagaaagggaaaagucuucuguuuaaaacagaggauggugucaacaugugcacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccacauguggguaugggacuggagacacgaacugaaacauggaugucaucagaaggggccuggaaacauguucagagaauugaaaccuggaucuugagacauccaggcuuugccauaauggcagcaauccuggcauacaccauaggaacgacacauuuccaaagggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaauaaaccaacauuggauuuugaacugauaaaaacagaagccaaacaaccugccacucuaaggaaguacuguauagaagcaaagcugaccaauacaacaacagaaucucguugcccaacacaaggggaacccagucuaaaugaagagcaggacaaaagguucaucugcaaacacuccaugguagacagaggauggggaaauggauguggauuauuuggaaaaggaggcauugugaccugugcuauguucacaugcaaaaagaacauggaaggaaaagucgugcugccagaaaaucuggaauacaccaucgugauaacaccucacucaggagaagagcacgcuguagguaaugacacaggaaaacauggcgaggaaaucaaaauaacaccacagaguuccaucacagaagcagaacugacaggcuauggcacugucacgauggagugcucuccgagaacgggccucgacuucaaugagauggugcugcugcagauggaagagaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagacacgucuuaggucgccugauuacaguuaacccaaucgugacagaaaaagauagcccagucaacauagaagcagaaccuccauucggagacagcuacaucaucauaggaguagagccgggacaacugaaacucaauugguuuaagaagggaaguuccaucggccaaauguuugagacaacaaugagaggagcgaagagaauggccauauuaggugacacagccugggauuuuggaucccugggaggaguguuuacaucuauaggaaaggcucuccaccaaguuuucggagcaaucuauggggcugcuuuuagcggggucucauggacuaugaaaauccucauaggagucaucaucacauggauaggaaugaauucacguaguaccucacugucugugucacuaguauuggugggagucgugacacuguaccugggagcuauggugcaggcugauagugguugcguugugagcuggaaaaacaaagaauugaaauguggcagcgggauauucauuacagauaacgugcacacauggacagagcaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauccuaucagaaaaugagguaaagcugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucucauugauggcccugaaacagcagaaugccccaacacaaacagagcuuggaacucguuggaaguugaagacuaugguuuuggaguuuuuaccaccaauauauggcuaaaacugagagaaaaacaggauguauuuugugacucaaaacucaugucagcggccauaaaagacaacagagccguccaugccgauauggguuauuggauagaaagugcacucaaugacacauggaagauggagaaagccucuuucauugaaguuaaaagcugccacuggccaaagucacacacccucuggagcaauggaguauuggaaagugagaugauaauuccaaaaaauuuugccgggccagugucacaacacaacuacagaccaggcuaccauacacaaacagcaggaccuuggcaucuagguaagcuugagauggacuucgauuucugcgaaggaaccacagugguggugacugaggacuguggaaauagaggacccucuuuaagaacgaccacugccucuggaaaacuuauaacagaauggugcugccgaucuugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuucuggaagagaugcucaggacccgaguaggaacgaaacaugcaauacugcuagucgcaguaucuuuugugacauugauuacugggaacauguccuuuagagaccugggaagagugaugguuauggugggcguuaccaugacggaugauauagguaugggagugacuuaccuugcccuacuagcagcuuucaaaguuagaccaacuuucgcagcuggacuacucuugagaaaacugaccuccaaggaauuaaugauggccaccauaggaaucacacuccuuucccaaagcaccauaccagaaaccauucuugaacugacugaugcguuagccuugggcaugaugguccucaaaauagugagaaauauggaaaaguaccaauuggcagugaccaucauggcuaucucgugugucccaaaugcagugauacugcuaaacgcauggaaggugaguugcacaauauuggcagcgguguccguuucuccauugcuccuaacauccucacagcagaaaacggauuggauaccacuggcauugacgauaaaaggucucaauccaacagccaucuuucuaacaacucuuucgagaaccagcaagaaaaggagcuggccgcuaaaugaagcugucauggcagucgggauggugagcauuuuagccaguucucuccuaaagaaugacauucccaugacagguccauuaguggcuggagggcuccuuacuguguguuacgugcucaccggacgaucggccgauuuggaacuagagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauugcuggugaucucaggaguuuuuccaguaucgauaccaauuacggcagcagcaugguaccugugggaagugaagaaacaacgggcuggaguauugugggacgucccuucacccccaccagugggaaaagccgaacuggaagauggagcuuauagaaucaagcaaagagggauucuuggauauucucagauuggagccggaguuuacaaagaaggaacauuccauacaauguggcacgucacacguggugcuguucugaugcauagagggaaaaggauugaaccaucaugggcagacgucaagaaagaccuaauaucauauggaggaggcuggaagcuagaaggagaauggaaagaaggagaggaaguccaaguccuggcauuggaaccuggaaaaaauccaagagccguccaaacgaaaccuggacuuuucaaaaccaacaccggaaccauaggcgccguaucucuggacuuuuccccuggaacgucaggaucuccaauugucgauagaaaaggaaaaguugugggucuuuacgguaaugguguugucacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagaguuguggcagcugaaauggaggaagcucuuagaggacuuccaauaagauaccaaaccccagccaucagagccgagcacaccgggcgggagaucguggaccuaaugugucaugccacauuuacuaugaggcugcuaucaccagucagagugccaaauuacaaccugaucaucauggacgaagcccacuucacagauccagcaaguauagcagcuagaggauauauuucaacucgaguagaaaugggugaagcagcugggauuuucaugacagccacuccuccgggaaguagagacccauuuccucagagcaaugcaccaaucauggaugaggaaagagaaaucccugagcgcucguggaauucaggacaugaaugggucacggauuuuaaagggaagacuguuugguuuguuccaaguauaaaagcaggaaaugacauagcagcuugucucagaaaaaauggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccagucauacuaacagauggcgaagagcgggugauuuuggcaggaccuaugccagugacccacucuagugcagcacaaagaagagggagaguaggaagaaauccaaaaaaugaaaaugaccaguacauauacaugggggaaccucuggaaaaugaugaagacugugcacauuggaaagaagcuaaaaugcuccuagauaacaucaacacaccugaagggaucauuccuaguauguucgaaccagagcgugaaaagguggaugccauugauggugaauaccguuugagaggagaagcaaggaaaaccuuuguggaccuaaugagaagaggggacuuaccagucugguuggcuuacagaguggcagcugagggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaagacaagagacgcacuggacaacuuagcugugcugcauacggcugaggcagguggaagggcguacaaucaugcucucagugaacugccggagacccuggagacacugcuuuuacugacacuccuggccacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuccucauaguuuugcucauuccagaaccagaaaaacagagaacaccccaagacaaccaauugaccuacguagucauagccauccucacagugguggccgcaaccauggcaaaugagauggguuuccuggaaaaaaccaagaaagaccucggauugggaagcauuacaacccaggaaucugagagcaacauccuggacauagaucuacguccugcaucagcauggacgcuguaugccguggcuacaacauuugucacaccaauguugagacauagcauugaaaauuccucagugaaugucucccuaacagccauugcuaaccaagccacagugcuaaugggucuugggaaaggauggccauugucaaagauggacaucggaguuccccuccuugccauuggaugcuauucacaagucaacccuauaacucucacagcagcucuucuuuuauugguagcacauuauaccauuauagggccaggacuucaagcaaaagcaaccagagaagcucagaaaagagcagcagcaggcaucaugaaaaacccaacagucgaugggauaacagugauugaccuagaaccaauacccuaugauccaaaauuugaaaagcaguuaggacaaguaaugcuccuaauccucugcgugacucaaguauuaaugaugaggacuacaugggcucugugcgaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaagaacacaacaaacacaagaagaggaacuggcaacauaggagagacacuuggagaaaaauggaaaagccgauuaaacgcacugggaaaaagugaauuucagaucuacaagaaaaguggaauccaggaaguggauagaaccuuggcaaaagaaggcaucaaaagaggagaaacggaccaccacgcugugucgcgaggcucagcaaaacugagaugguucgucgagagaaauaugguaacaccagaagggaaggugguggaccucgguugcggcagagggggcuggucauacuauugugggggacuaaagaauguaagagaagucaaaggccugacaaaaggaggaccaggacacgaggaacccauccccaugucaacauauggguggaaucuagugcgucugcaaaguggaguugacgucuucuucaccccgccagaaaagugugauacauuguugugugacauaggggagucgucaccaaaucccacgauagaagcaggacggacacucagaguccucaacuuaguggaaaauugguugaauaacaacacccaauuuugcauaaagguucucaacccauauaugcccucagucauagaaaaaauggaaacacuacaaaggaaauauggaggagcuuuagugaggaacccacucucacgaaacuccacacaugagauguacuggguauccaaugcuaccgggaacauagugucaucagugaacaugauuucaaggauguugauuaacagauucacaaugaaacacaagaaagccaccuacgagccagauguugaccuaggaagcggaacccgcaacauuggaauugaaagugagauaccaaaucuagacauaauaggaaagagaauagagaaaauaaagcaagagcaugaaacaucauggcacuaugaccaagaccacccauacaaaacaugggcuuaccaugguagcuaugaaacaaaacaaacuggaucagcaucaucuauggugaacggaguggucagacugcugacaaaaccuugggacgucgucccuauggugacacagauggcaaugacagacacgacuccauuuggacaacaacgcgucuucaaagagaaaguggacacgagaacccaagaaccgaaggaaggcacaaagaaacugaugagaauuacggcagaguggcuuuggaaagaacuaggaaagaaaaagacaccuaggauguguaccagagaagaauucacaagaaaggugagaagcaaugcagccuugggggccauauucacugaugaaaacaaauggaaaucggcucgugaggcuguugaagauaguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuuuuuagaauuugaagcccuaggauucuugaaugaagaucacugguucuccagagggaacucccugaguggaguggaaggagaagggcugcacaggcuaggcuacauuuuaagagacgugagcaagaaggaagggggagcaauguacgccgaugacacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagcgggcaagucggcaccuauggccuuaauacuuucaccaacauggaagcccaauuaauuagacagauggagggagaaggaaucuucaaaagcauucagcaccugacagucacagaagaaaucgcuguacagaacugguuagcaagaguggggcgugaaaggcuaucaagaauggccaucaguggagaugauuguguuguaaaacccuuagaugacagauuugcaagugcuuuaacagcucuaaaugacaugggaaaaguuaggaaagauauacaacaaugggaaccuucaagaggauggaacgacuggacacaagugccuuucuguucacaccauuuucaugaguuagucaugaaagauggucgcgugcucguagucccaugcagaaaccaagaugaacugauugguagagcccgaauuucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaauaggguguggauccaagaaaacccguggauggaagacaaaacuccaguggaaucaugggaagaagucccauauuuggggaaaagagaagaccaauggugcggcucauugauugggcuaacaagcagggcuacuugggcaaagaacauccaaacagcaauaaaucaagucagaucccuuauaggcaaugaggaauacacagacuacaugccauccaugaagagauucagaagggaagaggaagaggcagguguccugugguag

SEQ ID NO: 6376 - RNA, 9876 nt, Artificial Sequence
  derived and/or modified CDS sequence (wt) from DENV-2__JX669483__SS-prME
acagcaggcgugauuauuauguugauuccaacagcaauggcguuccauuuaaccacacguaauggagaaccacacaugaucguugguaggcaagagaaagggaaaagucuucuguuuaaaacagaggauggugucaacaugugcacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccacauguggguaugggacuggagacacgaacugaaacauggaugucaucagaaggggccuggaaacauguucagagaauugaaaccuggaucuugagacauccaggcuuugccauaauggcagcaauccuggcauacaccauaggaacgacacauuuccaaagggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaauaaaccaacauuggauuuugaacugauaaaaacagaagccaaacaaccugccacucuaaggaaguacuguauagaagcaaagcugaccaauacaacaacagaaucccguugcccaacacaaggggaacccagucuaaaugaagagcaggacaaaagguucaucugcaaacacuccaugguagacagaggauggggaaauggauguggauuauuuggaaaaggaggcauugugaccugugcuauguucacaugcaaaaagaacauggaaggaaaagucgugcugccagaaaaucuggaauacaccaucgugauaacaccucacucaggagaagagcacgcuguagguaaugacacaggaaaacauggcgaggaaaucaaaauaacaccacagaguuccaucacagaagcagaacugacaggcuauggcacugucacgauggagugcucuccgagaacgggccucgacuucaaugagauggugcugcugcagauggaagagaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucaaaguacaauaugaaggggacggcucuccauguaagaucccuuuugagauaauggauuuggaaaaaagacacgucuuaggucgccugauuacaguuaacccaaucgugacagaaaaagauagcccagucaacauagaagcagaaccuccauucggagacagcuacaucaucauaggaguagagccgggacaacugaaacucaauugguuuaagaagggaaguuccaucggccaaauguuugagacaacaaugagaggagcgaagagaauggccauauuaggugacacagccugggauuuuggaucccugggaggaguguuuacaucuauaggaaaggcucuccaccaaguuuucggagcaaucuauggggcugcuuuuagcggggucucauggacuaugaaaauccucauaggagucaucaucacauggauaggaaugaauucacguagcaccucacugucugugucacuaguauuggugggagucgugacacuguaccugggagcuauggugcaggcugauagugguugcguugugagcuggaaaaacaaagaauugaaauguggcagcgggauauucauuacagauaacgugcacacauggacagagcaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauccuaucagaaaaugagguaaagcugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucucauugauggcccugaaacagcagaaugccccaacacaaacagagcuuggaacucguuggaaguugaagacuaugguuuuggaguuuuuaccaccaauauauggcuaaaacugagagaaaaacaggauguauuuugugacucaaaacucaugucagcggccauaaaagacaacagagccguccaugccgauauggguuauuggauagaaagugcacucaaugacacauggaagauggagaaagccucuuucauugaaguuaaaagcugccacuggccaaagucacacacccucuggagcaauggaguauuggaaagugagaugauaauuccaaaaaauuuugccgggccagugucacaacacaacuacagaccaggcuaccauacacaaacagcaggaccuuggcaucuagguaagcuugagauggacuucgauuucugcgaaggaaccacagugguggugacugaggacugcggaaauagaggacccucuuuaagaacgaccacugccucuggaaaacuuauaacagaauggugcugccgaucuugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacccgaguaggaacgaaacaugcaauacugcuagucgcaguaucuuuugugacauugauuacugggaacauguccuuuagagaccugggaagagugaugguuaugguaggcguuaccaugacggaugauauagguaugggagugacuuaccuugcccuacuagcagcuuucaaaguuagaccaacuuucgcagcuggacuacucuugagaaaacugaccuccaaggaauuaaugauggccaccauaggaaucacacuccuuucccaaagcaccauaccagaaaccauucuugaacugacugaugcguuagccuugggcaugaugguccucaaaauagugagaaauauggaaaaguaccaauuggcagugaccaucauggcuaucucgugugucccaaaugcagugauacugcuaaacgcauggaaggugaguugcacaauauuggcagcgguguccguuucuccauugcuccuaacauccucacagcagaaaacggauuggauaccacuggcauugacgauaaaaggucucaauccaacagccaucuuucuaacaacucuuucgagaaccagcaagaaaaggagcuggccgcuaaaugaagcugucauggcagucgggauggugagcauuuuagccaguucucuccuaaagaaugacauucccaugacagguccauuaguggcuggagggcuccuuacuguguguuacgugcucaccggacgaucggccgauuuggaacuagagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauugcuggugaucucaggaguuuuuccaguaucgauaccaauuacggcagcagcaugguaccugugggaagugaagaaacaacgggcuggaguauugugggacgucccuucacccccaccagugggaaaagccgaacuggaagauggagcuuauagaaucaagcaaagagggauucuuggauauucucagauuggagccggaguuuacaaagaaggaacauuccauacaauguggcacgucacacguggugcuguucugaugcauagagggaaaaggauugaaccaucaugggcagacgucaagaaagaccuaauaucauauggaggaggcuggaagcuagaaggagaauggaaagaaggagaggaaguccaaguccuggcauuggaaccuggaaaaaauccaagagccguccaaacgaaaccuggacuuuucaaaaccaacaccggaaccauaggcgccguaucucuggacuuuuccccuggaacgucaggaucuccaauugucgauagaaaaggaaaaguugugggucuuuacgguaaugguguuguuacaaggaguggagcauaugugagugcuauagcccagaccgaaaaaagcauugaagacaauccagagaucgaagaugacaucuuccgaaagaaaagauugaccaucauggaccuccauccaggagcaggaaagacaaaaagauaccuuccagccauaguuagagaagccauaaaacguggcuugagaacauuaauccuggcucccacuagaguuguggcagcugaaauggaggaagcucuuagaggacuuccaauaagauaccaaaccccagccaucagagccgagcacaccgggcgggagaucguggaccuaaugugucaugccacauuuacuaugaggcugcuaucaccagucagagugccaaauuacaaccugaucaucauggacgaagcccacuucacagauccagcaaguauagcagcuagaggauauauuucaacucgaguagaaaugggugaagcagcugggauuuucaugacagccacuccuccgggaaguagagacccauuuccucagagcaaugcaccaaucauggaugaggaaagagaaaucccugagcguucguggaauucaggacaugaaugggucacggauuuuaaagggaagacuguuugguuuguuccaaguauaaaagcaggaaaugacauagcagcuugucucagaaaaaauggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccagucauacuaacagauggcgaagagcgggugauuuuggcaggaccuaugccagugacccacucuagugcagcacaaagaagagggagaguaggaagaaauccaaaaaaugaaaaugaccaguacauauacaugggggaaccucuggaaaaugaugaagacugugcacauuggaaagaagcuaaaaugcuccuagauaacaucaacacaccugaagggaucauuccuaguauguucgaaccagagcgugaaaagguggaugccauugauggugaauaccguuugagaggagaagcaaggaaaaccuuuguggaccuaaugagaagaggggacuuaccagucugguuggcuuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaagacaagagacgcacuggacaacuuagcugugcugcauacggcugaggcagguggaagggcguacaaucaugcucucagugaacugccggagacccuggagacacugcuuuuacugacacuccuggccacagucacaggaggaaucuucuuauucuuaaugagcggaaaagguauagggaagaugacccugggaauguguugcauaaucacggcuaguauccuccuaugguaugcacagauacaaccacacuggauagcagccucaauaauacuggaguuuuuccucauaguuuugcucauuccagaaccagaaaaacagagaacaccucaagacaaucaauugaccuacguagucauagccauccucacagugguggccgcaaccauggcaaaugagauggguuuccuggaaaaaaccaagaaagaccucggauugggaagcauuacaacccaggaaucugagagcaacauccuggacauagaucuacguccugcaucagcauggacgcuguaugccguggcuacaacauuugucacaccaauguugagacauagcauugaaaauuccucagugaaugucucccuaacagccauugcuaaccaagccacagugcuaaugggucuugggaaaggauggccauugucaaagauggacaucggaguuccccuccuugccauuggaugcuauucacaagucaacccuauaacucucacagcagcucuucuuuuauugguagcacauuauaccauuauagggccaggacuucaagcaaaagcaaccagagaagcucagaaaagagcagcagcaggcaucaugaaaaacccaacagucgaugggauaacagugauugaccuagaaccaauacccuaugauccaaaauuugaaaagcaguuaggacaaguaaugcuccuaauccucugcgugacucaaguauuaaugaugaggacuacaugggcucugugcgaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaagaacacaacaaacacaagaagaggaacuggcaacauaggagagacacuuggagaaaaauggaaaagccgauuaaacgcacugggaaaaagugaauuucagaucuacaagaaaaguggaauccaggaaguggauagaaccuuggcaaaagaaggcaucaaaagaggagaaacggaccaccacgcugugucgcgaggcucagcaaaacugagaugguuugucgagagaaauaugguaacaccagaagggaaggugguggaccucgguugcggcagagggggcuggucauacuauugugggggacugaagaauguaagagaagucaaaggccugacaaaaggaggaccaggacacgaggaacccauccccaugucaacauauggguggaaucuagugcgucugcaaaguggaguugacgucuucuucaccccaccagaaaagugugauacauuguugugugacauaggggagucgucaccaaaucccacgauagaagcaggacggacacucagaguccucaacuuaguggaaaauugguugaauaacaacacccaauuuugcauaaagguucucaacccauauaugcccucagucauagaaaaaauggaaacacuacaaaggaaauauggaggagcuuuagugaggaacccacucucacgaaacuccacacaugagauguacuggguauccaaugcuaccgggaacauagugucaucagugaacaugauuucaaggauguugauuaacagauucacaaugaaacacaagaaagccaccuaugagccagauguugaccuaggaagcggaacccgcaacauuggaauugaaagugagauaccaaaucuagacauaauaggaaagagaauagagaaaauaaagcaagagcaugaaacaucauggcacuaugaccaagaccacccauacaaaacaugggcuuaccaugguagcuaugaaacaaaacaaacuggaucagcaucaucuauggugaacggaguggucagacugcugacaaaaccuugggacgucgucccuauggugacacagauggcaaugacagacacgacuccauuuggacaacaacgcgucuucaaagagaaaguggacacgagaacccaagaaccgaaggaaggcacaaagaaacugaugagaauuacggcagaguggcuuuggaaagaacuaggaaagaaaaagacaccuaggauguguaccagagaagaauucacaagaaaggugagaagcaaugcagccuugggggccauauucacugaugaaaacaaauggaaaucggcucgugaggcuguugaagauaguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuauuuagaauuugaagcccuaggauucuugaaugaagaucacugguucuccagagggaacucccugaguggaguggaaggagaagggcugcacaggcuaggcuacauuuuaagagacgugagcaagaaggaagggggagcaauguacgccgaugacacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagcgggcaagucggcaccuauggccuuaauacuuucaccaacauggaagcccaauuaauuagacagauggagggagaaggaaucuucaaaagcauucagcaccugacagucacagaagaaaucgcuguacagaacugguuagcaagaguggggcgugaaaggcuaucaagaauggccaucaguggagaugauuguguuguaaaacccuuagaugacagauuugcaagugcuuuaacagcucuaaaugacaugggaaaaguuaggaaagauauacaacaaugggaaccuucaagaggauggaacgacuggacacaagugccuuucuguucacaccauuuucaugaguuagucaugaaagauggucgcgugcucguagucccaugcagaaaccaagaugaacugauugguagagcccgaauuucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaauaggguguggauccaagaaaacccguggauggaagacaaaacuccaguggaaucaugggaagaagucccauaucuggggaaaagagaagaccaauggugcggcucauugauugggcuaacaagcagggcuacuugggcaaagaacauccaaacagcaauaaaucaagucagaucccuuauaggcaaugaggaauacacagacuacaugccauccaugaagagauucagaagggaagaggaagaggcagguguccugugguag

SEQ ID NO: 6377 - RNA, 9876 nt, Artificial Sequence
  derived and/or modified CDS sequence (wt) from DENV-2__JX669484__SS-prME
acagcaggcgugauuauuauguugauuccaacagcaauggcguuccauuuaaccacacguaauggagaaccacacaugaucguugguaggcaagagaaagggaaaagucuucuguuuaaaacagaggauggugucaacaugugcacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccacauguggguaugggacuggagacacgaacugaaacauggaugucaucagaaggggccuggaaacauguucagagaauugaaaccuggaucuugagacauccaggcuuugccauaauggcagcaauccuggcauacaccauaggaacgacacauuuccaaagggccuugauuuucaucuuacugacagcagucgcuccuucaaugacaaugcguugcauaggaauaucaaauagagacuucguagaagggguuucaggaggaagcuggguugacauagucuuagaacauggaaguugugugacgacgauggcaaaaaauaaaccaacauuggauuuugaacugauaaaaacagaagccaaacaaccugccacucuaaggaaguacuguauagaagcaaagcugaccaauacaacaacagaaucucguugcccaacacaaggggaacccagucuaaaugaagagcaggacaaaagguucaucugcaaacacuccaugguagacagaggauggggaaauggauguggauuauuuggaaaaggaggcauugugaccugugcuauguucacaugcaaaaagaacauggaaggaaaagucgugcugccagaaaaucuggaauacaccaucgugauaacaccucacucaggagaagagcacgcuguagguaaugacacaggaaaacauggcaaggaaaucaaaauaacaccacagaguuccaucacagaagcagaacugacaggcuauggcacugucacgauggagugcucuccgagaacgggccucgacuucaaugagauggugcugcugcagauggaagagaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacucacgggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggacuuggaaaaaagacacgucuuaggucgccugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcgaagagaauggccauauuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguaguaccucacugucugugucacuaguauuggugggagucgugacacuguaccugggagcuauggugcaggcugauagugguugcguugugagcuggaaaaacaaagaauugaaauguggcagcgggauauucauuacagauaacgugcacacauggacagagcaauauaaguuccaaccagaauccccuucaaaacuagcuucagcuauccaaaaagcucacgaagagggcauuuguggaauccgcucaguaacaagauuggagaaucugauguggaaacaaauaacaccagaauugaaucacauccuaucagaaaaugagguaaaguugacuauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucguuggaaguugaagacuaugguuuuggaguuuuuaccaccaauauauggcuaaaacugagagaaaaacaggauguauuuugugacucaaaacucaugucagcggccauaaaagacaacagagccguccaugccgauauggguuauuggauagaaagugcacucaauggcacauggaagauggagaaagccucuuucauugaaguuaaaagcugccacuggccaaagucacacacccucuggagcaauggaguauuggaaagugagaugauaauuccaaaaaauuuugccgggccagugucacaacacaacuacagaccaggcuaccauacacaaacagcaggaccuuggcaucuagguaagcuugagauggacuucgauuucugcgaaggaaccacagugguggugacugaggacuguggaaauagaggacccucuuuaagaacgaccacugccucuggaaaacuuauaacagaauggugcugccgaucuugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacccgaguaggaacgaaacaugcaauacugcuagucgcaguaucuuuugugacauugauuacugggaacauguccuuuaaagaccugggaagagugaugguuauggugggcguugccaugacggaugauauagguaugggagugacuuaccuugcccuacuagcagcuuucaaaguuagaccaacuuucgcagcuggacuacucuugagaaaacugaccuccaaggaauuaaugauggccaccauaggaaucacacuccuuucccaaagcaccauaccagaaaccauucuugaacugacugaugcguuagccuugggcaugaugguccucaaaauagugagaaauauggaaaaguaccaauuggcagugaccaucaugacuaucucgugugucccaaaugcagugauacugcuaaacgcauggaaggugaguugcacaauauuggcagcgguguccguuucuccauugcuccuaacauccucacagcagaaaacggauuggauaccacuggcauugacgauaaaaggucucaauccaacagccaucuuucuaacaacucuuucgagaaccagcaagaaaaggagcuggccgcuaaaugaagcugucauggcagucgggauggugagcauuuuagccaguucucuccuaaagaaugacauucccaugacagguccauuaguggcuggagggcuccuuacuguguguuacgugcucacuggacgaucggccgauuuggaacuggagagagcugccgauguaaaaugggaagaucaggcagaaauaucaggaagcagcccaauccugucaauaacaauaucagaagauggcagcaugucgauaaagaaugaagaggaagaacaaacacugaccauacucaucagaacgggauugcuggugaucucaggaguuuuuccaguaucgauaccaauuacggcagcagcaugguaccugugggaagugaagaaacaacgggcuggaguauugugggacgucccuucacccccaccagugggaaaagccgaacuggaagauggagcuuauagaaucaagcaaagagggauucuuggauauucucagauuggagccggaguuuacaaagaaggaacauuccauacaauguggcacgucacacguggugcuguucugaugcauagagggaaaaggauugaaccaucaugggcagacgucaagaaagaccuaauaucauauggaggaggcuggaagcuagaaggagaauggaaagaaggagaggaaguccaaguccuggcauuggaaccuggaaaaaauccaagagccguccaaacgaaaccuggacuuuucaaaaccaacaccggaaccauaggcgccguaucucuggacuuuuccccuggaacgucaggaucuccaauugucgauagaaaaggaaaaguugugggucuuuacgguaaugguguugucacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagaguuguggcagcugaaauggaggaagcucuuagaggacuuccaauaagauaccaaaccccagccaucagagccgagcacaccgggcgggagaucguggaccuaaugugucaugccacauuuacuaugaggcugcuaucaccagucagagugccaaauuacaaccugaucaucauggacgaagcucacuucacagauccagcaaguauagcagcuagaggauauauuucaacucgaguagaaaugggugaagcagcugggauuuucaugacagccacuccuccgggaaguagagacccauuuccucagagcaaugcaccaaucauggaugaggaaagagaaaucccugagcgcucguggaauucaggacaugaaugggucacggacuuuaaagggaagacuguuugguuuguuccaaguauaaaagcaggaaaugacauagcagcuugucucaggaaaaauggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccagucauacuaacagauggcgaagagcgggugauuuuggcaggaccuaugccagugacccacucuagugcagcacaaagaagagggagaguaggaagaaauccaaaaaaugaaaaugaccaguacauauacaugggggaaccucuggaaaaugaugaagacugugcacauuggaaagaagcuaaaaugcuccuagauaacaucaacacaccugaaggaaucauuccuaguauguucgaaccagagcgugaaaagguggaugccauugauggugaauaccguuugagaggagaagcaaggaaaaccuuuguggaccuaaugagaagaggggacuuaccagucugguuggccuacagaguggcagcugagggcaucaacuacgcagacagaaggugguguuuugauggaaucaagaacaaccaaauacuggaagaaaacguggaaguggaaaucuggacaaaagaaggggaaaggaagaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagagaugcacuggacaacuuagcugugcugcauacggcugaggcagguggaagggcguauaaucaugcucucagugaacugccagagacccuggagacacugcuuuuacugacacuccuggccacagucacaggaggaaucuucuuauucuuaaugagcggaaaagguguagggaagaugacccugggaauguguugcauaaucacggcuagcauccuccuaugguaugcacagauacaaccacacuggauagcagcuucaauaauacuggaguuuuuccucauaguuuugcucauuccagaaccagaaaaacagagaacaccccaagacaaccaauugaccuacguagucauagccauccucacagugguggccgcaaccauggcaaaugagauggguuuccuggaaaaaaccaagaaagaccucggauugggaagcauuacaacccaggaaucugagagcaacauccuggacauagauuuacguccugcaucagcauggacgcuguaugccguggcuacaacauuugucacaccaauguugagacauagcauugaaaauuccucagugaaugucucccuaacagccauugcuaaccaagccacagugcuaaugggucuugggaaaggauggccacugucaaagauggacaucggaguuccccuccuugccauuggaugcuauucacaggucaacccuauaacucucacagcagcucuucuuuuauugguagcacauuaugccauuauagggccaggacuucaagcaaaagcaaccagagaagcucagaaaagagcagcagcaggcaucaugaaaaacccaacagucgaugggauaacagugauugaccuagaaccaauacccuaugauccaaaauuugaaaagcaguuaggacaaguaaugcuccuaauccucugcgugacucaaguauuaaugaugaggacuacaugggcucugugugaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaagaacacaacaaacacaagaagaggaacuggcaacauaggagagacacuuggagaaaaauggaaaagccgauuaaacgcacugggaaaaagugaauuccagaucuacaagaaaaguggaauccaggaaguggauagaaccuuggcaaaagaaggcaucaaaagaggagaaacggaccaccacgcugugucgcgaggcucagcaaaacugagaugguucgucgagagaaauauggucacaccagaagggaaggugguggaccuugguugcggcagagggggcuggucauacuauugugggggacuaaagaauguaagagaagucaaaggccugacaaaaggaggaccaggacacgaagaacccauccccaugucaacauauggguggaaucuagugcgucugcaaaguggaguugacgucuucuucaccccgccagaaaagugugauacauuguugugugacauaggggagucgucaccaaaucccacgauagaagcaggacggacacucagaguccucaacuuaguggaaaauugguugaacaacaacacccaauuuugcauaaaaguucucaacccauauaugcccucagucauagaaaaaauggaaacacuacaaaggaaauauggaggagcuuuagugaggaauccacucucacgaaacuccacacaugagauguacuggguauccaaugcuaccgggaacauagugucaucagugaacaugauuucaaggauguugauuaacagauucacaaugaaacacaagaaagccaccuacgagccagauguugaccuaggaagcggaacccgcaacauuggaauugaaagugagauaccaaaucuagacauaauaggaaagagaauagagaaaauaaagcaagagcaugaaacaucauggcacuaugaccaagaccacccauacaaaacaugggcuuaccaugguagcuaugaaacaaaacaaacuggaucagcaucaucuauggugaacggaguggucagacugcugacaaaaccuugggacgucgucccuauggugacacagauggcaaugacagacacgacuccauuuggacaacaacgcgucuucaaagagaaaguggacacgagaacccaagaaccgaaggaaggcacaaagaaacugaugagaauuacggcagaguggcuuuggaaagaacuaggaaagaaaaagacaccuaggauguguaccagagaagaauucacaagaaaggugagaagcaaugcagccuugggggccauauucacugaugaaaacaaauggaaaucggcucgugaggcuguugaagauaguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuuuuuagaguuugaagcccuaggauucuugaaugaagaucacugguucuccagagggaacucccugaguggaguggaaggagaagggcugcacaggcuaggcuacauuuuaagagacgugagcaagaaggaagggggagcaauguacgccgaugauacagcaggaugggacacaagaaucacacuagaagacuuaaaaaaugaagaaaugguaauaaaccacaugaaaggagaacacaagaaacuagccgaggccauauucaaauuaacguaccaaaauaagguggugcgugugcaaagaccaacaccaagaggcacaguaauggauaucauaucgagaagagaccaaagaggcagcgggcaagucggcaccuauggccuuaauacuuucaccaacauggaagcccaauuaauuagacagauggagggagaaggaaucuucaaaagcauucagcaccugacagucacagaagaaaucgcuguacagaacugguuagcaagaguggggcgugaaaggcuaucaagaauggccaucaguggagaugauuguguuguaaaacccuuagaugacagauuugcaagugcuuuaacagcucuaaaugacaugggaaaaguuaggaaagauauacaacaaugggaaccuucaagaggauggaacgacuggacacaagugccuuucuguucacaccauuuucaugaguuagucaugaaagauggucgcgugcucguagucccaugcagaaaccaagaugaacugauugguagagcccgaauuucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaauaggguguggauccaagaaaacccguggauggaagacaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauucagaagggaagaggaagaggcagguguccugugguag

SEQ ID NO: 6378 - RNA, 9876 nt, Artificial Sequence
  derived and/or modified CDS sequence (wt) from DENV-2__JX669485__SS-prME
acagcaggcgugauuauuauguugauuccaacagcaauggcguuccauuuaaccacacguaauggagaaccacacaugaucguugguaagcaagagaaagggaaaagucuucuguuuaaaacagaggauggugucaacaugugcacccucauggccauagaccuuggugaauugugugaagacacaaucacguacaagugcccccuccucaggcaaaaugaaccagaagacauagauuguuggugcaacuccacguccacauggguaacuuacgggacauguaccaccacaggagaacacagaagagaaaaaagaucaguggcacucguuccacauguggguaugggacuggagacacgaacugaaacauggaugucaucagaaggggccuggaaacauguucagagaauugaaaccuggaucuugagacauccaggcuuugccauaauggcagcaauccuggcauacaccauaggaacgacacauuuccaaagggccuugauuuucaucuuacugacagcugucgcuccuucaaugacaaugcguugcauaggaauaucaaauagagacuucguagaagggguuucaggaggaagcuggguugacauagucuuagaacauggaaguugugugacgacgauggcaaaaaauaaaccaacauuggauuuugaacugauaaaaacagaagccaaacaaccugccacucuaaggaaguacuguauagaagcaaagcugaccaauacaacaacagaaucucguugcccaacacaaggggaacccagucuaaaugaagagcaggacaaaagguucaucugcaaacacuccaugguagacagaggauggggaaauggauguggauuauuuggaaaaggaggcauugugaccugugcuauguucacaugcaaaaagaacauggaaggaaaagucgugcugccagaaaaucuggaauacaccaucgugauaacaccucacucaggagaagagcacgcuguagguaaugacacaggaaaacauggcaaggaaaucaaaauaacaccacagaguuccaucacagaagcagaacugacaggcuauggcacugucacgauggagugcucuccgagaacgggccucgacuucaaugagauggugcugcugcaaauggaagagaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacucacgggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggacuuggaaaaaagacacgucuuaggucgccugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcgaagagaauggccauauuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguaguaccucacugucugugucacuaguauuggugggagucgugacacuguaccugggagcuauggugcaggcugauagugguugcguugugagcuggaaaaacaaagaauugaaauguggcagcgggauauucauuacagauaacgugcacacauggacagagcaauauaaguuccaaccagaauccccuucaaaacuagcuucagcuauccaaaaagcucacgaagagggcauuuguggaauccgcucaguaacaagauuggagaaucugauguggaaacaaauaacaccagaauugaaucacauccuaucagaaaaugagguaaaguugaccauuaugacaggagacauuaaaggaaucaugcaggcaggaaaacgaucuuugcggccccagcccacugaguugaaguacucauggaaaacauggggaaaggcgaaaaugcucuccacagagucucacaaucagaccuuucuuauugauggcccugaaacagcagaaugccccaacacaaacagagcuuggaacucguuggaaguugaagacuaugguuuuggaguuuuuaccaccaauauauggcuaaaacugagagaaaaacaggauguauuuugugacucaaaacucaugucagcggccauaaaagacaacagagccguccaugccgauauggguuauuggauagaaagugcacucaacggcacauggaagauggagaaagccucuuucauugaaguuaaaagcugccacuggccaaagucacacacccucuggagcaauggaguauuggaaagugagaugauaauuccaaaaaauuuugccgggccagugucacaacacaacuacagaccaggcuaccauacacaaacagcaggaccuuggcaucuagguaagcuugagauggacuucgauuucugcgaaggaaccacagugguggugacugaggacuguggaaauagaggacccucuuuaagaacgaccacugccucuggaaaacuuauaacagaauggugcugccgaucuugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacccgaguaggaacgaaacaugcaauacugcuagucgcaguaucuuuugugacauugauuacugggaacauguccuuuagagaccugggaagagugauaguuauggugggcguuaccaugacggaugauauagguaugggagugacuuaccuugcccuacuagcagcuuucaaaguuagaccaacuuucgcagcuggacuacucuugagaaaacugaccuccaaggaauuaaugauggccaccauaggaaucacacuccuuucccaaagcaccauaccagaaaccauucuugaacugacugaugcguuagccuugggcaugaugguccucaaaauagugagaaauauggaaaaguaccaauuggcagugaccaucauggcuaucucgugugucccaaaugcagugauacugcuaaacgcauggaaggugaguugcacaauauuggcagugguguccguuucuccauugcuccuaacaucuucacagcagaaaacggauuggauaccacuggcauugacgauaaaaggucucaauccaacagccaucuuucuaacaacucuuucgagaaccagcaagaaaaggagcuggccgcuaaaugaagcugucauggcaguugggauggugagcauuuuagccaguucucuccuaaagaaugacauucccaugacagguccauuaguggcuggagggcuccuuacuguguguuacgugcucacuggacgaucggccgauuuggaacuggagagagcugccgauguaaaaugggaagaucaggcagaaauaucaggaagcagcccaauccugucaauaacaauaucagaagauggcagcaugucgauaaagaaugaagaggaagaacaaacacugaccauacucaucagaacgggauugcuggugaucucaggaguuuuuccaguaucgauaccaauuacggcagcagcaugguaccugugggaagugaagaaacaacgggcuggaguauugugggacgucccuucacccccaccaguggaaaaagccgaacuggaagauggagcuuauagaaucaagcaaagagggauucuuggauauucucagauuggagccggaguuuacaaagaaggaacauuccauacaauguggcacgucacacguggugcuguucugaugcauagagggaaaaggaucgaaccaucaugggcagacgucaagaaagaccuaauaucauauggaggaggcuggaagcuagaaggagaauggaaagaaggagaggaaguccaaguccuggcauuggaaccuggaaaaaauccaagagccguccaaacgaaaccuggacuuuucaaaaccaacaccggaaccauaggcgccguaucucuggacuuuuccccuggaacgucaggaucuccaauugucgauagaaaaggaaaaguugugggucuuuacgguaaugguguugucacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagaguuguggcagcugaaauggaggaagcucuuagaggacuuccaauaagauaccaaacuccagccaucagagccgagcacaccgggcgggagaucguggaccuaaugugucaugccacauuuacuaugaggcugcuaucaccagucagagugccaaauuacaaccugaucaucauggacgaagcucacuucacagauccagcaaguauagcagcuagaggauauauuucaacucgaguagaaaugggugaagcagcugggauuuucaugacagccacuccuccgggaaguagagacccauuuccucagagcaaugcaccaaucauggaugaggaaagagaaaucccugagcgcucguggaauucaggacaugaaugggucacggauuuuaaagggaagacuguuugguuuguuccaaguauaaaagcaggaaaugacauagcagcuugucucagaaaaaauggaaagaaagugauacaacucaguaggaagacuuuugacucugaguauguuaagacuagagccaacgauugggacuuuguggucacaacugacauuucagaaaugggugccaacuucaaggcugagaggguuauagaccccagacguugcaugaaaccagucauacuaacagauggcgaagagcgggugauuuuggcaggaccuaugccagugacccacucuagugcagcacaaagaagagggagaguaggaagaaauccaaaaaaugaaaaugaccaguacauauacaugggggaaccucuggaaaaugaugaagacugugcacauuggaaagaagcuaaaaugcuccuagauaacaucaacacaccugaaggaaucauuccuaguauguucgaaccagagcgugaaaagguggaugccauugauggugaauaccguuugagaggagaagcaaggaaaaccuuuguggaccuaaugagaagaggggacuuaccagucugguuggccuacagaguggcagcugagggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagagacgcacuggacaacuuagcugugcugcauacggcugaggcagguggaagggcguacaaucaugcucucagugaacugccggagacccuggagacacugcuuuuacugacacuccuggccacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuccucauaguuuugcucauuccagaaccagaaaaacagagaacaccccaagacaaccaauugaccuacguagucauagccauccucacagugguggccgcaaccauggcaaaugagauggguuuccuggaaaaaaccaagaaagaccucggauugggaagcauuacaacccaggaaucugagagcaacauccuggacauagaucuacguccugcaucagcauggacgcuguaugccguggcuacaacauuugucacaccaauguugagacauagcauugaaaauucuucagugaaugucucccuaacagccauugcuaaccaagccacagugcuaaugggucuugggaaaggauggccauugucaaagauggacaucggaguuccccuccuugccauuggaugcuauucacaggucaacccuauaacucucacagcagcucuucuuuuauugguagcacauuaugccauuauagggccaggacuucaagcaaaagcaaccagagaagcucagaaaagagcagcagcaggcaucaugaaaaacccaacagucgaugggauaacagugauugaccuagaaccaauacccuaugauccaaaauuugaaaagcaguuaggacaaguaaugcuccuaauccucugcgugacucaaguauuaaugaugaggacuacaugggcucugugugaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaagaacacaacaaacacaagaagaggaacuggcaacauaggagagacacuuggagaaaaauggaaaagccgauuaaacgcacugggaaaaagugaauuucagaucuacaagaaaaguggaauccaggaaguggauagaaccuuggcaaaagaaggcaucaaaagaggagaaacggaccaccacgcugugucgcgaggcucagcaaaacugagaugguucgucgagagaaauauggucacaccagaagggaaggugguggaccuugguugcggcagagggggcuggucauacuauugugggggacuaaagaauguaagagaagucaaaggccugacaaaaggaggaccaggacacgaagaacccauucccaugucaacauauggguggaaucuagugcgucugcaaaguggaguugacgucuucuucaccccgccagaaaagugugauacauuguugugugacauaggggagucgucaccaaaucccacgauagaagcaggacggacacuuagaguccucaacuuaguggaaaauugguugaacaauaacacccaauuuugcauaaaaguucucaacccauauaugcccucagucauagaaaaaauggaaacacuacaaaggaaauauggaggagcuuuagugaggaauccacucucacgaaacuccacacaugagauguacuggguauccaaugcuaccgggaacauagugucaucagugaacaugauuucaaggauguugauuaacagauucacaaugaaacacaagaaagcuaccuacgagcuagauguugaccuaggaagcggaacccgcaacauuggaauugaaagugagacaccaaaucuagauauaauaggaaagagaauagagaaaauaaagcaagagcaugaaacaucauggcacuaugaccaagaccacccauacaaaacaugggcuuaccaugguagcuaugaaacaaaacaaacuggaucagcaucaucuauggugaacggaguggucagacugcugacaaaaccuugggacgucgugccuauggugacacagauggcaaugacagacacgacuccauuuggacaacaacgcgucuucaaagagaaaguggacacaagaacccaagaaccgaaggaaggcacaaagaaacugaugagaauuacggcagaguggcuuuggaaagaacuaggaaagaaaaagacaccuaggauguguaccagagaagaauucacaagaaaggugagaagcaaugcagccuugggggccauauucacugaugaaaacaaauggaaaucggcucgugaggcuguugaagauaguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuuuuuagaguuugaagcccuaggauucuugaaugaagaucacugguucuccagagggaacucccugaguggaguggaaggagaagggcugcacaggcuaggcuacauuuugagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagcgggcaagucggcaccuauggccuuaauacuuucaccaacauggaagcccaauuaauuagacagauggagggagaaggaaucuucaaaaguauucagcaccugacagucacagaagaaaucgcuguacagaacugguuagcaagaguggggcgugaaaggcuaucaagaauggccaucaguggagaugauuguguuguaaaacccuuagaugacagauuugcaagugcuuuaacagcucuaaaugacaugggaaaaguuaggaaagauauacaacaaugggaaccuucaagaggguggaacgacuggacacaagugccuuucuguucacaccauuuucaugaguuagucaugaaagauggucgcgugcucguagucccaugcagaaaccaagaugaacugaucgguagagcccgaauuucccagggagccggguggucuuugaaggagacggccuguuuggggaagucuuacgcccaaauguggacccugauguacuuccacagacgugaucucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaaguuccauacuuggggaaaagagaagaccaauggugcggcucauugaucgggcuaacaagcagggcuaccugggcaaagaacauccaaacagcaauaaaucaagucagaucccuuauaggcaaugaggaauacacagacuacaugccauccaugaagagauucagaagggaagaggaagaggcagguguccugugguag

SEQ ID NO: 6379 - RNA, 9876 nt, Artificial Sequence
  derived and/or modified CDS sequence (wt) from DENV-2__JX669486__SS-prME
acagcaggcgugauuauuauguugauuccaacagcaauggcguuccauuuaaccacacguaauggagaaccacacaugaucguugguaggcaagagaaagggaaaagucuucuguuuaaaacagaggauggugucaacaugugcacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccacauguggguaugggacuggagacacgaacugaaacauggaugucaucagaaggggccuggaaacauguucagagaauugaaaccuggaucuugagacauccaggcuuugccauaauggcagcaauccuggcauacaccauaggaacgacacauuuccaaagggccuugauuuuuaucuuacugacagcugucgcuccuucaaugacaaugcguugcauaggaauaucaaauagagacuucguagaagggguuucaggaggaagcuggguugacauagucuuggaacauggaaguugugugacgacgauggcaaaaaacaaaccaacauuggauuuugaacugauaaaaacagaagccaaacaaccugccacucuaaggaaguacuguauagaagcaaagcugaccaauacaacaacagaaucucguugcccaacacaaggggaacccagucuaaaugaagagcaggacaaaagguucaucugcaaacacuccaugguagacagaggauggggaaauggauguggauuauuuggaaaaggaggcauugugaccugugcuauguucacaugcaaaaagaacauggaaggaaaagucgugcugccagaaaaucuggaauacaccaucgugauaacaccucacucaggagaagagcacgcuguagguaaugacacaggaaaacauggcgaggaaaucaaaauaacaccacagaguuccaucacagaagcagaacugacaggcuauggcacugucacgauggagugcucuccgagaacgggccucgacuucaaugagauggugcugcugcagauggaagagaaagcuuggcuggugcacaggcaaugguuccuagaccugccguuaccauggcuacccggagcggacacacaaggaucaaauuggauacagaaagagacauuggucacuuucaaaaauccccaugcgaagaaacaggaugucguuguuuuaggaucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagacacgucuuaggucgccugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcgaagagaauggccauauuaggugacacagccugggauuuuggaucccugggaggaguguucacaucuauaggaaaggcucuccaccaaguuuucggagcaaucuauggggcugcuuuuaguggggucucauggacuaugaaaauccucauaggagucaucaucacauggauaggaaugaauucacguaguaccucacugucugugucacuaguauuggugggagucgugacacuguaccugggagcuauggugcaggcugauagugguugcguugugagcuggaaaaacaaagaauugaaauguggcagcgggauauucauuacagauaacgugcacacauggacagagcaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauccuaucagaaaaugagguaaaguugaccauuaugacaggagacaucaaaggaaucaugcaggcaggaaaaagaucuuugcggccccagcccacugagcugaaguacucauggaaaacauggggaaaggcgaaaaugcucuccacagagucccacaaucagaccuuucuuauugauggcccugaaacagcagaaugccccaacacaaacagagcuuggaacucguuggaaguugaagacuaugguuuuggaguuuuuaccaccaauauauggcuaaaacugagagaaaaacaggauguauuuugugacucaaaacucaugucagcggccauaaaagacaacagagccguccaugccgauauggguuauuggauagaaagugcacucaaugacacauggaagauggagaaagccucuuucauugaaguuaaaagcugccacuggccaaagucccacacccucuggagcaauggaguauuggaaagugagaugauaauuccaaaaaauuuugccgggccagugucacaacacaacuacagaccaggcuaccauacacaaacagcaggaccuuggcaucuagguaagcuugagauggacuucgauuucugcgaaggaaccacagugguggugacugaggacuguggaaauagaggacccucuuuaagaacgaccacugccucuggaaaacuuauaacagaauggugcugccgaucuugcacacuaccaccucuaagauacagaggugaggauggaugcugguacgggauggaaaucagaccauugaaagagaaagaggagaauuuggucaacuccuuggucacagccggacaugggcagauugacaacuuuucgcuaggagucuugggaauggcacuguuucuggaagaaaugcucaggacccgaguaggaacgaaacaugcaauacugcuagucgcaguaucuuuugugacauugaucacugggaacauguccuuuagagacuugggaagagugaugguuauggugggcguuaccaugacggaugauauagguaugggagugacuuaccuugcccuauuagcagcuuucaaaguuagaccaacuuucgcagcuggacuacucuugagaaaacugaccuccaaggaauuaaugauggccaccauaggaauuacacuccuuucccaaagcaccacaccagaaaccauucuugaacugacugaugcguuagccuugggcaugaugguccuaaaaauagugagaaauauggaaaaguaccaauuggcagugaccaucaugacuaucuugugugucccaaaugcagugauacugcuaaacgcauggaaggugaguugcacaauauuggcagugguguccguuucuccauugcuccuaacauccucacagcagaaaacggauuggauaccacuggcauugacgauaaaaggucucaauccaacagccaucuuucuaacaacccuuucgagaaccagcaagaaaaggagcuggccgcuaaaugaagcugucauggcagucgggauggugagcauuuuagccaguucucuccuaaagaaugacauucccaugacagguccauuaguggcuggagggcuccuuacuguguguuacgugcucacuggacgaucggccgauuuggaacuggagagagcugccgauguaaaaugggaagaucaggcagaaauaucaggaagcagcccaauccugucaauaacaauaucagaagauggcagcaugucgauaaagaaugaagaggaagaacaaacacugaccauacucaucagaacgggauugcuggugaucucaggaguuuuuccaguaucgauaccaaucacggcagcagcaugguaccugugggaagugaagaaacaacgggcuggaguauugugggacgucccuucacccccaccaguggaaaaagccgaacuggaagauggagcuuauagaaucaagcaaagagggauucuuggauauucucagauuggagccggaguuuacaaagaaggaacauuccacacaauguggcacgucacacguggugcuguucugaugcauagagggaaaaggauugaaccaucaugggcagacgucaagaaagaccuaauaucauauggaggaggcuggaagcuagaaggagaauggaaagaaggagaggaaguccaaguccuggcauuggaaccuggaaaaaauccaagagccguccaaacgaaaccuggacuuuucaaaaccaacaccggaaccauaggcgccgugucucuggacuuuuccccuggaacgucaggaucuccaauugucgauagaaaaggaaaaguugugggucuuuacgguaaugguguugucacaaggaguggagcauaugugagugcuauagcccagaccgaaaaaagcauugaagacaauccagagaucgaagaugacauuuuccgaaagaaaagauugaccaucauggaucuccauccaggagcaggaaagacaaaaagauaccuuccagccauaguuagagaagccauaaaacguggcuugagaacauuaauccuggcucccacuagaguuguggcagcugaaauggaggaagcucuuagaggacuuccaauaagauaccaaaccccagccaucagagccgagcacaccgggcgggagauuguggaccuaaugugucaugccacauuuacuaugaggcugcuaucaccagucagagugccaaauuacaaccugauuaucauggacgaagcccacuucacagauccagcaaguauagcagcuagaggauauauuucaacucgaguagaaaugggugaagcagcugggauuuuuaugacagccacuccuccgggaaguagagacccauuuccucagagcaaugcaccaaucauggaugaggaaagagaaaucccugagcgcucguggaauucaggacaugaaugggucacggauuuuaaagggaagacuguuugguuuguuccaaguauaaaagcaggaaaugacauagcagcuugucucagaaaaaauggaaagaaagugauacaacucaguaggaagacuuuugacucugaguauguuaagacuagagccaaugauugggacuuuguggucacaacugacauuucagaaaugggcgccaacuucagggcugagaggguuauagaccccagacguugcaugaaaccagucauacuaacagauggcgaagagcgagugauuuuggcaggaccuaugccagugacccacucuagugcagcacaaagaagagggagaguaggaagaaauccaaaaaaugaaaaugaccaguacauauacaugggggaaccucuggaaaaugaugaagacugugcacauuggaaagaagcuaaaaugcucuuagauaacaucaacacaccugaaggaaucauuccuaguauguucgaaccagagcgugaaaagguggaugccauugauggugaauaccguuugagaggagaagcaaggaaaaccuuuguggaccuaaugagaagaggggacuuaccagucugguuggccuacagaguggcagcugagggcaucaacuacgcagacagaaggugguguuuugauggaauuaagaacaaccagauacuggaagaaaacguggaaguggaaaucuggacaaaagaaggggaaaggaagaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagaaacgcacuggacaacuuagcugugcugcauacggcugaggcagguggaagggcguacaaucaugcucucagugaacugccggagacccuggagacacugcuuuuacugacacuccuggccacagucacaggaggaaucuucuuauucuuaaugagcggaaaagguauagggaagaugacucugggaauguguugcauaaucacggcuaguguccuccuaugguaugcacagauacaaccacacuggauagcagcuucaauaauacuggaguuuuuccucauaguuuugcucauuccagaaccagaaaaacagagaacaccccaagacaaccaauugaccuacguagucauagccauccucacagugguggccgcaaccauggcaaaugagauggguuuccuggaaaaaaccaagaaagaccucggacugggaagcauuacaacccaggaaucugagagcaacauccuggacauagaucuacguccugcaucagcauggacgcuguaugccguggcuacaacauuugucacaccaauguugagacauagcauugaaaauuccucagugaaugucucccuaacagccauugcuaaccaagccacagugcuaaugggucuugggaaaggauggccauugucaaagauggacaucggaguuccccuccuugccauuggaugcuacucacaagucaacccuauaacucucacagcagcucuucuuuuauugguagcacauuaugccauuauagggccaggacuucaagcaaaagcaaccagagaagcucagaaaagagcagcagcaggcaucaugaaaaacccaacagucgaugggauaacagugguugaccuagaaccaauacccuaugauccaaaauuugaaaagcaguuaggacaaguaaugcuccuaauccucugcgugacucaaguguuaaugaugaggacuacaugggcucugugugaggcucuaacccuagcgaccgggcccaucuccacacugugggaaggaaauccugggagguuuuggaacaccaccauugcagugucaauggcuaacaucuuuagggggagcuacuuggccggagcuggacuucucuuuuccaucaugaagaacacaacaaacacaagaagaggaacuggcaacauaggagagacacuuggagaaaaauggaaaagccgauuaaacgcacugggaaaaagugaauuucagaucuacaagagaaguggaauccaggaaguggauagaaccuuggcaaaagaaggcaucaaaagaggagaaacggaccaccacgcugugucgcgaggcucagcaaaacugagaugguucgucgagagaaauauggucacaccagaagggaaggugguggaccucgguugcggcagagggggcuggucauacuauugugggggacuaaagaauguaagagaagucaaaggccugacaaaaggaggaccaggacacgaagaacccauccccaugucaacauauggguggaaucuagugcgucugcaaaguggaguugacgucuucuucaccccgccagaaaagugugauacauuguugugugacauaggggagucgucaccaaaucccacgauagaagcaggacggacacucagaguccuuaacuuaguggaaaauugguugaacaacaacacccaauuuugcauaaagguucucaacccauauaugcccucagucauagaaaaaauggaaacacuacaaaggaaauauggaggagcuuuagugaggaauccacucucacgaaacuccacacaugagauguacuggguauccaaugcuaccgggaacauagugucaucagugaacaugauuucaaggauguugauuaacagauucacaaugaaacacaagaaagccaccuacgagccagauguugaccuaggaagcggaacccgcaacauuggaauugaaagugagauaccaaaucuagacauaauaggaaagagaauagagaaaauaaagcaagagcaugaaacaucauggcacuaugaccaagaccacccauacaaaacaugggcuuaccaugguagcuaugaaacaaaacaaacuggaucagcaucaucuauggugaacggaguggucagacugcugacaaaaccuugggacgucgucccaauggugacacagauggcaaugacagacacgacuccauuuggacaacaacgcgucuucaaagagaaaguggacacgagaacccaagaaccgaaggaaggcacaaagaaacugaugagaauuacggcagaguggcuuuggaaagaacuaggaaagaaaaagacaccuaggauguguaccagagaagaauucacaagaaaggugagaagcaaugcagccuugggggccauauucacugaugaaaacaaauggaaaucggcucgugaggcuguugaagauaguagguuuugggagcugguugacagggaaagaaaucuccaucuugaaggaaagugugaaacauguguguacaacaugaugggaaaaagagagaagaagcuaggggaguucggcaaggcaaaagguagcagagccauaugguacauguggcuuggagcacgcuuuuuagaguuugaagcccuaggauucuugaaugaagaucacugguucuccagagggaacucccugaguggaguggaaggagaagggcugcacaggcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccguauucaaauuaacguaccaaaacaagguggugcgugugcaaagaccaacaccaagaggcacaguaauggauaucauaucgagaagagaccaaagaggcagcgggcaagucggcaccuauggccuuaauacuuucaccaacauggaagcccaauuaauuagacagauggagggagaaggaaucuucaaaagcauucagcaccugacagucacagaagaaaucgcuguacagaacugguuagcaagaguggggcgugaaaggcuaucaagaauggccaucaguggagaugauuguguuguaaaacccuuagaugacagauuugcaagugcuuuaacagcucuaaaugacaugggaaaaguuaggaaagauauacaacaaugggaaccuucaagaggauggaacgacuggacacaagugccuuucuguucacaccauuuccaugaguuagucaugaaagauggucgcgugcucguagucccaugcagaaaccaagaugaacugauugguagagcccgaauuucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaauaggguguggauccaagaaaacccguggauggaagacaaaacuccaguggaaucaugggaagaagucccauacuuggggaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauucagaagggaagaggaagaggcagguguccugugguag

SEQ ID NO: 6380 - RNA, 9876 nt, Artificial Sequence
  derived and/or modified CDS sequence (wt) from DENV-2__JX669487__SS-prME
acagcaggcgugauuauuauguugauuccaacagcaauggcguuccauuuaaccacacguaauggagaaccacacaugaucguugguaggcaagagaaagggaaaagucuucuguuuaaaacagaggaugguguuaacauguguacucucauggccauagaccuuggugaauugugugaagauacaaucacguacaaguguccccuccucaggcaaaaugaaccagaagacauagauuguuggugcaacuccacguccacauggguaacuuaugggacauguaccaccacaggagaacacagaagagaaaaaagaucaguggcacucguuccacauguggguaugggacuggagacacgaacugaaacauggaugucaucagaaggggccuggaaacauguucagagaauugaaaccuggaucuugagacauccaggcuuugccauaauggcagcaauccuggcauacaccauaggaacgacacauuuccaaagggccuugauuuucaucuuacugacagcugucgcuccuucaaugacaaugcguugcauaggaauaucaaauagagacuucguagaagggguuucaggaggaagcuggguugacauagucuuagaacauggaaguugugugacgacgauggcaaaaaauaaaccaacauuggauuuugaacugauaaaaacagaagccaaacaaccugccacuuuaaggaaguacuguauagaagcaaagcugaccaauacaacaacagaaucucguugcccaacacaaggggaacccagucuaaaugaagagcaggacaaaagguucaucugcaaacacuccaugguagacagaggauggggaaauggauguggauuauuuggaaaaggaggcaucgugaccugugcuauguucacaugcaaaaagaacauggaaggaaaagucgugcugccagagaaucuugaauacacuaucaugauaacaccucacucaggagaagagcacgcuguagguaaugacacaggaaaacauggcaaggaaaucaaaauaacaccacagaguuccaucacagaagcagaacugacaggcuauggcacugucacgauggagugcucuccgagaacgggccucgacuucaaugagaugguacugcugcagauggaagagaaagcuuggcuggugcacaggcaaugguucuuagaccugccguuaccauggcuacccggagcggacacacaaggaucaaauuggauacagaaagagacauuggucacuuucaaaaauccccacgcgaagaaacaagacgucguuguuuuaggaucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagacacgucuuaggccgccugauuacaguuaacccaaucguaacagaaaaagauagcccagucaacauagaagcagaaccuccauucggagacaguuacaucaucauaggaguagagccgggacaauugaaacucaauugguuuaagaagggaaguuccaucggccaaauguuugagacaacaaugagaggagcgaagagaauggccauauuaggcgacacagccugggauuuuggaucccugggaggaguguuuacaucuauaggaaaggcucuccaccaaguuuucggagcaaucuauggggcugcuuuuaguggggucucauggacuaugaaaauccucauaggagucaucauuacauggauaggaaugaauucacguaguaccucacugucugugucacuaguauuggugggagucgugacacuguaccugggagcuauggugcaggcugauagugguugcguugugagcuggaaaaacaaagaauugaaauguggcagcgggaucuucaucacagauaacgugcacacguggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauuaaaucacauccuaucagaaaaugagguaaaguuaaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucguuggaaguugaagacuaugguuuuggaguuuuuaccaccaauauauggcuaaaacugagagaaaaacaggauguauuuugugacucaaaacucaugucagcggccauaaaagacaacagagccguccaugccgauauggguuauuggauagaaagugcacucaaugacacauggaagauggagaaagccucuuucauugaaguaaaaagcugccacuggccaaagucacacacccucuggagcaauggaguauuggaaagugagaugauaauuccaaaaaauuuugccgggccagugucacaacacaacuacagaccaggcuaccauacacaaacagcaggaccuuggcaucuagguaagcuugagauggacuucgauuucugcgaaggaaccacagugguggugacugaggacuguggaaauagaggacccucuuuaagaacgaccacugccucuggaaaacuuauaacagaauggugcugccgaucuugcacacuaccaccucuaagauacagaggugaggauggaugcugguacgggauggaaaucagaccauugaaagagaaagaggagaauuuggucaacuccuuggucacagccggacauggacagauugacaacuuuucacuaggagucuugggaauggcacuguuccuggaagaaaugcucaggacccgaguaggaacgaaacaugcaauacugcuagucgcaguaucuuuugugacauugauuacugggaacauguccuuuagagaccugggaagagugaugguuauggugggcguuaccaugacggaugacauagguaugggagugacuuaccuugcccuacuagcagcuuucaaaguuagaccaacuuucgcagcuggauuacucuugagaaaacugaccuccaaggaauuaaugauggccaccauaggaaucgcacuccuuucccaaagcaccauaccagaaaccauucuugaacugacugaugcguuagcccugggcaugaugguccucagaauagugagaaauauggaaaaauaccaauuggcagugaccaucauggcuaucucgugugucccaaaugcagugauacuccuaaacgcauggaaggugaguugcacaauauuggcagcgguguccguuucuccauugcucuuaacauccucacagcagaaaacggauuggauaccacuggcauugacgauaaaaggucucaauccaacagccaucuuucuaacaacucuuucgagaaccagcaagaaaaggagcuggccgcuaaaugaagcugucauggcagucgggauggugagcauuuuagccaguucucuccuaaagaaugacauucccaugacagguccauuaguggcuggagggcuccuuacuguguguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauugcuggugaucucaggaguuuuuccaguaucgauaccaauuacggcagcagcaugguaccugugggaagugaagaaacaacgggcuggaguauugugggacgucccuucacccccaccaguggaaaaagccgaacuggaagauggagccuauagaaucaagcaaagagggauucuuggauauucucagauuggagccggaguuuacaaagaaggaacauuccauacaauguggcacgucacacguggugcuguucugaugcauagagggaaaaggauugaaccaucaugggcagacgucaagaaagaccuaauaucauauggaggaggcuggaagcuagaaggagaauggaaagaaggagaggaaguccaaguccuggcauuggaaccuggaaaaaauccaagagccguccaaacgaaaccuggacuuuucaaaaccaacaccggaaccauaggcgccauaucucuggacuuuuccccuggaacgucaggaucuccaauugucgauagaaaaggaaaaguugugggucuuuacggcaaugguguuguuacaaggaguggagcauaugugagugcuauagcccagaccgaaaaaagcauugaagacaauccagagaucgaagacgacauuuuccgaaagaaaagauugaccaucauggaccuccauccaggagcgggaaagacaaaaagauaccuuccagccauaguuagagaagccauaaaacguggcuugagaacauuaauccuggcucccacuagaguuguggcagcugaaauggaggaagcucuuagaggacuuccaauaagauaccaaaccccagccaucagagccgagcacaccgggcgggagaucguggaccuaaugugucaugccacauucacuaugagguugcuaucaccagucagaguaccaaauuacaaccugaucaucauggacgaagcccacuucacagauccagcaaguauagcagcuagaggauauauuucaacucgaguagaaaugggugaagcagcugggauuuucaugacagccacuccuccgggaagcagagacccauuuccucagagcaaugcaccaaucauggaugaggaaagagaaauuccugagcgcucauggaauucaggacaugaaugggucacggauuuuaaagggaagacuguuugguuuguuccaaguauaaaagcaggaaaugacauagcagcuugucucagaaaaaacggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccagucauacuaacagauggcgaagagcgggugauuuuggcaggaccuaugccagugacccacucuagugcagcacaaagaagagggagaauaggaagaaauccaaaaaaugaaaaugaccaguacauauacaugggggaaccucuggaaaaugaugaagacugugcacauuggaaagaagcuaaaaugcuccuagauaacaucaacacaccugaaggaaucauuccuaguauguucgaaccagagcgugaaaagguggaugccauugauggugaguaccguuugagaggagaagcaaggaaaaccuuuguggaccuaaugagaagaggggacuuaccagucugguuggccuacagaguggcagcugaaggcaucaacuacgcagacagaaggugguguuuugauggaaucaagaacaaccaaauacuggaagaaaacguggaaguggaaaucuggacgaaagaaggggaaaggaagaaauuaaaacccagaugguuggaugcuaggaucuauucugacccacuggcacuaaaagaauucaaggaauuugcggcuggaagaaaaucuuugacccugaaccuaaucacagaaauggguaggcuuccaacuuucaugacucagaaggcaagagacgcacuggacaacuuagcugugcugcauacggcugaggcagguggaagggcguacaaacaugcucucagugaacugccggagacccuggagacacugcuuuuacugacacuccuggccacagucacaggaggaaucuucuuauucuuaaugagcggaaaagguauagggaagaugacccugggaauguguugcauaaucacggcuagcauucuccuaugguaugcacagauacaaccacacuggauagcagcuucaauaauacuggaguuuuuucucauaguuuugcucauuccagaaccagaaaaacagagaacaccccaagacaaccaauugaccuacguagucauagccauccucacagugguggccgcaaccauggcaaaugagauggguuuccuggaaaaaacuaagaaagaccucggauugggaagcauuacaacccaggaaucugagagcaacauccuggacauagaucuacguccugcaucagcauggacgcuguaugccguggcuacaacauuugucacaccaauguugagacauagcauugaaaauuccucagugaaugucucccuaacagccauugcuaaccaagccacagugcuaaugggucuugggaaaggauggccauugucaaagauggacaucggaguuccccuccuugccauuggaugcuauucacaagucaacccuauaacucucacagcagcucuucuuuuauugguagcacauuaugccauuauagggccaggacuucaagcaaaagcaaccagagaagcucagaaaagagcagcagcaggcaucaugaaaaacccaacagucgaugggauaacagugauugaccuagaaccaauacccuaugauccaaaauuugaaaagcaguuaggacaaguaaugcuccuaauccucugcgugacucaaguauuaaugaugaggacuacaugggcucugugugaagcucuaacccuagcgaccgggcccaucuccacacugugggaaggaaauccagggagguuuuggaacacuacuauugcagugucaauggccaacaucuuuagggggagcuacuuggccggagcuggacuucucuuuuccaucaugaagaacacaacaaacacaagaagaggaacuggcaacauaggagagacacuuggagaaaaauggaaaagccgauuaaacgcacuggggaaaagugaauuucagaucuacaagaaaaguggaauccaggaaguggauagaaccuuggcaaaagaaggcaucaaaagaggagaaacggaccaccacgcugugucgcgaggcucagcaaaacugagaugguucgucgagagaaauauggucacaccagaagggaaggugguggaccucgguugcggcagagggggcuggucauacuauugugggggacugaagaauguaagagaagucaaaggccugacaaaaggaggaccaggacacgaagaacccauccccaugucaacauauggguggaaucuagugcgucugcaaaguggaguugaugucuucuucaccccgccagaaaagugugauacauuguugugugacauaggggagucgucaccaaaucccacgauagaagcaggacggacacucagaguccucaacuuagcggaaaauugguugaacaacaacacccaauuuugcauaaagguucucaacccauauaugcccucagucauagaaaaaauggaaacacuacaaaggaaauauggaggagcuuuagugaggaauccacucucacgaaacuccacacaugagauguacuggguauccaaugcuaccgggaacauagugucaucagugaauaugauuucaaggauguugauuaacagauucacaaugaaacacaagaaagccaccuacgagccagauguugaccuaggaagcggaacccgcaacauuggaauugaaagugagauaccaaaucuagacauaauaggaaagagaauagagaaaauaaagcaagagcaugaaacaucauggcacuaugaccaagaccacccauacaaaacaugggcuuaccacgguagcuaugaaacaaaacaaacuggaucagcaucaucuauggugaacggaguggucagacugcugacgaaaccuugggacgucgucccuauggugacacagauggcaaugacagacacgacuccauuuggacaacaacgcgucuucaaagagaaaguggacacgagaacccaagaaccgaaagaaggcacaaagaaacugaugagaaucacggcagaguggcuuuggaaagaacuaggaaagaaaaagacaccuaggauguguaccagagaagaauucacaagaaaggugagaagcaaugcagccuugggggccauauucacugaugaaaacaaauggaaaucggcucgugaggcuguugaagauaguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuuuuuagaguuugaagcccuaggauucuugaaugaagaucacugguucuccagagggaacucccugaguggaguggaaggagaagggcugcacaggcuaggcuacauuuuaagagaugugagcaagaaggaagggggagcaauguacgccgaugauacagcaggaugggacacaagaaucacacuagaggacuugaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaaaagaccaaagaggcagcgggcaagucggcaccuauggccuuaacacuuucaccaacauggaagcccaauuaauuagacagauggaaggagaaggaaucuucaaaagcauucagcaccugacagucacagaagaaaucgcuguacagaacugguuagcaagaguggggcgugaaaggcuaucaagaauggccaucaguggagaugauuguguuguaaaaccuuuagaugacagauuugcaagugcuuuaacagcucuaaaugacaugggaaaaguuaggaaagauauacaacaaugggaaccuucaagaggauggaacgacuggacacaagugccuuucuguucacaccauuuucaugaguuagucaugaaagauggucgcgugcucguagucccaugcagaaaccaagaugaacugauugguagagcccgaauuucccagggagccggguggucuuugaaggagacggccuguuuggggaagucuuacgcccaaauguggacccugauguacuuccacagacgcgaccucagacuggcagcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccauacuuggggaaaagagaagaccaauggugcggcucauugauugggcuaacaagcagggcuaccugggcaaagaacauccaaacagcaauaaaccaagucagaucccuuauaggcaaugaggaauacacagacuacaugccauccaugaagagauucagaagggaagaggaagaggcagguguccugugguag

SEQ ID NO: 6381 - RNA, 9876 nt, Artificial Sequence
  derived and/or modified CDS sequence (wt) from DENV-2__JX669488__SS-prME
acagcaggcgugauuauuauguugauuccaacagcaauggcguuccauuuaaccacacguaauggagaaccacacaugaucguugguaggcaagagaaagggaaaagucuucuguuuaaaacagaggaugguguuaacauguguacccucauggccauagaccuuggugaauugugugaagauacaaucacguacaaguguccccuccucaggcaaaaugaaccagaagacauagauuguuggugcaacuccacguccacauggguaacuuaugggacauguaccaccacaggagaacacagaagagaaaaaagaucaguggcacucguuccacauguggguaugggacuggagacacgaacugaaacauggaugucaucagaaggggccuggaaacauguucagagaauugaaaccuggaucuugagacauccaggcuuugccauaauggcagcaauccuggcauacaccauaggaacgacacauuuccaaagggccuugauuuucaucuuacugacagcugucgcuccuucaaugacaaugcguugcauaggaauaucaaauagagacuucguagaagggguuucaggaggaagcuggguugacauagucuuagaacauggaaguugugugacgacgauggcaaaaaauaaaccaacauuggauuuugaacugauaaaaacagaagccaaacaaccugccacuuuaaggaaguacuguauagaagcaaagcugaccaauacaacaacagaaucucguugcccaacacaaggggaacccagucuaaaugaagagcaggacaaaagguucaucugcaaacauuccaugguagacagaggauggggaaauggauguggauuauuuggaaaaggaggcaucgugaccugugcuauguucacaugcaaaaagaacauggaaggaaaaguagugcugccagagaaucuggaauacacuaucgugauaacaccucacucaggagaagagcacgcuguagguaaugacacaggaaaacauggcaaggaaaucaaaauaacaccacagaguuccaucacagaagcagaacugacaggcuauggcacugucacaauggagugcucuccgagaacgggccucgacuucaaugagauggugcugcugcagauggaagagaaagcuuggcuggugcacaggcaaugguuccuagaccugccguuaccauggcuacccggagcggacacacaaggaucaaauuggauacagaaagagacauuggucacuuucaaaaauccccacgcgaagaaacaagacgucguuguuuuaggaucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagacacgucuuaggccgccugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcgaagagaauggccauacuaggagacacagccugggauuuuggaucccugggaggaguguuuacaucuauaggaaaggcucuccaccaaguuuucggagcaaucuauggggcugcuuuuaguggggucucauggacuaugaaaauccucauaggagucaucauuacauggauaggaaugaauucacguaguaccucacugucugugucacuaguauuggugggagucgugacacuguaccugggagcuauggugcaggcugauagugguugcguugugagcuggaaaaacaaagaauugaaauguggcagcgggaucuucaucacagauaacgugcacacguggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauuaaaucacauccuaucagaaaaugagguaaaguuaaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucguuggaaguugaagacuauggcuuuggaguuuuuaccaccaauauauggcuaaaacugagagaaaaacaggauguauuuugugacucaaaacucaugucagcggccauaaaagacaacagagccguccaugccgauauggguuauuggauagaaagugcacucaaugacacauggaagauggagaaagccucuuucauugaaguaaaaagcugccacuggccaaagucacacacccucuggagcaauggaguauuggaaagugagaugauaauuccaaaaaauuuugccgggccagugucacaacacaacuacagaccaggcuaccauacacaaacagcaggaccuuggcaucuagguaagcuugagauggacuucgauuucugcgaaggaaccacagugguggugacugaggacuguggaaauagaggacccucuuuaagaacgaccacugccucuggaaaacuuauaacagaauggugcugccgaucuugcacacuaccaccucuaagauacagaggugaggauggaugcugguacgggauggaaaucagaccauugaaagagaaagaggagaauuuggucaacuccuuggucacagccggacauggacagauugacaacuuuucacuaggagucuugggaauggcacuguuccuggaagaaaugcucaggacccgaguaggaacgaaacaugcaauacugcuagucgcagcaucuuuugugacauugauuacugggaacaugucuuuuagagaccugggaagagugaugguuauggugggcgcuaccaugacggaugacauaggcaugggagugacuuaccuugcccuacuagcagcuuucaaaguuagaccaacuuucgcagcuggacuacucuugagaaaacugaccuccaaggaauuaaugauggccaccauaggaaucgcacuccuuucccaaagcaccauaccagaaaccauucuugaacugacugaugcguuagcccugggcaugaugguccucagaauagugagaaauauggaaaaauaccaacuggcagugaccaucauggcuaucucgugugucccaaaugcagugauacuccuaaacgcauggaaggugaguugcacaauauuggcagcgguguccguuucuccauugcucuuaacauccucacagcagaaaacggauuggauaccacuggcauugacgauaaaaggucucaauccaacagccaucuuucuaacaacucuuucgagaaccagcaagaaaaggagcuggccgcuaaaugaagcugucauggcagucgggauggugagcauucuagccaguucucuccuaaaaaaugacauucccaugacagguccauuaguggcuggagggcuccuuacuguguguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauugcuggugaucucaggaguuuuuccaguaucgauaccaauuacggcagcagcaugguaccugugggaagugaagaaacaacgggcuggaguauugugggacgucccuucacccccaccaguggaaaaagccgaacuggaagauggagccuauagaaucaagcaaagagggauucuuggauauucucagauuggagccggaguuuacaaagaaggaacauuccauacaauguggcacgucacacguggugcuguucugaugcauagagggaaaaggauugaaccaucaugggcagacgucaagaaagaccuaauaucauauggaggaggcuggaagcuagaaggagaauggaaagaaggagaggaaguccaaguccuggcauuggaaccugggaaaaauccaagagccguccaaacgaaaccuggacuuuucaaaaccaacaccggaaccauaggcgccauaucucuggacuuuuccccuggaacgucaggaucuccaauugucgauagaaaaggaaaaguugugggucuuuacggcaaugguguugucacaaggaguggagcauaugugagugcuauagcccagaccgaaaaaagcauugaagacaauccagagaucgaagaugacauuuuccgaaagaaaagauugaccaucauggaccuccauccaggagcgggaaagacaaaaagauaccuuccagccauagucagagaagccauaaaacguggcuugagaacguuaauccuggcucccacuagaguuguggcagcugaaauggaggaagcucuuagaggacuuccaauaagauaccaaaccccagccaucagagccgagcacaccgggcgggagaucguggaccuaaugugucaugccacauucacuaugaggcugcuaucaccagucagaguaccaaauuacaaccugaucaucauggacgaagcccacuucacagauccagcaaguauagcagcuagaggauauauuucaacucgaguagaaaugggugaagcagcugggauuuucaugacagccacuccuccgggaagcagagacccauuuccucagagcaaugcaccaaucauggaugaggaaagagaaauuccugaacgcucauggaauucaggacaugaaugggucacggauuuuaaagggaagacuguuugguucguuccaaguauaaaagcaggaaaugacauagcagcuugucucagaaaaaacggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccagucauacuaacagauggcgaagagcgggugauuuuggcaggaccuaugccagugacccacucuagugcagcacaaagaagagggagaauaggaagaaauccaaaaaaugaaaaugaccaguacauauacaugggggaaccucuggaaaaugaugaagacugugcacauuggaaagaagcuaaaaugcuccuagauaacaucaacacaccugaaggaaucauuccuaguauguucgaaccagagcgugaaaagguggaugccauugauggugaguaccguuugagaggagaagcaaggaaaaccuuuguggaccuaaugagaagaggggacuuaccaguuugguuggccuacaaaguggcagcugaaggcaucaacuacgcagacagaaggugguguuuugauggaaucaagaacaaccaaauacuggaagaaaacguggaaguggaaaucuggacgaaagaaggggaaaggaagaaauuaaaacccagaugguuggaugcuaggaucuauucugacccacuggcgcuaaaagaauucaaggaauuugcggcuggaagaaaaucuuugacccugaaccuaaucacagaaauggguaggcuuccaacuuucaugacucagaaggcaagagacgcacuggacaacuuagcugugcugcauacggcugaggcagguggaagggcguacaaacaugcucucagugaacugccggagacccuggagacacugcuuuuacugacacuccuggccacagucacaggaggaaucuucuuauucuuaaugagcggaaaagguauagggaagaugacccugggaauguguugcauaaucacggcuagcauucuccuaugguaugcacagauacaaccacacuggauagcagcuucaauaauacuggaguuuuuccucauaguuuugcucauuccagaaccagaaaaacagagaacaccccaagacaaccaauugaccuacguagucauagccauucucacagugguggccgcaaccauggcaaaugagauggguuuccuggaaaaaaccaagaaagaccucggauugggaagcauuacaacccaggaaucugagagcaacauccuggacauagaucuacguccugcaucagcauggacgcuguaugccguggcuacaacauuugucacaccaauguugagacauagcauugaaaauuccucagugaaugucucccuaacagccauugcuaaccaagccacagugcuaaugggucuugggaaaggauggccauugucaaagauggacaucggaguuccccuccuugccauuggaugcuauucacaagucaacccuauaacucucacagcagcucuucuuuuauugguagcacauuaugccauuauagggccaggacuucaagcaaaagcaaccagagaagcucagaaaagagcagcagcaggcaucaugaaaaacccaacagucgaugggauaacagugauugaccuagaaccaauacccuaugauccaaaauuugaaaagcaguuaggacaaguaaugcuccuaauccucugcgugacucaaguauuaaugaugaggacuacaugggcucugugugaagcucuaacccuagcgaccgggcccaucuccacacugugggaaggaaauccagggagguuuuggaacacuacuauugcagugucaauggccaacaucuuuagggggagcuacuuggccggagcuggacuucucuuuuccaucaugaagaacacagcaaacacaagaagaggaacuggcaacauaggagagacacuuggagaaaaauggaaaagccgauugaacgcacuggggaaaagugaauuucagaucuacaagaaaaguggaauccaggaaguggauagaaccuuggcaaaagaaggcaucaaaagaggagaaacggaccaccacgcugugucgcgaggcucagcaaaacugagaugguucgucgagagaaauauggucacaccagaagggaaggugguggaccucgguugcggcagagggggcuggucauacuauuguggaggacuaaagaauguaagagaagucaaaggccugacaaaaggaggaccaggacacgaagaacccauccccaugucaacauauggguggaaucuagugcgucugcaaaguggaguugacgucuucuucaccccgccagaaaagugugauacauuguugugugacauaggggagucgucaccaaaucccacgauagaagcaggacggacacucagaguccucaacuuagcggaaaauugguugaacaacaacacccaauuuugcauaaagguucucaacccauauaugccuucagucauagaaaaaauggaaacacuacaaaggaaauauggaggagcuuuagugaggaauccacucucacgaaacuccacacaugagauguacuggguauccaaugcuaccgggaacauagugucaucagugaauaugauuucaaggauguugauuaacagauucacaaugaaacacaagaaagccaccuacgagccagauguugaccuaggaagcggaacccgcaacauuggaauugaaagugagauaccaaaucuagacauaauaggaaagagaauagagaaaauaaagcaagagcaugaaacaucauggcacuaugaccaagaccacccauacaaaacaugggcuuaccacgguagcuaugaaacaaaacaaacuggaucagcaucaucuauggugaacggaguggucagacugcugacgaaaccuugggacgucgucccuauggugacacagauggcaaugacagacacgacuccauuuggacaacaacgcgucuucaaagagaaaguggacacgagaacccaagaaccgaaagaaggcacaaagaaacugaugagaaucacggcagaguggcuuuggaaagaacuaggaaagaaaaagacaccuaggauguguaccagagaagaauucacaagaaaggugagaaguaaugcagccuugggggccauauucacugaugaaaacaaauggaaaucggcucgugaggcuguugaagauaguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuuuuuagaguuugaagcccuaggauuuuugaaugaagaucacugguucuccagagggaacucccugaguggaguggaaggagaagggcugcacaggcuaggcuacauuuuaagagaugugagcaagaaggaagggggagcaauguacgccgaugauacagcaggaugggacacaagaaucacacuagaggacuuaaaaaaugaagaaaugguaacaaaccacauggaaggagaacacaagaaacuagccgaggccauauucaaauuaacguaccaaaacaagguggugcgugugcaaagaccaacaccaagaggcacaguaauggauaucauaucuagaaaagaccaaagaggcagcgggcaagucggcaccuauggccuuaacacuuucaccaacauggaagcccaauuaauuagacagauggaaggagaaggaaucuucaaaagcauucagcaccugacagucacagaagaaaucgcuguacagaacugguuagcaagaguggggcgugaaaggcuaucaagaauggccaucaguggagaugauuguguuguaaaaccuuuagaugacagauuugcaagugcuuuaacagcucuaaaugacaugggaaaaguuaggaaagauauacaacaaugggaaccuucaagaggauggaacgacuggacacaagugccuuucuguucacaccauuuucaugaguuagucaugaaagauggucgcgugcucguagucccaugcagaaaccaagaugaacugauugguagagcccgaauuucccagggagccggguggucuuugaaggagacggccuguuuggggaagucuuacgcccaaauguggacccugauguacuuccacagacgcgaccucagacuggcagcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccauacuugggaaaaagagaagaccaauggugcggcucauugauugggcuaacaagcagggcuaccugggcaaagaacauccaaacagcaauaaaccaagucagaucccuuauaggcaaugaggaauacacagacuacaugccauccaugaagagauucagaagggaagaggaagaggcagguguccugugguag

SEQ ID NO: 6382 - RNA, 9876 nt, Artificial Sequence
  derived and/or modified CDS sequence (wt) from DENV-2__JX669479__SS-prME
acagcaggcgugauuguuauguugauuccaacagcgauggcguuccauuuaaccacacguaauggagaaccacacaugaucguugguaggcaggagaaagggaaaagucuucuguucaaaacagaggaugguguuaacauguguacccucauggccauagaccuuggugaguugugugaagauacaaucacguacaaguguccccuccucagacaaaaugaaccagaagacauagauuguuggugcaacucaacguccacauggguaacuuaugggacauguaccaccacaggagaacacagaagagaaaaaagaucaguggcgcucguuccacauguggguaugggacuggagacacgaacugaaacauggaugucaucagaaggggccuggaagcauguucagagaauugaaaccuggaucuugagacauccagguuuuaccauaauggcagcgauccuggcauacaccauaggaacgacacacuuccaaagggccuugauuuucaucuuacugacagcugucgcuccuucaaugacaaugcgcugcauaggaauaucaaauagagacuucguagaagggguuucaggaggaagcuggguugacaucguuuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaaaucguacagucagaaaauuuggaauacaccaucgugauaacaccucacucaggagaagagcacgcuguagguaaugacacaggaaagcacggcaaggaaaucaaaauaacaccacagaguuccaccacagaagcagaacugacaggcuauggcacugucacgauggagugcucuccgagaacgggccucgacuucaaugagauggugcugcugcagauggaagacaaagcuuggcuggugcacaggcaaugguuccuagaccugccguugccauggcuacccggagcggauacacaaggaucaaauuggauacagaaagagacauuggucacuuucaaaaauccccacgccaagaaacaggaugucguugucuuagggucucaagaaggggccaugcacacggcacucacaggggcuacagaaauccagaugucaucaggaaacuuacuguucacgggacaucucaagugcaggcugaggauggacaaacuacagcucaaaggaaugucauacucuauguguacagggaaguuuaaaaucgugaaggaaauagcagaaacacaacauggaacaauaguuaucagaguacaauaugaaggggacgguucuccaugcaagaucccuuuugagauaacagauuuggaaaaaagacacgucuuaggacgccugauuacaguuaacccaaucguaacagaaaaagauagcccagucaacauagaagcagaacccccauucggagacagcuacaucaucguaggaguagagccgggacaacugaaacucaauugguuuaagaagggaaguuccaucggccaaauguuugagacaacaaugagaggagcaaagagaauggccauuuuaggugacacagccugggauuuuggaucucugggaggaguguuuacaucuauaggaaaggcucuccaucaaguuuucggagcaaucuauggggcugcuuuuaguggggucucauggacuaugaaaauccucauaggagucaucaucacauggauaggaaugaauucacguagcaccucacugucugugucgcuaguauuggugggagucgugacacuguaccugggagcuauggugcaggcugauagugguugcauugugagcuggaaaaauaaagaacugaaauguggcagcgggaucuucauuacagauaacguacacacauggacagaacaauauaaguuccaaccagaauccccuucaaaacuagcuucagcuauccaaaaagcucaugaagaaggcauuuguggaauccgcucaguaacaagauuggagaaucugauguggaaacaaauaacaccagaauugaaucauauucuaucagaaaaugagguaaaguugaccaucaugacaggagacauuaaaggaaucaugcaggcaggaaaaagauccuugcggccucagcccacugagcugaaguacucauggaaaacauggggaaaggcgaaaaugcucucuacagagucucacaaccagaccuuucuuauugauggcccugaaacagcagaaugccccaacacaaacagagcuuggaacucccuggaaguugaagacuaugguuuuggaguuuuuaccaccaauauauggcuaaaauugagagaaaaacaggauguauuuugugacucaaaacucaugucagcggccauuaaagacaacagagccguccaugccgauauggguuauuggauagaaagugcacucaaugacacauggaagauggagaaagccuccuucauugaaguuaaaagcugccacuggccaaagucacacacccucuggagcaauggaguauuagaaagugagaugauaauuccaaaaaauuuugccgggccagugucacaacacaacuacagaccaggcuaccauacacaaacagcaggaccuuggcaucuagguaagcuugagauggacuuugauuucugcgaaggaacuacagugguggugacugaggacuguggaaauagaggacccucuuuaagaacgaccacugccucuggaaagcucauaacagaauggugcugccgauccugcacacuaccaccucuaagauacagaggugaggauggaugcugguacgggauggaaaucagaccuuugaaagagaaagaagagaacuuggucaacuccuuggucacagccggacaugggcagauugacaacuuuucacuaggagucuugggaauggcacuguuccuggaagaaaugcuuaggacccgaguaggaacgaaacaugcaauacugcuaguugcacuaucuuucgugacauugauaacugggaacaugucuuuuagagaccugggaagagugauggucauggugggcgcuaccaugacggaugacauagguaugggagugacuuaucuugcccuacuagcagcuuucaaaguuagaccaacuuuugcagcuggacuacucuugagaaaacugaccuccaaggaauugaugauggccaccauaggaaucgcacuccuuucccaaagcaccuugccagagaccauucuagaacugacugaugcguuagccuugggcaugauggcccucaaaauagugagaaauauggaaaaauaccaauuggcagugacuaucauggcuauuucgugugucccaaaugcagugauauugcaaaacgcauggaaggugaguugcacaauauuggcagcgguguccguuucuccacugcuccuaacauccucacagcagaaagcggauuggauaccauuggcauugacgauaaaaggucucaacccaacagccauuuuucuaacaacucuuucgagaaccagcaagaaaaggagcuggccgcuaaaugaagcuaucauggcagucgggauggugagcauuuuagccaguucucuccuaaagaaugauauuccuaugacagguccauuaguggcuggagggcuccucaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucauuagaacgggauuguuggugaucucaggagucuuuccaguaucgauaccaauuacggcagcagcaugguaccugugggaagugaagaaacaacgggcuggaguauugugggacguuccuucacccccaccaguggaaaaagccgaacuggaagauggagccuauagaaucaagcaaagagggauucuuggauauucucagauuggagccggaguuuacaaagaaggaacauuccauacaauguggcacgucacacguggugcuguucugaugcauagagggaagaggauugaaccaucaugggcagauguuaagaaagaccuaauaucauauggaggaggcuggaagcuagaaggagaauggaaggaaggagaggaaguccaaguccuggcauuggaaccuggaaaaaaucccagagcuguccaaacgaaaccuggaauuuucaaaaccaacaccggaaccauaggcgcuguaucucuggacuuuuccccuggaacgucaggaucuccaauugucgauagaaaaggaaaaguugugggucuuuacgguaaugguguugucacaaggaguggagcauacguaagugccauagcccagaccgaaaaaagcauugaagacaauccagagaucgaagaugacauuuuccgaaagaaaagauugaccaucauggaccuccauccaggggcaggaaagacaaaaagauaccuuccagccauaguuagagaagccauaaaacguggcuugagaacauuaauccuggcucccacuagagucguggcagcugaaauggaggaagcucuuagaggacuuccaauaagauaccaaaccccagccaucagagccgagcacaccgggcgagagaucguggaccuaaugugucaugccacauuuacuaugaggcugcuaucaccagucagagugccaaauuacaaccugauuaucauggacgaagcccacuucacagacccagcaagcauagcagcuagaggauacauuucaacucgaguagagaugggugaagcagccgggauuuuuaugacagccacuccuccggggagcagagacccauuuccucagagcaaugcaccaaucauggaugaggaaagagaaaucccugagcguucauggaauucaggacaugaaugggucacggauuuuaaagggaagacuguuugguuuguuccaaguauaaaagcaggaaaugacauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagagggucauagacccuagacgcugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucucgaaaaugaugaagacugugcacacuggaaagaagcuaaaaugcuccuagauaacaucaacacacccgaaggaaucauuccuagcauguucgaaccagagcgugaaaagguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauguggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagaaacgcacuggacaacuuggcugugcugcauacggcugagguagguggaagggcguacacucaugcucucagugaacugccggagacucuggagacacugcuucuacugacacuccuggcagcagucacaggaggaaucuucuuauucuuaaugagcggaaaagguauagggaagaugacucugggaauguguugcauaaucacagcuagcauucuccuaugguaugcacagauacaaccacauuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauuuggaagcauuacaacccaggaaucugagagcaacauccuggacauagaucuacguccugcaucagcauggacgcuguaugccguggcuacaacauuugucacaccaauguugcgacauagcauugaaaauuccucaguaaaugucucccuaacagccauugcuaaccaagccacagugcuaaugggucuugggaaaggauggccauugucaaagauggacauuggaguuccccuccuugccauuggaugcuacucacaagucaacccuauaacccucacagcagcucuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaacaccaccauugcagugucaauggcuaacaucuuuagggggagcuacuuggccggagcuggacuucucuuuuccaucaugaagaacacaacaaacacaagaagaggaacuggcaacguaggagagacacuuggagaaaaauggaaaagccgauuaaaggcacugggaaaaagugaauuucagaucuacaagaaaaguggaauccaggaaguggauagaacccuagcaaaagaaggcaucaaaagaggagaaacggaccaccaugcugugucacgaggaucagcaaaauugagaugguucgucgagagaaacauggucacaccggaagggaaggugguggaucuugguugcggcagagggggcuggucauacuauugugggggacuaaagaauguaagagaagucaaaggccuaacaaaaggaggaccaggacacgaagaacccauccccaugucaacauauggguggaaucuagugcgucugcaaaguggggucgacguuuucuucaccccgccagaaaagugugauacauuguugugugacauaggggagucgucaccaaaucccacgauagaagcaggacgaacacucagaguccucaacuuaguggaaaauuggcugaacaauaacacccaauuuugcauaaagguccucaauccauauaugcccucagucauagaaaaaauggaaacacuacaaaggaaauauggaggagccuuagugaggaauccacucucacgaaacuccacgcaugaaauguacuggguaucuaaugcuaccgggaacauagugucaucagugaacaugauuucaaggauguugauuaacagauucacaaugaaacauaagaaagccaccuacgagccagauguugaccuaggaaguggaacccgcaacauuggaauugaaagugagauaccaaaccuagacauaauaggaaagagaauagagaaaauaaaacaagagcaugaaacaucauggcauuaugaccaagaccacccauacaaaacgugggcuuaccauggcagcuaugaaacaaaacaaacugggucagcaucaucuauggugaacggaguggucagacugcugacaaaaccuugggacgucgucccuauggugacacagauggcaaugacagacacgacuccauuuggacaacagcgcguuuucaaagagaaaguggacacgagaacucaagaaccgaaggaaggcacaaagaaacugaugaaaauuacggcagaguggcuuuggaaagaacuaggaaaggaaaagacaccuagaauguguaccagagaagaauucacaagaaaagugagaagcaaugcagccuugggggccguauucacugaugagaacaaauggaaaucggcacgugaggcuguugaagaugguagguuuugggagcuaguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagaggugggcaagaaggaaggaggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaaaagaccaaagaggcagugggcaagucgguaccuauggccuuaauacuuucaccaauauggaagcccaauuaauuagacagauggaaggagaaggaaucuucaaaagcauucagcaccugaccgccacagaagaaaucgcuguacagaacugguuagcaagaguggggcgugaaaggcuaucaagaauggccaucaguggagaugacuguguuguaaaaccuauagaugacagauuugcaagugcuuuaacagcucuaaaugacaugggaaaaguuaggaaagauauacaacaaugggaaccuucaagaggauggaacgauuggacacaggugccuuucuguucacaccauuuucaugaguuagucaugaaagauggucgcgugcucguagucccaugcagaaaccaagaugaacugauuggcagagcccgaauuucccagggagccggauggucuuugaaggagacggcuuguuuggggaagucuuacgcccaaauguggacccugauguacuuccacagacgugaccucagauuggcggcaaaugccauuugcucggcagucccgucacauuggguuccaacaagucgaacaaccugguccauacacgccaagcaugaauggaugacgacggaagacaugcuggcagucuggaacaggguguggauccaagaaaacccauggauggaagacaaaacuccaguggaaucaugggaagaagucccauaccugggaaaaagggaagaccaauggugcggcucauugauugggcuaacaagcagggcuaccugggcaaagaauauccagacagcaauaaaucaagucagaucccuuauaggcaaugaaggauacacagacuacaugccauccaugaagagauucagaagagaagaggaagaggcagguguccugugguag

SEQ ID NO: 6383 - RNA, 9876 nt, Artificial Sequence
  derived and/or modified CDS sequence (wt) from DENV-2__KF744403__SS-prME
acugcaggcaugaucauuaugcugauuccaacagugauggcguuccauuuaaccacacguaacggagaaccacacaugaucgucaguagacaagagaaagggaaaagucuucuguucaaaacagaggauggugugaacauguguacccucauggccauggaccuuggugaauugugugaagauacaaucacguauaaguguccucuucucaggcagaaugaaccagaagacauagauuguuggugcaacucuacauccacauggguaaccuaugggacguguaccaccacaggagaacacagaagagagaaaagaucaguggcacuagucccacaugugggaaugggauuggagacacgaacugaaacauggaugucaucagaaggggccuggaaacaugcccagagaauugaaacuuggauuuugagacauccaggcuuuaccuuaauggcagcaauccuggcauacaccauaggaacgacaaauuuccaaagagcccugaucuucaucuuacugacagcugucgcuccuucaaugacaaugcguugcauaggaauaucaaacagagauuuuguagaagggguuucaggaggaagcuggguugacauagucuuagaacauggaagcugugugacgacaauggccaaaaacaaaccgacauuggauuuugaacugauaaaaacagaagccaaacaaccugccacucuaaggaaguacugcauagaggcaaaguuaaccaacacaacaacagaaucucgcugcccaacacaaggggaacccagccuaaaugaagagcaggauaaaagguucgucugcaaacacuccaugguagacagaggauggggaaauggauguggacuauuuggaaaaggaggcauugugaccugugcuauguuuacaugcaaaaagaacauggaaggaaaaaucgugcaaccagaaaacuuggaauauaccaucgugauaacaccucacucaggggaagagcacgcaguuggaaaugacacagggaaacauggcaaggaaaucaaaauaacaccacagaguuccaucacagaagcagaguugacaggcuauggcacagucacgauggagugcucuccgaggacgggccucgauuucaaugagaugguguuguugcaaauggaaaacaaagcuuggcuggugcaccggcaaugguuccuagaucugccguugccauggcugcccggagcggacacacaaggaucaaauuggauacagaaagagacauuagucacuuucaaaaauccccaugcgaagaaacaagauguuguuguuuuaggaucccaagaaggggcuaugcauacagcacucacaggggccacagaaauccagaugucaucagggaacuuacuguucacaggacaucucaaguguaggcugaggauggacaaacuacagcucaaaggaaugucauacuccaugugcacaggaaaguuuaaaguugugaaggaaauagcagaaacacaacauggaacaauagucgucagaguacaauaugaaggggacgguucuccauguaagauucccuuugagauaauggauuuggaaaaaagacaugucuugggccgccugaucacagucaacccaauugugacagaaaaggauagcccagucaacauagaagcagaaccuccauucggagacagcuacgucaucauaggaguggagccggggcaauugaagcugaauugguuuaagaaaggaaguucuaucggccaaauguuugagacaacaaugaggggagcgaagagaauggcuauucuaggugacacagcuugggauuuuggaucccugggaggaguauucacaucuauaggaaaggcucuccaccagguuuuuggagcaaucuacggcgcugccuucagcggggucucguggacuaugaaaauccucauaggagucauuaucacauggauaggaaugaauucacguagcaccucacugucuguaucacuaguauuggugggagucguaacacuguaccugggaguuguggugcaggccgauagugguugcguugugagcuggagaaacaaagaacugaaaugugguagugggauuuucaucacagacaacgugcacacguggacagaacaauacaaguuccaaccagaaucccccucaaaacuagcuucagcuauccagaaagcucaucaagagggcauuuguggaauccgcucaguaacgagacuggaaaauuugauguggaaacaaauaacaccggaauugaaucacauucuaucagaaaaugaggugaagcugacuaucaugacaggagauaucaaaggaaucaugcaugcaggaaaacgaucuuugcggccucagcccacugagcugagguauucauggaaaacauggggcaaagcgaaaauccucucuacagagucccauaaccagaccuuccucauugauggccccgaaacagcagaaugccccaacacaaacagagcuuggaacucacuugaaguugaagacuauggcuuuggaguauucaccaccaauauauggcuaaggcugagagaaaagcaggaugcauuuugcgacucaaaacucaugucagcggccauaaaagacaacagagccguccaugccgacauggguuauuggauagaaagugcacucaaugacacauggaagauagagaaagccucuuucaucgaaguuaaaagcugccacuggccaaagucacacacccucuggagcaauggagugcuagaaagugagaugauaauuccaaagaauuucgcuggaccagugucacaacacaauuacagaccaggcuaccauacacaaacagcaggaccauggcauuuagguaagcuugagauggauuuugauuucugcaagggaacuacagugguggugacugaggacuguggaaauagaggacccuccuuaagaacaaccacugccucuggaaaacucauaacagaauggugcugcagaucuugcacauugccaccacuaagauauagaggugaggacggaugcugguacgggauggaaaucagaccauugaaagaaaaagaagagaauuuggucagcuccuuggucacagccggacaugggcagauugacaacuucucauuaggagucuugggaauggcauuguuucuggaagaaaugcucaggacccgaguaggaacgaaacaugcaauacuacuaguugcaguuucuuuugugacauugaucacagggaacauguccuuuagagaccugggaagagugaugguuauggugggcgcuacuaugacggaugacauagguaugggcgugacuuaucuugcccuacuagcagccuucaaagucagaccaacuuuugcagcuggacuacucuugagaaaguugaccucuaaggaauugaugaugacuaccauaggaaucguacuccucucccaaagcaccauaccagagaccauucuugaacugacugaugcguuagcccugggcaugaugguccucaaaauagugaggaaaauggaaagguaucaacuggcagugacuauuauggcuaucuugugcgucccaaaugcagugauauuacaaaacgcauggaaagugagcugcacaauauuggcagugguguccguuuccccacugcuauuaacauccucacagcagaaagcggauuggauaccauuagcauuaacgauuaaaggucucaauccaacagcuauauuucuaacaacccuuucacgaaccagcaagaaaaggagcuggccacuaaaugaggcuaucauggcagucgggauggugagcauuuuagccaguucacuucuaaaaaaugacauucccaugacaggaccauugguggcuggagggcuccucacaguaugcuaugugcucacuggacgaucggccgauuuggaauuggagaaagcugcugacgucagaugggaagaucaggcagagauaucaggaaguaguccaauccuaucaauaauaauaucagaagauggcagcaugucaauaaaaaacgaagaggaagaacaaacacugaccauacucauuagaacaggauugcuggugaucucaggacuuuuuccuguaucaauaccaaucacggcagcagcaugguaccugugggaagugaagaaacaacgggcuggaguauugugggaugucccuucacccccaccugugggaaaagcugaacuggaagauggagccuacagaaucaagcaaaaagggauucucggauauucccagaucggagccggaguuuacaaagaaggaacauuccauacaauguggcacgucacacguggugcuguucuaaugcauaaaggaaagaggauugagccaucaugggcggacgucaaaaaagaccuaauaucauauggaggaggcuggaaacuagaaggagaauggaaggaaggagaagaaguccagguccuggcauuggaaccuggaaaaaauccaagagccguccaaacaaaacccggucuuuucaaaaccaaugccggaaccauaggugccguaucucuggacuuuuccccuggaacgucaggaucaccaaucauugacaaaaaaggaaaggugguaggacuuuaugguaacggcguuguuacaaggaauggaucauaugugagugcuauagcccagacggaaaaaagcauugaagacaauccagagauugaagaugacauuuuucgaaagaaaagauugaccaucauggaccuccacccaggagcaggaaagacgaaaagauaccuuccggccauagucagagaagccauaaaacggggccugaggacauuaauucuggcccccacuagaguuguggcagcugaaauggaggaagcucuuaggggacucccaauaagauaccaaaccccagccaucagagccgagcacaccgggcgggagauuguggaccuaaugugucaugccacauucacuaugaggcugcuaucgccaauuagaguaccaaauuacaacuugauuaucauggaugaagcccauuucacagacccagcaaguauagcggccagaggauacauuucaacucgaguggaaaugggugaggcagcugggauuuucaugacagccacuccuccggggagcagagacccauuuccccagagcaaugcaccaaucauggaugaagaaagagaaaucccugaacguucguggaauuccggacaugaauggguuacggauuuuaaagggaagacuguuugguucguuccaaguauaaaagcaggaaaugacauagcagcuugccugagaaaaaauggaaagaaagugauacaacucagcaggaaaaccuuugauucugaguaugucaagacuagaaccaaugacugggacuuugugguuacaacugacauuucagaaaugggugccaacuucaaggcugagagggucauagaucccagacgcugcaugaaaccaguuauacuaacagacggugaagagcgggugauccuagcaggacccaugccagugacccauucuagugcagcacaaagaagagggagaauaggaagaaauccaaaaaaugaaaacgaccaguacauauauaugggggaaccucuggaaaacgacgaagacugugcacacuggaaagaagcuaaaaugcuccuagauaacaucaauacaccugaaggaaucauuccuaguauguucgaaccagagcgcgaaaagguggaugcuauugauggugaauaccgcuugagaggagaagcacggaaaaccuuuguagaccuaaugagaagaggagaccuaccagucugguuggccuacaagguggcagcugaaggcaucaacuacgcagacagaaggugguguuuugauggaaucaggaacaaccaaauccuggaagaaaauguggaaguggaaaucuggacaaaagaaggggaaaggaagaaauuaaaacccagguggcuggacgcuaggaucuauucugacccauuagcgcuaaaagaauucaaggaauuugcagcuggaagaaagucccugacccugaaccuaaucacagaaaugggaaggcuuccaacuuucaugacucagaaggcaagagacgcauuggacaaccuggcagugcugcacacggcugaagcagguggaagggcguacaaucaugcucucagcgaacugccggagacucuggagauauuacuuuuacugacacuucuggcuacagucacgggaggaaucuuuuuauucuugaugagcggaagagguauagggaagaugaccuuaggaaugugcugcauaaucacggccagcauucuucuaugguacgcacaaauacagccacacuggauagcagcuucaauaauacuggaauuuuuccucauaguucugcuuauuccagaaccagaaaagcagagaacaccccaagauaaccaauugaccuacguugucauagccauccucacagugguggccgcaaccauggcaaacgagauggguuuccuggaaaaaacgaagaaagaucucggauuaggaagcauuacaacccagcaacccgagagcaacauccuggacauagaucuacguccugcaucagcauggacgcuguaugccguggccacaacauucaucacaccaauguugagacauagcauugaaaauuccucagugaacgugucccuaacagcuauugccaaccaagccacaguguuaaugggucuugggaaaggauggccacugucaaagauggacaucggaguuccccuucucgccauuggaugcuacucacaagucaaccccauaacacucacagcagcucuucucuuauugguagcacauuacgcuaucauagggccaggacuccaagcaaaagcaaccagagaagcucagaaaagagcagcagcgggcaucaugaaaaauccaacuguugauggaauaacaguaaucgaccuagauccaauacccuaugauccaaaguuugaaaagcaguugggacaaguaaugcuccuaguccucugugugacucaaguauugaugaugaggacuacaugggcucugugugaagcuuuaaccuuagcgacagggcccauuuccacauugugggaaggaaauccagggagguuuuggaacacuaccauugcagugucaauggcuaacauuuuuagaggaaguuacuuggcuggagcuggacuucucuuuuccaucaugaagaacacaaccaacacaagaaggggaacuggcaacauaggagagacgcuuggagaaaaauggaaaagccgguugaacgcauuggggaaaagugaauuccagaucuacaagaaaaguggaauccaggaaguggauagaacauuagcaaaagaaggcauuaaaagaggagaaacggaccaucacgcugugucgcgaggcucagcaaaacugagaugguucgucgagagaaauaugaucacaccagaagggaaaguaguggaccuugguugcggcagaggaggcuggucauacuauugugggggacuaaagaauguaagagaagucaaaggccugacaaagggaggaccagggcacgaagaacccauccccaugucuacauauggguggaaccuagugcgucuucaaaguggaguugacguuuucuucacuccgccagaaaagugcgacacauugcugugugacauaggggagucgucaccaaaucccacgguagaagcaggacggacacucagaguccucaacuuaguggaaaauugguugaacaacaacacccaauuuugcauaaagguucucaacccauacaugcccucagucauagaaaaaauggaagcacuacaaaggaaauauggaggagccuuagugaggaauccacucucacgaaacuccacacaugagauguacuggguauccaaugccuccgggaacauagugucaucagugaacaugauuucaaggauguugaucaacagauucacaaugaaacacaagaaagccaccuacgagccagauguugaccuaggaagcggaacccgcaacauuggaauugaaagugagguaccaaaccuggacauaauugggaaaagaauagaaaaaauaaaacaagagcaugaaacaucauggcacuaugaccaagaucacccauacaaaacaugggcuuaccaugguagcuacgaaacaaaacaaacuggaucagcaucauccauggugaacggaguggucagacugcugacaaaaccuugggacgucauccccauggugacacagauggcuaugacagacacgacuccauuuggacaacagcguguuuuuaaagagaaaguggacacgagaacccaagaaccgaaagaaggcacaaagaaauuaaugaaaaucacggcagaauggcuuuggaaagaacuagggaagaaaaagacaccuaggauguguacuagagaagaguucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugaaacauguguguacaacaugaugggaaaaagagagaagaagcuaggggaguucggcaaggcaaaaggcagcagagccauaugguauauguggcuuggagcacguuuuuuagaguuugaagcccuaggauucuugaaugaagaucacugguucuccagagagaacucccugaguggaguggaaggagaagggcugcacaagcuaggcuacaucuuaagagacgugagcaagaaagagggaggagcaauguaugccgaugacaccgcaggaugggacacaagaaucacacuggaagaucuaaaaaaugaagaaaugguaacaaaccacauggaaggagaacacaagaaacuagcugaggcuauuuucaaauuaacguaccaaaacaagguggugcgugugcaaagaccaacaccaagaggcacaguaauggauaucauaucaagaagagaccaaagagguagcggacaaguugguaccuauggacucaacacuuucacuaauauggaagcccaacuaaucagacagauggaaggagaaggagucuuuaaaagcauucagcaccugacggccacagaagaaauugccgugcaaaacuggcuagcaagaguagggcgcgaaagguuaucaagaauggccaucaguggagaugacuguguagugaaacccuuagaugacagauucgcaagugcuuuaacagcucuaaaugacaugggaaaggucaggaaagacauacaacaaugggaaccuucaaaaggguggaaugauuggacacaggugcccuucuguucacaucauuuccaugaguuaaucaugaaagacggucgcguacuuguaguuccauguagaaaccaagaugaauugauugguagagcccgaauuucccagggagcuggauggucuuugcgggagacagccuguuuagggaagucuuaugcccaaauguggagcuugauguacuuccacagacgugaccucaggcuggcggcaaaugcuaucugcucggcggucccaucacauuggguuccaacaaguagaacaaccugguccauacaugccaaacaugaauggaugacaacggaagacaugcugacagucuggaacaggguguggauucaagaaaauccauggauggaagacaagacuccaguggaaucaugggaggaaaucccauacuuggggaaaagagaagaccaauggugcgguucauugauugggcuaacaagcagggccaccugggcaaagaacauccaaacagcaauaaaucaaguuagaucccuuauaggcaaugaggaauacacagauuacaugccauccaugaaaagauucagaagagaagaggaagaggcaggaguccugugguag

SEQ ID NO: 6384 - RNA, 9876 nt, Artificial Sequence
  derived and/or modified CDS sequence (wt) from DENV-2__KF744406__SS-prME
acugcaggcaugaucauuaugcugauuccaacagugauggcguuccauuuaaccacacguaacggagaaccacacaugaucgucaguagacaagagaaagggaaaagucuucuguucaaaacagaggauggugugaacauguguacccucauggccauggaccuuggugaauugugugaagauacaaucacguauaaguguccucuucucaggcagaaugaaccagaagacauagauuguuggugcaacucuacauccacauggguaaccuaugggacguguaccaccacaggagaacacagaagagagaaaagaucaguggcacuagucccacaugugggaaugggauuggagacacgaacugaaacauggaugucaucagaaggggccuggaaacaugcccagagaauugaaacuuggauuuugagacauccaggcuuuaccuuaauggcagcaauccuggcauacaccauaggaacgacaaauuuccaaagagcccugaucuucaucuuacugacagcugucgcuccuucaaugacaaugcguugcauaggaauaucaaacagagauuuuguagaagggguuucaggaggaagcuggguugacauagucuuagaacauggaagcugugugacgacaauggccaaaaacaaaccgacauuggauuuugaacugauaaaaacagaagccaaacaaccugccacucuaaggaaguacugcauagaggcaaaguuaaccaacacaacaacagaaucucgcugcccaacacaaggggaacccagccuaaaugaagagcaggauaaaagguucgucugcaaacacuccaugguagacagaggauggggaaauggauguggacuauuuggaaaaggaggcauugugaccugugcuauguuuacaugcaaaaagaacauggaaggaaaaaucgugcaaccagaaaacuuggaauauaccaucgugauaacaccucacucaggggaagagcacgcaguuggaaaugacacagggaaacauggcaaggaaaucaaaauaacaccacagaguuccaucacagaagcagaguugacaggcuauggcacagucacgauggagugcucuccgaggacgggccucgauuucaaugagaugguguuguugcaaauggaaaacaaagcuuggcuggugcaccggcaaugguuccuagaucugccguugccauggcugcccggagcggacacacaaggaucaaauuggauacagaaagagacauuagucacuuucaaaaauccccaugcgaagaaacaagauguuguuguuuuaggaucccaagaaggggcuaugcauacagcacucacaggggccacagaaauccagaugucaucagggaacuuacuguucacaggacaucucaaguguaggcugaggauggacaaacuacagcucaaaggaaugucauacuccaugugcacaggaaaguuuaaaguugugaaggaaauagcagaaacacaacauggaacaauagucgucagaguacaauaugaaggggacgguucuccauguaagauucccuuugagauaauggauuuggaaaaaagacaugucuugggccgccugaucacagucaacccaauugugacagaaaaggauagcccagucaacauagaagcagaaccuccauucggagacagcuacgucaucauaggaguggagccggggcaauugaagcugaauugguuuaagaaaggaaguucuaucggccaaauguuugagacaacaaugaggggagcgaagagaauggcuauucuaggugacacagcuugggauuuuggaucccugggaggaguauucacaucuauaggaaaggcucuccaccagguuuuuggagcaaucuacggcgcugccuucagcggggucucguggacuaugaaaauccucauaggagucauuaucacauggauaggaaugaauucacguagcaccucacugucuguaucacuaguauuggugggagucguaacacuguaccugggaguuguggugcaggccgauagugguugcguugugagcuggagaaacaaagaacugaaaugugguagugggauuuucaucacagacaacgugcacacguggacagaacaauacaaguuccaaccagaaucccccucaaaacuagcuucagcuauccagaaagcucaucaagagggcauuuguggaauccgcucaguaacgagacuggaaaauuugauguggaaacaaauaacaccggaauugaaucacauucuaucagaaaaugaggugaagcugacuaucaugacaggagauaucaaaggaaucaugcaugcaggaaaacgaucuuugcggccucagcccacugagcugagguauucauggaaaacauggggcaaagcgaaaauccucucuacagagucccauaaccagaccuuccucauugauggccccgaaacagcagaaugccccaacacaaacagagcuuggaacucacuugaaguugaagacuauggcuuuggaguauucaccaccaauauauggcuaaggcugagagaaaagcaggaugcauuuugcgacucaaaacucaugucagcggccauaaaagacaacagagccguccaugccgacauggguuauuggauagaaagugcacucaaugacacauggaagauagagaaagccucuuucaucgaaguuaaaagcugccacuggccaaagucacacacccucuggagcaauggagugcuagaaagugagaugauaauuccaaagaauuucgcuggaccagugucacaacacaauuacagaccaggcuaccauacacaaacagcaggaccauggcauuuagguaagcuugagauggauuuugauuucugcaagggaacuacagugguggugacugaggacuguggaaauagaggacccuccuuaagaacaaccacugccucuggaaaacucauaacagaauggugcugcagaucuugcacauugccaccacuaagauauagaggugaggacggaugcugguacgggauggaaaucagaccauugaaagaaaaagaagagaauuuggucagcuccuuggucacagccggacaugggcagauugacaacuucucauuaggagucuugggaauggcauuguuucuggaagaaaugcucaggacccgaguaggaacgaaacaugcaauacuacuaguugcaguuucuuuugugacauugaucacagggaacauguccuuuagagaccugggaagagugaugguuauggugggcgcuacuaugacggaugacauagguaugggcgugacuuaucuugcccuacuagcagccuucaaagucagaccaacuuuugcagcuggacuacucuugagaaaguugaccucuaaggaauugaugaugacuaccauaggaaucguacuccucucccaaagcaccauaccagagaccauucuugaacugacugaugcguuagcccugggcaugaugguccucaaaauagugaggaaaauggaaagguaucaacuggcagugacuauuauggcuaucuugugcgucccaaaugcagugauauuacaaaacgcauggaaagugagcugcacaauauuggcagugguguccguuuccccacugcuauuaacauccucacagcagaaagcggauuggauaccauuagcauuaacgauuaaaggucucaauccaacagcuauauuucuaacaacccuuucacgaaccagcaagaaaaggagcuggccacuaaaugaggcuaucauggcagucgggauggugagcauuuuagccaguucacuucuaaaaaaugacauucccaugacaggaccauugguggcuggagggcuccucacaguaugcuaugugcucacuggacgaucggccgauuuggaauuggagaaagcugcugacgucagaugggaagaucaggcagagauaucaggaaguaguccaauccuaucaauaauaauaucagaagauggcagcaugucaauaaaaaacgaagaggaagaacaaacacugaccauacucauuagaacaggauugcuggugaucucaggacuuuuuccuguaucaauaccaaucacggcagcagcaugguaccugugggaagugaagaaacaacgggcuggaguauugugggaugucccuucacccccaccugugggaaaagcugaacuggaagauggagccuacagaaucaagcaaaaagggauucucggauauucccagaucggagccggaguuuacaaagaaggaacauuccauacaauguggcacgucacacguggugcuguucuaaugcauaaaggaaagaggauugagccaucaugggcggacgucaaaaaagaccuaauaucauauggaggaggcuggaaacuagaaggagaauggaaggaaggagaagaaguccagguccuggcauuggaaccuggaaaaaauccaagagccguccaaacaaaacccggucuuuucaaaaccaaugccggaaccauaggugccguaucucuggacuuuuccccuggaacgucaggaucaccaaucauugacaaaaaaggaaaggugguaggacuuuaugguaacggcguuguuacaaggaauggaucauaugugagugcuauagcccagacggaaaaaagcauugaagacaauccagagauugaagaugacauuuuucgaaagaaaagauugaccaucauggaccuccacccaggagcaggaaagacgaaaagauaccuuccggccauagucagagaagccauaaaacggggccugaggacauuaauucuggcccccacuagaguuguggcagcugaaauggaggaagcucuuaggggacucccaauaagauaccaaaccccagccaucagagccgagcacaccgggcgggagauuguggaccuaaugugucaugccacauucacuaugaggcugcuaucgccaauuagaguaccaaauuacaacuugauuaucauggaugaagcccauuucacagacccagcaaguauagcggccagaggauacauuucaacucgaguggaaaugggugaggcagcugggauuuucaugacagccacuccuccggggagcagagacccauuuccccagagcaaugcaccaaucauggaugaagaaagagaaaucccugaacguucguggaauuccggacaugaauggguuacggauuuuaaagggaagacuguuugguucguuccaaguauaaaagcaggaaaugacauagcagcuugccugagaaaaaauggaaagaaagugauacaacucagcaggaaaaccuuugauucugaguaugucaagacuagaaccaaugacugggacuuugugguuacaacugacauuucagaaaugggugccaacuucaaggcugagagggucauagaucccagacgcugcaugaaaccaguuauacuaacagacggugaagagcgggugauccuagcaggacccaugccagugacccauucuagugcagcacaaagaagagggagaauaggaagaaauccaaaaaaugaaaacgaccaguacauauauaugggggaaccucuggaaaacgacgaagacugugcacacuggaaagaagcuaaaaugcuccuagauaacaucaauacaccugaaggaaucauuccuaguauguucgaaccagagcgcgaaaagguggaugcuauugauggugaauaccgcuugagaggagaagcacggaaaaccuuuguagaccuaaugagaagaggagaccuaccagucugguuggccuacaagguggcagcugaaggcaucaacuacgcagacagaaggugguguuuugauggaaucaggaacaaccaaauccuggaagaaaauguggaaguggaaaucuggacaaaagaaggggaaaggaagaaauuaaaacccagguggcuggacgcuaggaucuauucugacccauuagcgcuaaaagaauucaaggaauuugcagcuggaagaaagucccugacccugaaccuaaucacagaaaugggaaggcuuccaacuuucaugacucagaaggcaagagacgcauuggacaaccuggcagugcugcacacggcugaagcagguggaagggcguacaaucaugcucucagcgaacugccggagacucuggagauaucacuuuuacugacacuucuggcuacagucacgggaggaaucuuuuuauucuugaugagcggaagagguauagggaagaugaccuuaggaaugugcugcauaaucacggccagcauucuucuaugguacgcacaaauacagccacacuggauagcagcuucaauaauacuggaauuuuuccucauaguucugcuuauuccagaaccagaaaagcagagaacaccccaagauaaccaauugaccuacguugucauagccauccucacagugguggccgcaaccauggcaaacgagauggguuuccuggaaaaaacgaagaaagaucucggauuaggaagcauuacaacccagcaacccgagagcaacauccuggacauagaucuacguccugcaucagcauggacgcuguaugccguggccacaacauucaucacaccaauguugagacauagcauugaaaauuccucagugaacgugucccuaacagcuauugccaaccaagccacaguguuaaugggucuugggaaaggauggccacugucaaagauggacaucggaguuccccuucucgccauuggaugcuacucacaagucaaccccauaacacucacagcagcucuucucuuauugguagcacauuacgcuaucauagggccaggacuccaagcaaaagcaaccagagaagcucagaaaagagcagcagcgggcaucaugaaaaauccaacuguugauggaauaacaguaaucgaccuagauccaauacccuaugauccaaaguuugaaaagcaguugggacaaguaaugcuccuaguccucugugugacucaaguauugaugaugaggacuacaugggcucugugugaagcuuuaaccuuagcgacagggcccauuuccacauugugggaaggaaauccagggagguuuuggaacacuaccauugcagugucaauggcuaacauuuuuagaggaaguuacuuggcuggagcuggacuucucuuuuccaucaugaagaacacaaccaacacaagaaggggaacuggcaacauaggagagacgcuuggagaaaaauggaaaagccgguugaacgcauuggggaaaagugaauuccagaucuacaagaaaaguggaauccaggaaguggauagaacauuagcaaaagaaggcauuaaaagaggagaaacggaccaucacgcugugucgcgaggcucagcaaaacugagaugguucgucgagagaaauaugaucacaccagaagggaaaguaguggaccuugguugcggcagaggaggcuggucauacuauugugggggacuaaagaauguaagagaagucaaaggccugacaaagggaggaccagggcacgaagaacccauccccaugucuacauauggguggaaccuagugcgucuucaaaguggaguugacguuuucuucacuccgccagaaaagugcgacacauugcugugugacauaggggagucgucaccaaaucccacgguagaagcaggacggacacucagaguccucaacuuaguggaaaauugguugaacaacaacacccaauuuugcauaaagguucucaacccauacaugcccucagucauagaaaaaauggaagcacuacaaaggaaauauggaggagccuuagugaggaauccacucucacgaaacuccacacaugagauguacuggguauccaaugccuccgggaacauagugucaucagugaacaugauuucaaggauguugaucaacagauucacaaugaaacacaagaaagccaccuacgagccagauguugaccuaggaagcggaacccgcaacauuggaauugaaagugagguaccaaaccuggacauaauugggaaaagaauagaaaaaauaaaacaagagcaugaaacaucauggcacuaugaccaagaucacccauacaaaacaugggcuuaccaugguagcuacgaaacaaaacaaacuggaucagcaucauccauggugaacggaguggucagacugcugacaaaaccuugggacgucauccccauggugacacagauggcuaugacagacacgacuccauuuggacaacagcguguuuuuaaagagaaaguggacacgagaacccaagaaccgaaagaaggcacaaagaaauuaaugaaaaucacggcagaauggcuuuggaaagaacuagggaagaaaaagacaccuaggauguguacuagagaagaguucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugaaacauguguguacaacaugaugggaaaaagagagaagaagcuaggggaguucggcaaggcaaaaggcagcagagccauaugguauauguggcuuggagcacguuuuuuagaguuugaagcccuaggauucuugaaugaagaucacugguucuccagagagaacucccugaguggaguggaaggagaagggcugcacaagcuaggcuacaucuuaagagacgugagcaagaaagagggaggagcaauguaugccgaugacaccgcaggaugggacacaagaaucacacuggaagaucuaaaaaaugaagaaaugguaacaaaccacauggaaggagaacacaagaaacuagcugaggcuauuuucaaauuaacguaccaaaacaagguggugcgugugcaaagaccaacaccaagaggcacaguaauggauaucauaucaagaagagaccaaagagguagcggacaaguugguaccuauggacucaacacuuucacuaauauggaagcccaacuaaucagacagauggaaggagaaggagucuuuaaaagcauucagcaccugacggccacagaagaaauugccgugcaaaacuggcuagcaagaguagggcgcgaaagguuaucaagaauggccaucaguggagaugacuguguagugaaacccuuagaugacagauucgcaagugcuuuaacagcucuaaaugacaugggaaaggucaggaaagacauacaacaaugggaaccuucaaaaggguggaaugauuggacacaggugcccuucuguucacaucauuuccaugaguuaaucaugaaagacggucgcguacuuguaguuccauguagaaaccaagaugaauugauugguagagcccgaauuucccagggagcuggauggucuuugcgggagacagccuguuuagggaagucuuaugcccaaauguggagcuugauguacuuccacagacgugaccucaggcuggcggcaaaugcuaucugcucggcggucccaucacauuggguuccaacaaguagaacaaccugguccauacaugccaaacaugaauggaugacaacggaagacaugcugacagucuggaacaggguguggauucaagaaaauccauggauggaagacaagacuccaguggaaucaugggaggaaaucccauacuuggggaaaagagaagaccaauggugcgguucauugauugggcuaacaagcagggccaccugggcaaagaacauccaaacagcaauaaaucaaguuagaucccuuauaggcaaugaggaauacacagauuacaugccauccaugaaaagauucagaagagaagaggaagaggcaggaguccugugguag

SEQ ID NO: 6385 - RNA, 9876 nt, Artificial Sequence
  derived and/or modified CDS sequence (wt) from DENV-2__KF744404__SS-prME
acugcaggcaugaucauuaugcugauuccaacagugauggcguuccauuuaaccacacguaacggagaaccacacaugaucgucaguagacaagagaaagggaaaagucuucuguucaaaacagaggauggugugaacauguguacccucauggccauggaccuuggugaauugugugaagauacaaucacguauaaguguccucuucucaggcagaaugaaccagaagacauagauuguuggugcaacucuacauccacauggguaaccuaugggacguguaccaccacaggagaacacagaagagagaaaagaucaguggcacuagucccacaugugggaaugggauuggagacacgaacugaaacauggaugucaucagaaggggccuggaaacaugcccagagaauugaaacuuggauuuugagacauccaggcuuuaccuuaauggcagcaauccuggcauacaccauaggaacgacaaauuuccaaagagcccugaucuucaucuuacugacagcugucgcuccuucaaugacaaugcguugcauaggaauaucaaacagagauuuuguagaagggguuucaggaggaagcuggguugacauagucuuagaacauggaagcugugugacgacaauggccaaaaacaaaccgacauuggauuuugaacugauaaaaacagaagccaaacaaccugccacucuaaggaaguacugcauagaggcaaaguuaaccaacacaacaacagaaucucgcugcccaacacaaggggaacccagccuaaaugaagagcaggauaaaagguucgucugcaaacacuccaugguagacagaggauggggaaauggauguggacuauuuggaaaaggaggcauugugaccugugcuauguuuacaugcaaaaagaacauggaaggaaaaaucgugcaaccagaaaacuuggaauauaccaucgugauaacaccucacucaggggaagagcacgcaguuggaaaugacacagggaaacauggcaaggaaaucaaaauaacaccacagaguuccaucacagaagcagaguugacaggcuauggcacagucacgauggagugcucuccgaggacgggccucgauuucaaugagaugguguuguugcaaauggaaaacaaagcuuggcuggugcaccggcaaugguuccuagaucugccguugccauggcugcccggagcggacacacaaggaucaaauuggauacagaaagagacauuagucacuuucaaaaauccccaugcgaagaaacaagauguuguuguuuuaggaucccaagaaggggcuaugcauacagcacucacaggggccacagaaauccagaugucaucagggaacuuacuguucacaggacaucucaaguguaggcugaggauggacaaacuacagcucaaaggaaugucauacuccaugugcacaggaaaguuuaaaguugugaaggaaauagcagaaacacaacauggaacaauagucgucagaguacaauaugaaggggacgguucuccauguaagauucccuuugagauaauggauuuggaaaaaagacaugucuugggccgccugaucacagucaacccaauugugacagaaaaggauagcccagucaacauagaagcagaaccuccauucggagacagcuacgucaucauaggaguggagccggggcaauugaagcugaauugguuuaagaaaggaaguucuaucggccaaauguuugagacaacaaugaggggagcgaagagaauggcuauucuaggugacacagcuugggauuuuggaucccugggaggaguauucacaucuauaggaaaggcucuccaccagguuuuuggagcaaucuacggcgcugccuucagcggggucucguggacuaugaaaauccucauaggagucauuaucacauggauaggaaugaauucacguagcaccucacugucuguaucacuaguauuggugggagucguaacacuguaccugggaguuguggugcaggccgauagugguugcguugugagcuggagaaacaaagaacugaaaugugguagugggauuuucaucacagacaacgugcacacguggacagaacaauacaaguuccaaccagaaucccccucaaaacuagcuucagcuauccagaaagcucaucaagagggcauuuguggaauccgcucaguaacgagacuggaaaauuugauguggaaacaaauaacaccggaauugaaucacauucuaucagaaaaugaggugaagcugacuaucaugacaggagauaucaaaggaaucaugcaugcaggaaaacgaucuuugcggccucagcccacugagcugagguauucauggaaaacauggggcaaagcgaaaauccucucuacagagucccauaaccagaccuuccucauugauggccccgaaacagcagaaugccccaacacaaacagagcuuggaacucacuugaaguugaagacuauggcuuuggaguauucaccaccaauauauggcuaaggcugagagaaaagcaggaugcauuuugcgacucaaaacucaugucagcggccauaaaagacaacagagccguccaugccgacauggguuauuggauagaaagugcacucaaugacacauggaagauagagaaagccucuuucaucgaaguuaaaagcugccacuggccaaagucacacacccucuggagcaauggagugcuagaaagugagaugauaauuccaaagaauuucgcuggaccagugucacaacacaauuacagaccaggcuaccauacacaaacagcaggaccauggcauuuagguaagcuugagauggauuuugauuucugcaagggaacuacagugguggugacugaggacuguggaaauagaggacccuccuuaagaacaaccacugccucuggaaaacucauaacagaauggugcugcagaucuugcacauugccaccacuaagauauagaggugaggacggaugcugguacgggauggaaaucagaccauugaaagaaaaagaagagaauuuggucagcuccuuggucacagccggacaugggcagauugacaacuucucauuaggagucuugggaauggcauuguuucuggaagaaaugcucaggacccgaguaggaacgaaacaugcaauacuacuaguugcaguuucuuuugugacauugaucacagggaacauguccuuuagagaccugggaagagugaugguuauggugggcgcuacuaugacggaugacauagguaugggcgugacuuaucuugcccuacuagcagccuucaaagucagaccaacuuuugcagcuggacuacucuugagaaaguugaccucuaaggaauugaugaugacuaccauaggaaucguacuccucucccaaagcaccauaccagagaccauucuugaacugacugaugcguuagcccugggcaugaugguccucaaaauagugaggaaaauggaaagguaucaacuggcagugacuauuauggcuaucuugugcgucccaaaugcagugauauuacaaaacgcauggaaagugagcugcacaauauuggcagugguguccguuuccccacugcuauuaacauccucacagcagaaagcggauuggauaccauuagcauuaacgauuaaaggucucaauccaacagcuauauuucuaacaacccuuucacgaaccagcaagaaaaggagcuggccacuaaaugaggcuaucauggcagucgggauggugagcauuuuagccaguucacuucuaaaaaaugacauucccaugacaggaccauugguggcuggagggcuccucacaguaugcuaugugcucacuggacgaucggccgauuuggaauuggagaaagcugcugacgucagaugggaagaucaggcagagauaucaggaaguaguccaauccuaucaauaauaauaucagaagauggcagcaugucaauaaaaaacgaagaggaagaacaaacacugaccauacucauuagaacaggauugcuggugaucucaggacuuuuuccuguaucaauaccaaucacggcagcagcaugguaccugugggaagugaagaaacaacgggcuggaguauugugggaugucccuucacccccaccugugggaaaagcugaacuggaagauggagccuacagaaucaagcaaaaagggauucucggauauucccagaucggagccggaguuuacaaagaaggaacauuccauacaauguggcacgucacacguggugcuguucuaaugcauaaaggaaagaggauugagccaucaugggcggacgucaaaaaagaccuaauaucauauggaggaggcuggaaacuagaaggagaauggaaggaaggagaagaaguccagguccuggcauuggaaccuggaaaaaauccaagagccguccaaacaaaacccggucuuuucaaaaccaaugccggaaccauaggugccguaucucuggacuuuuccccuggaacgucaggaucaccaaucauugacaaaaaaggaaaggugguaggacuuuaugguaacggcguuguuacaaggaauggaucauaugugagugcuauagcccagacggaaaaaagcauugaagacaauccagagauugaagaugacauuuuucgaaagaaaagauugaccaucauggaccuccacccaggagcaggaaagacgaaaagauaccuuccggccauagucagagaagccauaaaacggggccugaggacauuaauucuggcccccacuagaguuguggcagcugaaauggaggaagcucuuaggggacucccaauaagauaccaaaccccagccaucagagccgagcacaccgggcgggagauuguggaccuaaugugucaugccacauucacuaugaggcugcuaucgccaauuagaguaccaaauuacaacuugauuaucauggaugaagcccauuucacagacccagcaaguauagcggccagaggauacauuucaacucgaguggaaaugggugaggcagcugggauuuucaugacagccacuccuccggggagcagagacccauuuccccagagcaaugcaccaaucauggaugaagaaagagaaaucccugaacguucguggaauuccggacaugaauggguuacggauuuuaaagggaagacuguuugguucguuccaaguauaaaagcaggaaaugacauagcagcuugccugagaaaaaauggaaagaaagugauacaacucagcaggaaaaccuuugauucugaguaugucaagacuagaaccaaugacugggacuuugugguuacaacugacauuucagaaaugggugccaacuucaaggcugagagggucauagaucccagacgcugcaugaaaccaguuauacuaacagacggugaagagcgggugauccuagcaggacccaugccagugacccauucuagugcagcacaaagaagagggagaauaggaagaaauccaaaaaaugaaaacgaccaguacauauauaugggggaaccucuggaaaacgacgaagacugugcacacuggaaagaagcuaaaaugcuccuagauaacaucaauacaccugaaggaaucauuccuaguauguucgaaccagagcgcgaaaagguggaugcuauugauggugaauaccgcuugagaggagaagcacggaaaaccuuuguagaccuaaugagaagaggagaccuaccagucugguuggccuacaagguggcagcugaaggcaucaacuacgcagacagaaggugguguuuugauggaaucaggaacaaccaaauccuggaagaaaauguggaaguggaaaucuggacaaaagaaggggaaaggaagaaauuaaaacccagguggcuggacgcuaggaucuauucugacccauuagcgcuaaaagaauucaaggaauuugcagcuggaagaaagucccugacccugaaccuaaucacagaaaugggaaggcuuccaacuuucaugacucagaaggcaagagacgcauuggacaaccuggcagugcugcacacggcugaagcagguggaagggcguacaaucaugcucucagcgaacugccggagacucugcagauaucacuuuuacugacacuucuggcuacagucacgggaggaaucuuuuuauucuugaugagcggaagagguauagggaagaugaccuuaggaaugugcugcauaaucacggccagcauucuucuaugguacgcacaaauacagccacacuggauagcagcuucaauaauacuggaauuuuuccucauaguucugcuuauuccagaaccagaaaagcagagaacaccccaagauaaccaauugaccuacguugucauagccauccucacagugguggccgcaaccauggcaaacgagauggguuuccuggaaaaaacgaagaaagaucucggauuaggaagcauuacaacccagcaacccgagagcaacauccuggacauagaucuacguccugcaucagcauggacgcuguaugccguggccacaacauucaucacaccaauguugagacauagcauugaaaauuccucagugaacgugucccuaacagcuauugccaaccaagccacaguguuaaugggucuugggaaaggauggccacugucaaagauggacaucggaguuccccuucucgccauuggaugcuacucacaagucaaccccauaacacucacagcagcucuucucuuauugguagcacauuacgcuaucauagggccaggacuccaagcaaaagcaaccagagaagcucagaaaagagcagcagcgggcaucaugaaaaauccaacuguugauggaauaacaguaaucgaccuagauccaauacccuaugauccaaaguuugaaaagcaguugggacaaguaaugcuccuaguccucugugugacucaaguauugaugaugaggacuacaugggcucugugugaagcuuuaaccuuagcgacagggcccauuuccacauugugggaaggaaauccagggagguuuuggaacacuaccauugcagugucaauggcuaacauuuuuagaggaaguuacuuggcuggagcuggacuucucuuuuccaucaugaagaacacaaccaacacaagaaggggaacuggcaacauaggagagacgcuuggagaaaaauggaaaagccgguugaacgcauuggggaaaagugaauuccagaucuacaagaaaaguggaauccaggaaguggauagaacauuagcaaaagaaggcauuaaaagaggagaaacggaccaucacgcugugucgcgaggcucagcaaaacugagaugguucgucgagagaaauaugaucacaccagaagggaaaguaguggaccuugguugcggcagaggaggcuggucauacuauugugggggacuaaagaauguaagagaagucaaaggccugacaaagggaggaccagggcacgaagaacccauccccaugucuacauauggguggaaccuagugcgucuucaaaguggaguugacguuuucuucacuccgccagaaaagugcgacacauugcugugugacauaggggagucgucaccaaaucccacgguagaagcaggacggacacucagaguccucaacuuaguggaaaauugguugaacaacaacacccaauuuugcauaaagguucucaacccauacaugcccucagucauagaaaaaauggaagcacuacaaaggaaauauggaggagccuuagugaggaauccacucucacgaaacuccacacaugagauguacuggguauccaaugccuccgggaacauagugucaucagugaacaugauuucaaggauguugaucaacagauucacaaugaaacacaagaaagccaccuacgagccagauguugaccuaggaagcggaacccgcaacauuggaauugaaagugagguaccaaaccuggacauaauugggaaaagaauagaaaaaauaaaacaagagcaugaaacaucauggcacuaugaccaagaucacccauacaaaacaugggcuuaccaugguagcuacgaaacaaaacaaacuggaucagcaucauccauggugaacggaguggucagacugcugacaaaaccuugggacgucauccccauggugacacagauggcuaugacagacacgacuccauuuggacaacagcguguuuuuaaagagaaaguggacacgagaacccaagaaccgaaagaaggcacaaagaaauuaaugaaaaucacggcagaauggcuuuggaaagaacuagggaagaaaaagacaccuaggauguguacuagagaagaguucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugaaacauguguguacaacaugaugggaaaaagagagaagaagcuaggggaguucggcaaggcaaaaggcagcagagccauaugguauauguggcuuggagcacguuuuuuagaguuugaagcccuaggauucuugaaugaagaucacugguucuccagagagaacucccugaguggaguggaaggagaagggcugcacaagcuaggcuacaucuuaagagacgugagcaagaaagagggaggagcaauguaugccgaugacaccgcaggaugggacacaagaaucacacuggaagaucuaaaaaaugaagaaaugguaacaaaccacauggaaggagaacacaagaaacuagcugaggcuauuuucaaauuaacguaccaaaacaagguggugcgugugcaaagaccaacaccaagaggcacaguaauggauaucauaucaagaagagaccaaagagguagcggacaaguugguaccuauggacucaacacuuucacuaauauggaagcccaacuaaucagacagauggaaggagaaggagucuuuaaaagcauucagcaccugacggccacagaagaaauugccgugcaaaacuggcuagcaagaguagggcgcgaaagguuaucaagaauggccaucaguggagaugacuguguagugaaacccuuagaugacagauucgcaagugcuuuaacagcucuaaaugacaugggaaaggucaggaaagacauacaacaaugggaaccuucaaaaggguggaaugauuggacacaggugcccuucuguucacaucauuuccaugaguuaaucaugaaagacggucgcguacuuguaguuccauguagaaaccaagaugaauugauugguagagcccgaauuucccagggagcuggauggucuuugcgggagacagccuguuuagggaagucuuaugcccaaauguggagcuugauguacuuccacagacgugaccucaggcuggcggcaaaugcuaucugcucggcggucccaucacauuggguuccaacaaguagaacaaccugguccauacaugccaaacaugaauggaugacaacggaagacaugcugacagucuggaacaggguguggauucaagaaaauccauggauggaagacaagacuccaguggaaucaugggaggaaaucccauacuuggggaaaagagaagaccaauggugcgguucauugauugggcuaacaagcagggccaccugggcaaagaacauccaaacagcaauaaaucaaguuagaucccuuauaggcaaugaggaauacacagauuacaugccauccaugaaaagauucagaagagaagaggaagaggcaggaguccugugguag

SEQ ID NO: 6386 - RNA, 9876 nt, Artificial Sequence
  derived and/or modified CDS sequence (wt) from DENV-2__KF744407__SS-prME
acugcaggcaugaucauuaugcugauuccaacagugauggcguuccauuuaaccacacguaacggagaaccacacaugaucgucaguagacaagagaaagggaaaagucuucuguucaaaacagaggauggugugaacauguguacccucauggccauggaccuuggugaauugugugaagauacaaucacguauaaguguccucuucucaggcagaaugaaccagaagacauagauuguuggugcaacucuacauccacauggguaaccuaugggacguguaccaccacaggagaacacagaagggaaaagagaucaguggcacuagucccacaugugggaaugggauuggagacacgaacugaaacauggaugucaucagaaggggccuggaaacaugcccagagaauugaaacuuggauuuugagacauccaggcuuuaccuuaauggcagcaauccuggcauacaccauaggaacgacaaauuuccaaagagcccugaucuucaucuuacugacagcugucgcuccuucaaugacaaugcguugcauaggaauaucaaacagagauuuuguagaagggguuucaggaggaagcuggguugacauagucuuagaacauggaagcugugugacgacaauggccaaaaacaaaccgacauuggauuuugaacugauaaaaacagaagccaaacauccugccacuuuaaggaaguauuguauagaggcaaagcugaccaacacaacaacagcaucucgcugcccaacacaaggggaacccagccuaaaugaagagcaggauaaaagguucgucugcaaacacuccaugguagacagaggauggggaaauggauguggacuauuuggaaaaggaggcaucgugaccugugcuauguucacaugcaaaaagaacauggaaggaaaagucgugcaaccagaaaacuuggaauauaccauugugauaacaccucacucaggggaagagcacgcaguuggaaaugacacagggaaacauggcaaggaaaucaaaauaacaccacagaguuccaucacagaagcagagcugacaggcuauggcacugucacgauggagugcucuccgaggacgggccucgauuucaaugagaugguguugcugcaaauggaaaacaaagcuuggcuggugcaccggcaaugguuccuagaucugccguugccauggcugcccggagcagacacacaaggaucaaauuggauacagaaagagacauuagucacuuucaaaaauccccaugcgaagaaacaagauguuguuguuuuaggaucccaagaaggggcuaugcauacagcacucacaggggccacagaaauccagaugucaucagggaacuuacuguucacaggacaucucaaguguaggcugaggauggacaaacuacagcucaaaggaaugucauacuccaugugcacaggaaaguuuaaaguugugaaggaaauagcagaaacacaacauggaacaauagucgucagaguacaauaugaaggggacgguucuccauguaagaucccuuuugagauaauggauuuggaaaaaagacaugucuuaggucgcuugaucacagucaacccaauuguuacagaaaaggacagcccagucaacauagaagcagaaccuccauucggagacagcuacgucaucauaggaguggagccggggcaauugaagcugaauugguuuaagaaaggaaguucuaucggccaaauguuugagacaacaaugaggggagcgaagagaauggcuauucuaggugacacagcuugggauuuuggaucccugggaggaguauucacaucuauaggaaaggcucuccaccagguuuuuggagcaaucuauggggcugccuucagcggggucucauggacuaugaaaauccucauaggagucauuaucacauggauaggaaugaauucacguagcaccucacugucugugucacuaguauuagugggggucgugacauuguauuugggagucauggugcaggccgauagugguugcguugcgagcuggaaaaacaaagaacugaaaugugguagugggauuuucaucacagacaacgugcacacguggacagaacaauacaaguuccaaccagaaucccccucaaaacuagcuucagcuauccagaaagcucaucaagagggcauuuguggaauccgcucaguaacgagacuggaaaauuugauguggaaacaaauaacaccggaauugaaucacauucuaucagaaaaugaggugaagcugacuaucaugacaggagauaucaaaggaaucaugcaugcaggaaaacgaucuuugcggccucagcccacugagcugagguacucauggaaaacauggggcaaagcgaaaauccucucuacagagucccauaaccagaccuuccucauugauggccccgaaacagcagaaugccccaacacaaacagagcuuggaacucacuugaaguugaagacuauggcuuuggaguauucaccaccaauauauggcuaaggcugagagaaaagcaggaugcauuuugcgacucaaaacucaugucagcggccauaaaagacaacagagccguccaugccgacauggguuauuggauagaaagugcacucaaugacacauggaagauagagaaagccucuuucaucgaaguuaaaagcugccacuggccaaagucacacacccucuggagcaauggagugcuagaaagugagaugauaauuccaaagaauuucgcuggaccagugucacaacacaauuacagaccaggcuaucauacacaaacagcaggacccuggcaucuagguaagcuugagauggacuuugauuuuugugaaggaaccacagugguagugacugaggacuguggaaauagaggacccucuuuaagaacaacuacugcuucuggaaaacucauaacagaauggugcugccggucuugcacauuaccaccgcuaagguacagaggugaggacggaugcugguacgggauggaaaucagaccauugaaagaaaaagaagagaauuuggucagcuccuuggucacagccggacaugggcagauugacaacuucucauuaggagucuugggaauggcauuguuucuggaagaaaugcucaggacccgaguaggaacgaaacaugcaauacuacuaguugcaguuucuuuugugacauugaucacagggaacauguccuuuagagaccugggaagagugaugguuauggugggcgcuacuaugacggaugacauagguaugggcgugacuuaucuugcccuacuagcagccuucaaagucagaccaacuuuugcagcuggacuacucuugagaaaguugaccucuaaggaauugaugaugacuaccauaggaaucguacuccucucccaaagcaccauaccagagacuauacucgaacugacugacgcgcuggcuuuggggaugaugguucucaaaauagugagaaacauggaaaaguaucaacuagcagugacuauuauggcuaucuugugcgucccaaaugcagugauauuacaaaacgcauggaaagugagcugcacaauauuggcagugguguccguuuccccacugcuauuaacauccucacagcagaaagcagauuggauaccauuagcguuaacgaucaaaggucucaauccaacagcuauauuucuaacaacccuuucacgaaccagcaagaaaaggagcuggccacuaaaugaggcuaucauggcagucgggauggugagcauuuuagccaguucacuucuaaaaaaugacauucccaugacaggaccauugguggcuggagggcuccucacaguaugcuaugugcucacuggacgaucggccgauuuggaauuggagaaagcugcugacgucagaugggaagaacaggcagagauaucaggaaguaguccaauccuaucaauaauaauaucagaagauggcagcaugucaauaaaaaacgaagaggaagaacaaacacugaccauacucauuagaacaggauugcuggugauaucaggacuuuuuccuguaucaauaccaaucacggcagcugcaugguaccugugggaagugaagaaacaacgggcuggaguauugugggaugucccuucacccccaccugugggaaaagccgaacuggaagauggagccuacagaaucaagcaaaaagggauucucggauauucccagaucggagccggaguuuacaaagaaggaacauuccacacaauguggcacgucacacguggugcuguccuaaugcauaaagggaagaggauugagccaucaugggcggacgucaaaaaagaccuaauaucauauggaggaggcuggaagcuagaaggagaauggaaggaaggagaagaaguccagguccuggcauuggaaccuggaaaaaauccaagagccguccaaacaaaacccggucuuuucaaaaccaaugccggaaccauaggugccguaucucuggacuuuuccccuggaacgucaggaucaccaaucauugacaaaaaaggaaaggugguaggacuuuaugguaacggcguuguuacaaggaauggaucauaugugagugcuauagcccagacggaaaaaagcauugaagacaauccagagauugaagaugacauuuuucgaaagaaaagauugaccaucauggaccuccacccaggagcaggaaagacgaagagauaccuuccagcaauagucagagaagccauaaaacgaggcuugaggacauuaauucuggcccccacuagaguuguggcagcugaaauggaggaagcucuuaggggacucccaauaagauaccaaaccccagccaucagagccgagcacaccgggcgggagauuguggaccuaaugugucaugccacauucacuaugaggcugcuaucgccaauuagaguaccaaauuacaacuugauuaucauggaugaagcccauuucacagacccagcaaguauagcagcuagaggauacauuucaacucgaguggaaaugggugaggcagcugggauuuucaugacagccacuccuccggggagcagagacccauuuccccagagcaaugcaccaaucauggaugaagaaagagaaaucccugaacguucguggaauuccggacaugaauggguuacggauuuuaaagggaagacuguuugguucguuccaaguauaaaagcaggaaaugacauagcagcuugccugagaaaaaauggaaagaaagugauacaacucagcaggaaaaccuuugauucugaguaugucaagacuagaaccaaugacugggacuuugugguuacaacugacauuucagaaaugggugccaacuucaaggcugagagggucauagaucccagacgcugcaugaaaccaguuauacuaacagacggugaagagcgggugauccuagcaggacccaugccagugacccauucuagugcagcacaaagaagagggagaauaggaagaaauccaaaaaaugaaaacgaccaguacauauauaugggggaaccucuggaaaacgacgaagacugugcacacuggaaagaagcuaaaaugcuccuagauaacaucaauacaccugaaggaaucauuccuaguauguucgaaccagagcgcgaaaagguggaugcuauugauggugaauaccgcuugagaggagaagcacggaaaaccuuuguagaccuaaugagaagaggagaccuaccagucugguuggccuacaagguggcagcugaaggcaucaacuacgcagacagaaggugguguuuugauggaaucaggaacaaccaaauccuggaagaaaauguggaaguggaaaucuggacaaaagaaggagaaaggaagaaauuaaaacccagguggcuggacgcuaggaucuauucugacccauuagcgcuaaaagaauucaaggaauuugcagcuggaagaaagucccugacccugaaccuaaucacagaaaugggaaggcuuccaacuuucaugacucagaaggcaagagacgcauuggacaaccuggcagugcugcacacggcugaagcagguggaagggcguacaaucaugcucucagcgaacugccggagacucuggagacauugcuuuuacugacacucuuggccacagucacgggcggaaucuuccuauucuugaugagcggaaaaggcauagggaagaugacccugggaaugugcugcauaaucacggccaguguucuccuaugguaugcacaaauacagccacacuggauagcagcuucaauaauacuggaauuuuuccucauaguucugcuuauuccagaaccagaaaagcagagaacaccccaagauaaccaauuaaccuacguugucauagccauccucacagugguggccgcaaccauggcaaacgagauggguuuccuggaaaagacaaagaaagauuucggauugggaagcauugcaacccagcaacccgagagcaacauccuggacauagaucuacguccugcaucagcauggacgcuguaugccguggccacaacauucaucacaccaaugcugagacauagcauugaaaauuccucagugaacgugucccuaacagcuauugccaaccaagccacaguguuaaugggucuugggaaaggauggccacugucaaagauggacaucggaguuccccuucucgccauuggaugcuauucacaagucaaccccauaacacucacagcagcucuucucuuauugguagcacauuacgcuaucauagggccaggacuccaagcaaaagcaaccagagaagcucagaaaagagcagcagcgggcaucaugaaaaauccaacuguugauggaauaacaguaaucgaccuagauccaauacccuaugauccaaaguuugaaaagcaguugggacaaguaaugcuccuaguccucugugugacucaaguauugaugaugaggacuacaugggcucugugugaagcuuuaaccuuagcgacagggcccauuuccacauugugggaaggaaauccagggagguuuuggaacacuaccauugcagugucaauggcuaacauuuuuagaggaaguuaccuggcuggagcuggacuucucuuuucuaucaugaagaacacaaccaacacaagaaggggaacuggcaacauaggagagacgcuuggagaaaaauggaaaagccgguugaacgcauuggggaaaagugaauuccagaucuacaagaaaaguggaauccaggaaguggauagaacauuagcaaaagaaggcauuaaaagaggagaaacggaccaucacgcugugucgcgaggcucagcaaaacugagaugguucgucgagagaaauaugaucacaccagaagggaaaguaguggaccuugguugcggcagaggaggcuggucauacuauugugggggacuaaagaauguaagagaagucaaaggccuaacaaaaggaggaccaggacacgaagaacccauucccaugucaacauaugguuggaaccuggugcgucuucaaaguggaguugauguuuuuuuuacuccgccagaaaagugugacacacuacugugugacauaggggagucgucaccaaaccccacgguugaggcaggacgaacacucagaguucuaaaccuaguggaaaauuggcugaacaacaacacccaauuuugcaucaagguucucaacccauauaugcccucaguuauagaaaaaauggaagcgcugcaaaggaaauacggaggagcuuuggugaggaauccacucucacgaaauuccacacacgagauguacuggguauccaaugccuccgggaacauagugucaucagugaacaugauuucaaggauguugaucaacagauucacaaugaaacacaagaaagccaccuacgagccagauguugaccuaggaagcggaacccgcaacauuggaauugaaagugagguaccaaaccuggacauaauugggaaaagaauagaaaaaauaaaacaagagcaugaaacaucauggcacuaugaccaagaucacccauacaaaacaugggcuuaccaugguagcuacgaaacaaaacaaacuggaucagcaucauccauggugaacggaguggucagacugcugacaaaaccuugggacgucauccccauggugacacagauggcuaugacagacacgacuccauuuggacaacagcguguuuuuaaagagaaaguggacacgagaacccaagaaccgaaagaaggcacaaagaaauuaaugaaaaucacggcagaauggcuuuggaaagaacuagggaagaaaaagacaccuaggauguguacuagagaagaguucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugaaacauguguguacaacaugaugggaaaaagagagaagaagcuaggggaguucggcaaggcaaaaggcagcagagccauaugguauauguggcuuggagcacguuuuuuagaguuugaagcccuaggauucuugaaugaagaucacugguucuccagagagaacucccugaguggaguggaaggagaagggcugcacaagcuaggcuacaucuuaagagacgugagcaagaaagagggaggagcaauguaugccgaugacaccgcaggaugggacacaagaaucacacuggaagaucuaaaaaaugaagaaaugguaacaaaccacauggaaggagaacacaagaaacuagcugaggcuauuuucaaauuaacguaccaaaacaagguggugcgugugcaaagaccaacaccaagaggcacaguaauggauaucauaucaagaagagaccaaagagguagcggacaaguuggcaccuacggccucaauacuuucaccaacauggaagcccaacugaucagacagauggaaggagaaggagucuuuaaaagcauucagcaccugacggccacagaagaaauugccgugcaaaacuggcuaacaagaguagggcgcgaaagguuaucaagaauggccaucaguggagaugacuguguagugaaacccuuagaugacagauucgcaagugcuuuaacagcucuaaaugacaugggaaaggucaggaaagacauacaacaaugggaaccuucaaaaggguggaaugauuggacacaggugcccuucuguucacaucauuuccaugaguuaaucaugaaagacggucgcguacuuguaguuccaugcagaaaccaagaugaacugauugguagggcccgaauuucccagggagccggguggucuuugcgggaaacagccuguuuggggaagucuuacgcccaaauguggagccugauguacuuccacagacgugaccuuaggcuggcggcaaaugccauuugcucggcagucccaucacauuggguuccaacaagucgaacaacuugguccauacaugccaaacaugaauggaugacaacggaagacaugcugacagucuggaacaggguguggauucaagaaaauccauggauggaagacaagacuccaguggaaucaugggaggaaaucccauacuuggggaaaagagaagaccaauggugcgguucauugauugggcuaacaagcagggccaccugggcaaagaacauccaaacagcaauaaaucaaguuagaucccuuauaggcaaugaggaauacacagauuacaugccauccaugaaaagauucagaagagaagaggaagaggcaggaguccugugguag

SEQ ID NO: 6387 - RNA, 9876 nt, Artificial Sequence
  derived and/or modified CDS sequence (wt) from DENV-2__KF744399__SS-prME
acugcaggcaugaucauuaugcugauuccaacagugauggcguuccauuuaaccacacguaacggagaaccacacaugaucgucaguagacaagagaaagggaaaagucuucuguuuaaaacagaggauggugugaacaugugcacccucauggccauggaccuuggugaauugugugaagauacaaucacguacaaguguccucuucucaggcagaaugaaccagaagacauagauuguuggugcaacucuacauccacauggguaaccuaugggacguguaccaccacaggagaacacagaagagagaaaagaucaguggcacuagucccacaugugggaaugggauuggagacacgaacugaaacauggaugucaucagaaggggccuggaaacaugcccagagaauugaaaccuggauuuugagacauccaggcuuuaccuuaauggcagcaauccuggcauacaccauaggaacgacaaauuuccaaagagcccugaucuucaucuuacugacagcugucgcuccuucaaugacaaugcguugcauaggaauaucaaacagagacuuuguagaagggguuucaggaggaagcuggguugacauagucuuagaacauggaagcugugugacgacaauggccaaaaacaaaccaacauuggauuucgaacugauaaaaacagaagccaaacauccugccacucuaaggaaguauuguauagaggcaaagcugaccaacacaacaacagaaucucgcugcccaacacaaggagaacccagccuaaaugaagaacaggauaaaagguucgucugcaaacacuccaugguagacagaggauggggaaauggauguggacuauuuggaaaaggaggcauugugaccugugcuauguuuacaugcaaaaagaacauggaaggaaaaaucgugcaaccagaaaacuuggaauauaccaucgugauaacaccucacucaggggaagagaaugcaguuggaaaugacacaggaaaacacggcaaggaaauuaaaguaacaccacagaguuccauuacagaagcagaacugacaggcuauggcacugucacgauggaaugcucuccgagaacgggccucggcuuuaaugagaugguguuguugcaaauggaaaacaaagcuuggcuggugcaccggcaaugguucuuagaucugccguugccauggcugcccggagcggacacacaaggaucaaauuggauacagaaagagacauuagucacuuucaaaaauccccaugcgaagaaacaagauguuguuguuuuaggaucccaagaaggggcuaugcauacagcacucacaggggccacagaaauccagaugucaucagggaacuuacuguucacaggacaucucaagugcaggcugaggauggacaaacuacagcucaaaggaaugucauacuccaugugcacaggaaaauuuaaaguugugaaggaaauagcagaaacacaacauggaacaauagucgucagaguacaauaugaaggggacgguucuccauguaagauucccuuugagauaauggauuuggaaaaaagacaugucuugggccgccugaucacagucaacccaauugugacagaaaaggacagcccagucaacauagaagcagaaccuccauucggagacagcuacgucaucauaggaguggagccgggacaacugaagcucagcugguuuaagaaaggaagcucuauuggccaaauguuugagacaacaaugaggggagcgaagagaauggcuauucuaggugacacagcuugggauuuuggaucccugggaggaguauucacaucuauaggaaaggcccuccaccaagucuuuggagcaaucuauggggcugccuuuagcgggguuucauggacuaugaaaauccucauaggagucgucaucacauggauaggaaugaauucacgcagcaccucacugucugugucacuaguauuagugggggucgugacauuguauuugggagucauggugcaggccgauagugguugcguugugagcuggaaaaacaaagaacugaaaugugguagugggauuuucaucacagacaacgugcacacauggacagaacaauacaaguuccaaccagaauccccuucaaaacuagcuucagcuauccagaaggcucaccaagagggcauuuguggaauccgcucaguaacaagacuggaaaaucugauguggaaacaaauaacaccggaauugaaucacauucuaucagaaaaugaggugaagcugacuaucaugacaggagauaucaaaggaaucaugcaugcaggaaaacgaucuuugcggccucagcccacugagcugagguacucuuggaaagcauggggcaaagcgaaaauccucucuacagagcuccauaaccagaccuuccucauugauggccccgaaacagcagaaugccccaacacaaacagagcuuggaacucacuugaaguugaagacuauggcuuuggaguauucaccaccaauauauggcuaaagcugagagaaaagcaggaugcauuuugcgacucaaaacucaugucagcggcuauaaaagacaacagggccguccaugccgauauggguuauuggauagaaagugcacucaaugacacauggaagauagagaaagccucuuucaucgaaguuaaaagcugccacuggccaaagucacacacccucuggagcaauggagugcuagaaagugagaugauaauuccaaagaauuucgcuggaccagugucacaacacaauuacagaccaggcuaccauacacaaacagcaggaccauggcauuuagguaagcuugagauggacuuugauuucugcaagggaacuacagugguggugacugaggacugcggaaauagaggacccuccuuaagaacaaccacugccucuggaaaacucauaacagaauggugcuguagaucuugcacauugccaccacuaagguacagaggugaggauggaugcugguauggaauggaaaucaggccauugaaagagaaagaagagaaccuggucaacucuuuggucacagccggacaugggcagauugacaacuucucauuaggagucuugggaauggcauuguuucuggaagaaaugcucaggacccgaguaggaacgaaacaugcaauacuacuaguugcaguuucuuuugugacauugaucacagggaacauguccuuuagagaccugggaagagugaugguuauggugggcgcuacuaugacggaugacauaggcaugggcgugacuuaucuugcccuacuagcagccuucaaagucagaccaacuuuugcagcuggacuacucuugagaaaguugaccucuaaggaauugaugaugacuaccauaggaaucguacuccucucccaaagcaccauaccagagacuauacucgaacugacugacgcgcuggcuuuggggaugaugguucucaaaauagugaggaaaauggaaagguaucaacuggcagugacuaucauggcuaucuugugcgucccaaaugcagugauauuacaaaacgcauggaaagugagcugcacaauauuggcaguaguguccguuuccccacugcuauuaacauccucacagcagaaagcggauuggauaccauuagcauuaacgaucaaaggucucaauccaacagcuauauuccuaacaacccuuucacgaaccagcaagaaaaggagcuggccacuaaaugaggcuaucauggcagucgggauggugagcauuuuagccaguucacuccuuaaaaaugacauucccaugacaggaccauugguggcuggagggcuccuuacaguaugcuacgugcucacuggacgaucggccgauuuggaauuggagaaagcugcugacgucagaugggaagaacaggcagagauaucaggaaguaguccaauccugucaauaauaauaucggaagaugguagcaugucgauaaaaaacgaagaagaagaacaaacacugaccauacucauuaggacaggacugcuggugauaucaggacuuuuucccgugucaauaccaaucacggcagcugcaugguaccugugggaagugaaaaaacaacgagccggaguauugugggaugucccuucacccccaccugugggaaaagcugaacuggaagacggagccuacagaaucaagcagaaagggauucuaggauacucgcagaucggagcuggaguuuacaaagaaggaacauuccacacaauguggcacgucacacgcggugcuguccuaaugcauaaagggaagagacuugaaccaucaugggcggacgucaagaaagaccuaauaucguauggaggaggcuggaaacuagaaggagaauggaaggaaggagaagaaguccagguccuggcauuggagccuggaaaaaauccaagagccguccaaacaaaacccggucucuucaaaacuaacacuggaaccauaggcgccguaucucuggacuuuuccccuggaacgucaggaucaccaaucauugacaaaaaaggaaaggugguaggacuuuaugguaacggcguugucacaaggaauggaucauaugugagugcuauugcccagacggaaaaaagcauugaagacaauccagagauugaagaugacaucuuucgaaagaaaagauugaccaucauggaccuccacccaggagcaggaaagacgaaaagauaccuuccggccauagucagagaagccauaaaacggggccugaggacauuaauucuggcccccacuagaguuguggcagcugaaauggaggaagcucuuaggggacuuccaauaagauaccaaaccccagccaucagagccgagcacaccgggcgggagauuguggaccuaaugugccaugccacauucacuaugaggcugcuaucgccaauuagaguaccaaauuacaaccugauuaucauggaugaagcccauuucacagacccagcaaguauagcggccagaggauacauuucaacucgaguggaaaugggugaggcagcugggauuuuuaugacagccacuccuccggggagcagagacccauuuccccagagcaaugcaccaaucauggaugaagaaagagaaaucccugaacguucguggaauuccggacaugaauggguuacggauuuuaaagggaagacuguuugguucguuccaaguauaaaagcaggaaaugacauagcagcuugccugagaaaaaauggaaagaaagugauacaacucagcaggaaaaccuuugauucugaguaugucaagacuagaaccaaugacugggacuuugugguuacaacugacauuucagaaaugggugccaacuucaaggcugagagggucauagaucccagacgcugcaugaaaccaguuauacuaacagacggugaagagcgggugauccuagcaggacccaugccagugacccacucuagugcagcacaaagaagagggagaauaggaagaaauccgaaaaaugaaaacgaccaguacauauacaugggggaaccucuggaaaacgacgaagacugugcacacuggaaagaagcuaaaaugcuccuagauaacaucaauacaccugaaggaauaauuccuaguauguucgaaccagagcgcgaaaagguggaugccauugauggugaauaccgcuugagaggagaagcacggaaaaccuuuguagaccuaaugagaagaggagaccuaccagucugguuggccuacaagguggcagcugaaggcaucaacuacgcagacagaaggugguguuuugauggaaucaggaacaaccaaauccuggaagaaaauguggaaguggaaaucuggacaaaagaaggggaaaggaagaaauuaaaacccagauggcuggacgccaggaucuauucugacccacuagcacuaaaagaauucaaggaauuugcagcuggaagaaagucccucacccugaaucuaaucacagagauggguaggcuuccaacuuucaugacucagaaggcaagagacgcauuggacaaccuggcagugcugcacacggcugaagcagguggaagggcguacaaucaugcucucagcgaacugccggagacucuggagacauugcuuuuacugacacucuuggccacagucacgggcggaaucuuccuauucuugaugagcggaaaaggcauagggaagaugacccugggaaugugcugcauaaucacggccaguguucuccuaugguacgcacaaauacagccacacuggauagcagcuucaauaauacuggaguuuuuucucauagucuugcucauuccagaaccagaaaagcagagaacaccccaagauaaccaauuaacuuauguugucauagccauccuuacagugguggccgcaaccauggcaaacgagauggguuuccuggaaaagacaaagaaagacuucggauugggaagcauugcaacccagcaaccugagagcaacauccuggacauagaucuacguccugcaucagcuuggacucuauaugcuguggcaacaacuuucaucacaccaaugcugagacacagcauugaaaauuccucagugaaugugucucuaacggccauugccaaccaagccacaguuuuaaugggucuugggaaaggauggccauugucaaaaauggacaucggaguuccccuucucgcuaucgggugcuauucacaaguuaacccuauaacacucacagcagcucuucucuuauugguagcacauuacgcuaucauagggccaggacuccaagcaaaagcaaccagagaagcucagaaaagagcagcagcgggcaucaugaaaaauccaacuguugauggaauaacaguaauugacuuagauccaauacccuaugauccaaaguuugaaaaacaguugggacaaguaaugcuccuaguccucugugugacucaaguauugaugaugaggacuacaugggcucugugugaagcuuuaaccuuagcgacagggcccauuuccacauuaugggaaggaaauccagggagauuuuggaauacaacuauugcaguaucaauggcuaacauuuuuagagggagcuaccuggccggagcuggacuucucuuuuccaucaugaagaacacaaccaacacaagaaggggaacuggcaacauaggagagacgcuuggagaaaaauggaaaagccgguugaacgcauuggggaaaagugaauuccagaucuacaagaaaaguggaauccaggaaguggauagaacauuagcaaaagaaggcaucaaaagaggagaaacggaccaucacgcugugucacgaggcucagcaaaacugagaugguucgucgagagaaacauggucacaccagaagggaaaguaguggaccuugguugcggcagaggaggcuggucauacuauugugggggacuaaagaauguaagagaagucaaaggucugacaaagggaggaccagggcacgaagaacccauccccaugucuacauaugguuggaaccuggugcgucuucaaaguggaguugauguuuuuuuuacuccgccagaaaagugcgacacacugcugugugacauaggggagucgucaccaaaccccacgguugaggcaggacggacacucagaguccucaacuuaguggaaaauugguugaacaacaacacccaauuuugcauaaagguucucaacccauacaugcccucagucauagaaaaaauggaagcacuacaaaggaaauauggaggagcuuuggugaggaauccacucucacgaaauuccacacacgagauguacuggguauccaaugccuccgggaacauagugucaucagugaacaugauuucaagaauguugauuaacagauucacaaugagacauaagaaggccacauacgagccagauguugaccucggaagcggaacccguaacaucggaauugaaagugagauaccaaacuuggacauaauugggaaaagaauagaaaaaauaaaacaagagcaugaaacaucauggcacuaugaccaagaccacccauacaaaacgugggcuuaccaugguagcuaugaaacaaaacaaacuggaucagcaucauccauggugaacggaguggucagacugcugacaaaaccuugggacgucauccccauggugacacagauggcuaugacagacacgacuccauuugggcaacagcgcguuuuuaaagagaaaguggacacgagaacccaagaaccgaaagaaggcacaaagaaauuaaugaaaaucacggcagaauggcuuuggaaagaacuagggaagaaaaagacaccuaggauguguacuagagaagaauucacaagaaaggugagaagcaaugcagcccugggggccauauucacugaugagaacaaguggaagucggcacgugaggcuguugaagacaguagguuuugggagcugguugacaaggaaaggaaucuccaucuugaaggaaagugugaaacauguguguauaacaugaugggaaaaagagagaagaagcuaggggaguucggcaaggcaaagggcagcagagccauaugguauauguggcuuggagcacguuuuuuagaguuugaagcccuaggauucuugaaugaagaucacugguucuccagagagaacucccugaguggaguggaaggagaagggcugcacaagcuaggcuacaucuuaagagaagugagcaagaaagagggaggagcaauguaugccgaugacaccgcaggaugggacacaagaaucacacuggaagaucuaaaaaaugaagaaaugguaacaaaccacauggaaggagaacacaagaaacuagcugaggcuauuuucaaauuaacguaucaaaacaagguggugcgugugcaaagaccaacaccaagaggcacaguaauggauaucauaucgagaagagaccaaagagguagcggacaaguugguaccuacggccucaacacuuucacuaauauggaagcccaacuaaucagacagauggaaggagaaggagucuucaaaagcauucagcaccugacggccacagaagaaaacgccgugcaaaacuggcuagcaagaguagggcgcgaaagguuaucaagaauggccaucaguggagaugacuguguugugaaaccccuagaugacagauucgcaagugcuuuaacagcucuaaaugacaugggaaaggucaggaaagacauacaacaaugggaaccuucaagaggguggaaugauuggacacaggugcccuucuguucacaucauuuccaugaguuaaucaugaaagacggucgcguacuuguaguuccauguagaaaccaagaugaacugauugguagggcccgaauuucccagggagccggguggucuuugcgggaaacagccuguuuggggaagucuuaugcccaaauguggagcuugauguacuuccacagacgugaccucaggcuggcggcaaaugcuaucugcucggcggucccaucacauuggguuccaacaaguagaacaaccugguccauacaugccaaaaaugaauggaugacaacggaagacaugcugacagucuggaacaggguguggauucaagaaaauccauggauggaagacaagacuccaguggaaucaugggaggaaaucccauacuuggggaaaagagaagaccaauggugcgguucauugauugggcuaacaagcagggccaccugggcaaagaacauccaaacagcaauaaaucaaguuagaucccuuauaggcaaugaggaauacacagauuacaugccauccaugaaaagauucagaagagaagaggaagaggcaggagucuugugguag

SEQ ID NO: 6388 - RNA, 9876 nt, Artificial Sequence
  derived and/or modified CDS sequence (wt) from DENV-2__JX286516__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaguugugugaagauacaaucacguacaaguguccccuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugaaacauggaugucaucagaaggggccuggaagcauguucagagaauugaaaccuggaucuugagacauccagguuucaccauaauggcagcgauccuggcauacaccauaggaacgacacacuuccaaagggccuugauuuucaucuuacugacagcuguugcuccuucaaugacaaugcgcugcauaggaauaucaaauagagacuucguagaagggguuucaggaggaagcuggguugacaucguuuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaaaucguacagccagaaaauuuggaauacaccaucgugauaacaccucacucaggagaagagcacgcuguagguaaugacacaggaaagcauggaaaggaaaucaaaauaacaccacagaguuccaccacagaagcagaacugacaggcuauggcauugucacgauggagugcucuccgagaacgggccucgacuucaaugagauggugcugcugcagauggaagacaaagcuuggcuggugcacaggcaaugguuccuagaccugccguugccauggcuacccggagcggauacacaaggaucaaauuggauacagaaagagacauuggucacuuucaaaaauccccacgccaagaaacaggaugucguugucuuagggucucaagaaggggccaugcacacggcacucacaggggcuacagaaauccagaugucaucaggaaacuuacuguucacgggacaucucaagugcaggcugagaauggacaaacuacagcucaaaggaaugucauacucuauguguacaggaaaguuuaaaaucgugaaggaaauagcagaaacacaacauggaacaauaguuaucagaguacaauaugaaggggacggcucuccauguaagaucccuuuugagauaacagauuuggaaaaaagacacgucuuaggacgccugauuacaguuaacccaaucguaacagaaaaagauagcccagucaacauagaagcagaacccccauucggagacaguuacaucaucguaggaguagagccgggacaacugaaacucaauugguuuaagaagggaaguuccaucggccaaauguuugagacaacaaugagaggagcaaagagaauggccauuuuaggugacacagccugggauuuuggaucccugggaggaguguuuacaucuauaggaaaggcucuccaucaaguuuucggagcaaucuauggggcugcuuuuaguggggucucauggacuaugaaaauccucauaggagucaucaucacauggauaggaaugaauucacguagcaccucacugucugugucgcuaguauuggugggagucgugacacuguaccugggagcuauggugcaggcugauagugguugcauugugagcuggaaaaauaaagaacugaaauguggcagcgggaucuucauuacagauaacguacacacauggacagagcaauauaaguuccaaccagaauccccuucaaaacuagcuucagcuauccaaaaagcucaugaagaaggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgauccuugcggccucagcccacugagcugaaguacucauggaaaacauggggaaaggcgaaaaugcucucuacagagucucacaaucagaccuuucuuauugauggcccugaaacagcagaaugccccaacacaaacagagcuuggaacucacuggaaguugaagacuaugguuuuggaguuuuuaccaccaauauauggcuaaaauugagagaaaaacaggauguauuuugugacucaaaacucaugucagcggccauuaaagacaacagagccguccaugccgauauggguuauuggauagaaagugcacucaaugacacauggaagauggagaaagccuccuucauugaaguuaaaagcugccacuggccaaagucacacacccuauggagcaauggaguauuagaaagugagaugauaauuccaaaaaauuuugccgggccagugucacaacacaacuacagaccaggcuaccauacacaaacagcaggaccuuggcaucuagguaagcuugagauggacuuugauuucugcgaaggaacuacagugguggugacugaggacuguggaaauagaggacccucuuuaagaacgaccacugccucuggaaagcucauaacagaauggugcugccgauccugcacacuaccaccucuaagauacagaggugaggauggaugcugguacgggauggaaaucagaccuuugaaagagaaagaagagaacuuggucaacuccuuggucacagccggacaugggcagauugacaacuuuucacuaggagucuugggaauggcacuguuccuggaagaaaugcuuaggacccgaguaggaacgaaacaugcaauacugcuaguugcacuaucuuucgugacauugauuacugggaacaugucuuuuagagaccugggaagagugauggucauggugggcgcuaccaugacggaugacauagguaugggagugacuuaucuugcccuacuagcagcuuucaaaguuagaccaacuuuugcagcuggacuacucuugagaaaacugaccuccaaggaauugaugauggccaccauaggaaucgcacuccuuucccaaagcaccuugccagagaccauucuagaacugacugaugcguuagccuugggcaugauggcccucaaaauagugagaaauauggaaaaauaccaauuggcagugacuaucauggcuauuucgugugucccaaaugcagugauauugcaaaacgcauggaaggugaguugcacaauauuggcagcgguguccguuucuccacugcuccuaacauccucacagcagaaagcggauuggauaccacuggcacugacgauaaaaggucucaacccaacagcuauuuuucuaacaacucuuucgagaaccagcaagaaaaggagcuggccgcuaaaugaagcuaucauggcagucgggauggugagcauuuuagccaguucucuccuaaagaaugauauuccuaugacagguccauuaguggcuggagggcuccucaccguauguuacgugcucacuggacgaucggccgauuuggaacuggagagagcugccgauguaaaaugggaagaucaggcagaaauaucaggaagcagcccaauucugucaauaacaauaucagaagauggcagcaugucgauaaaaaaugaagaggaagaacaaacacugaccauacucauuaggacgggauuguuggugaucucaggagucuuuccaguaucgauaccaaucacggcagcagcaugguaccugugggaagugaagaaacaacgggcuggaguauugugggacgucccuucacccccaccagugggaaaagccgaacuggaagauggagccuauagaaucaagcaaagagggauucuuggauauucucagauuggagccggaguuuacaaagaaggaacauuccauacaauguggcacgucacacguggugcuguucugaugcauagagggaagaggauugaaccaucaugggcagaugucaagaaagaucuaauaucauauggaggaggcuggaagcuagaaggagaauggaaggaaggagaggaaguucaaguccuggcauuggaaccuggaaaaaaucccagagcuguccaaacgaaaccuggaauuuucaaaaccaacaccggaaccauaggcgcuguaucucuggacuuuuccccuggaacgucaggaucuccaauugucgacagaaaaggaaaaguugugggucuuuaugguaaugguguugucacaaggaguggagcauacguaagugccauagcccagaccgaaaaaagcauugaagacaauccagagaucgaagaugacauuuuccgaaagaaaagauugaccaucauggaccuccauccaggggcaggaaagacaaaaagauaccuuccagccauaguuagagaagccauaaaacguggcuugagaacauuaauccuggcucccacuagagucguggcagcugaaauggaggaagcucuuagaggacucccaauaagauaccaaaccccagccaucagagccgagcacaccgggcgagagaucguggaccuaaugugucaugccacauuuacuaugaggcugcuaucaccagucagagugccaaauuacaaccugauuaucauggacgaagcccacuucacagacccagcaagcauagcagcuagaggauacauuucaacucgaguagagaugggugaagcagccgggauuuuuaugacagccacuccuccgggaagcagagacccauuuccucagagcaaugcaccaaucauggaugaggaaagagaaaucccugagcguucauggaauucaggacaugaaugggucacggauuuuaaagggaagacuguuugguuuguuccaaguauaaaagcaggaaaugacauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagacccuagacgcugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucucgaaaaugaugaagacugugcacacuggaaagaagcuaaaaugcuccuagauaacaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauguggaaguggaaaucuggacaaaagaaggggaaaggaaaaaauuaaaacccagaugguuggaugcuaggaucuauucugauccacuggcacuaaaaggauucaaggaauuugcagcuggcagaaaaucuuugacccugaaccuaaucacagaaauggguaggcuuccaacuuuuaugacucagaaggcaagaaacgcacuggacaacuuggcugugcugcauacggcugagguagguggaaaggcguacacucaugcucucagugaacugccggagacucuggagacacugcuucuacugacacuccuggcagcagucacaggaggaaucuucuuauucuuaaugagcggaaaagguauagggaagaugacucugggaauguguugcauaaucacagcuagcauucuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauuuggaagcauuacaacccaggaaucugagagcaacauccuggacauagaucuacguccugcaucagcauggacgcuguaugccguggcuacaacauuugucacaccaauguugcgacauagcauugaaaauuccucaguaaaugucucccuaacagccauugcuaaccaagcuacagugcuaaugggucuugggaaaggauggccauugucaaagauggacaucggaguuccccuccuugccauuggaugcuacucacaagucaacccuauaacccucacagcagcucuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagauuuuggaacaccaccauugcagugucaauggcuaacaucuuuagggggagcuacuuggccggagcuggacuucucuuuuccaucaugaagaacacaacaaacacaagaagaggaacuggcaacguaggagagacacuuggagaaaaauggaaaagccgauuaaaugcacugggaaaaagugaauuucagaucuacaagaaaaguggaauccaggaaguggauagaacccuagcaaaagaaggcaucaaaagaggagaaacggaccaccaugcugugucacgaggaucagcaaaacugagaugguucgucgagagaaacauggucacaccggaagggaaggugguggaucuugguugcggcagagggggcuggucauacuauugugggggacuaaagaauguaagagaagucaaaggccuaacaaaaggaggaccaggacacgaagaacccauccccaugucaacauauggguggaaucuagugcgucugcaaaguggggucgacguuuucuucaccccgccagaaaagugugauacauuguugugugacauaggggagucgucaccaaaucccacgauagaagcaggacgaacacucagaguccucaacuuaguggaaaauuggcugaacaauaacacccaauuuugcauaaagguccucaauccauauaugcccucagucauagaaaaaauggaaacacuacaaaggaaauauggaggagccuuagugaggaauccacucucacgaaacuccacgcaugaaauguacuggguaucuaaugcuaccgggaacauagugucaucagugaacaugauuucaaggauguugauuaacagauucacaaugaaacauaagaaagccaccuacgagccagauguugaccuaggaaguggaacccgcaacauuggaauugaaagugagauaccaaaucuagacauaauaggaaagagaauagagaaaauaaaacaagagcaugaaacaucauggcauuaugaccaagaccacccauacaaaacgugggcuuaccauggcagcuaugaaacaaaacaaacuggaucagcaucaucuauggugaacggaguggucagacugcugacaaaaccuugggacgucguuccuauggugacacagauggcaaugacagacacgacuccauuuggacaacagcgcguuuucaaagagaaaguggacacgagaacucaagaaccgaaggaaggcacaaagaaacugaugaaaauuacggcagaguggcuuuggaaagaacuaggaaaggaaaagacaccuagaauguguaccagagaagaauucacaagaaaagugagaagcaaugcagccuugggggccguauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuucugaaugaagaucacugguucuccagagggaacucccugaguggaguggaaggagaagggcugcacaggcuaggcuacauuuuaagagaggugggcaagaaggaaggaggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaaaagaccaaagaggcagugggcaagucgguaccuauggccuuaauacuuucaccaauauggaagcccaauuaauuagacagauggaaggagaaggaaucuucaaaagcauucagcaccugaccgccacagaagaaaucgcuguacagaacugguuagcaagaguggggcgugaaaggcuaucaagaauggccaucaguggagaugacuguguuguaaaaccuauagaugacagauuugcaagugcuuuaacagcucuaaaugacaugggaaaaguuaggaaagauauacagcaaugggaaccuucaagaggauggaacgauuggacacaggugccuuucuguucacaccauuuucaugaguuagucaugaaagauggucgcgugcucguagucccaugcagaaaccaagaugaacugauuggcagagcccgaauuucccagggagccggguggucuuugaaggagacggcuuguuuggggaagucuuacgcccaaauguggacccugauguacuuccacagacgugaccucagauuggcggcaaaugccauuugcucggcagucccgucacauuggguuccaacaagucgaacaaccugguccauacacgccaagcaugaauggaugacgacggaagacaugcuggcagucuggaacaggguguggauccaagaaaacccauggauggaagacaaaacuccaguggaaucaugggaagaagucccauaccuggggaaaagggaagaccaauggugcggcucauugauugggcuaacaagcagggcuaccugggcaaagaauauccagacagcaauaaaucaagucagaucccuuauaggcaaugagggauacacagacuacaugccauccaugaagagauucagaagggaagaggaagaggcagguguccugugguag

SEQ ID NO: 6389 - RNA, 9876 nt, Artificial Sequence
  derived and/or modified CDS sequence (wt) from DENV-2__JX286518__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaguugugugaagauacaaucacguacaaguguccccuccuuagacaaaaugaaccagaagacauagauuguuggugcaacucuacauccacauggguaacuuaugggacauguaccaccacaggagaacacagaagagaaaaaagaucaguggcgcucguuccacauguggguaugggacuggagacacgaacugaaacauggaugucaucagaaggggccuggaagcauguucagagaauugaaaccuggaucuugagacauccagguuuuaccauaauggcagcgauccuggcauacaccauaggaacgacacacuuccaaagggccuugauuuucaucuuacugacagcuguugcuccuucaaugacaaugcgcugcauaggaauaucaaauagagacuucguagaagggguuucaggaggaagcuggguugacaucguuuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaaaucguacagccagaaaauuuggaauacaccaucgugauaacaccucacucaggagaagagcacgcuguagguaaugacacaggaaagcauggaaaggaaaucaaaauaacaccacagaguuccaccacagaagcagaacugacaggcuauggcacugucacgauggagugcucuccgagaacgggccucgacuucaaugagauggugcugcugcagauggaagacaaagcuuggcuggugcacaggcaaugguuccuagaccugccguugccauggcuacccggagcggauacacaaggaucaaauuggauacagaaagagacauuggucacuuucaaaaauccccacgccaagaaacaggaugucguugucuuagggucucaagaaggggccaugcacacggcacucacaggggcuacagaaauccagaugucaucaggaaacuuacuguucacgggacaucucaagugcaggcugagaauggacaaacuacagcucaaaggaaugucauacucuauguguacaggaaaguuuaaaaucgugaaggaaauagcagaaacacaacauggaacaauaguuaucagaguacaauaugaaggggacgguucuccauguaagaucccuuuugagauaacagauuuggaaaaaagacacgucuuaggacgccugauuacaguuaacccaaucguaacagaaaaagauagcccagucaacauagaagcagaacccccauucggagacaguuacaucaucguaggaguagagccgggacaacugaaacucaauugguuuaagaagggaaguuccaucggccaaauguuugagacaacaaugagaggagcaaagagaauggccauuuuaggugacacagccugggauuuuggaucccugggaggaguguuuacaucuauaggaaaggcucuccaucaaguuuucggagcaauuuauggggcugcuuuuaguggggucucauggacuaugaaaauccucauaggagucaucaucacauggauaggaaugaauucacguagcaccucacugucugugucgcuaguauuggugggagucgugacacuguaccugggagcuauggugcaggcugauagugguugcauugugagcuggaaaaauaaagaacugaaauguggcagcgggaucuucauuacagauaacguacacacauggacagagcaauauaaguuccaaccagaauccccuucaaaacuagcuucagcuauccaaaaagcucaugaagaaggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgauccuugcggccucagcccacugagcugaaguacucauggaaaacauggggaaaggcgaaaaugcucucuacagagucucauaaucagaccuuucuuauugauggcccugaaacagcagaaugccccaacacaaacagagcuuggaacucacuggaaguugaagacuaugguuuuggaguuuuuaccaccaauauauggcuaaaauugagagaaaaacaggauguguuuugugacucaaaacucaugucagcggccauuaaagacaacagagccguccaugccgauauggguuauuggauagaaagugcacucaaugacacauggaagauggagaaagccuccuucauugaaguuaaaagcugccacuggccaaagucacacacccuauggagcaauggaguauuagaaagugagaugauaauuccaaaaaauuuugccgggccagugucacaacacaacuacagaccaggcuaccauacacaaacagcaggaccuuggcaucuagguaagcuugagauggacuuugauuucugcgaaggaacuacagugguggugacugaggacuguggaaauagaggacccucuuuaagaacgaccacugccucuggaaagcucauaacagaauggugcugccgauccugcacacuaccaccucuaagauacagaggugaggauggaugcugguaugggauggaaaucagaccuuugaaagagaaagaagagaacuuggucaacuccuuggucacagccggacaugggcagauugacaacuuuucacuaggagucuugggaauggcacuguuccuggaagaaaugcuuaggacccgaguaggaacgaaacaugcaauacugcuaguugcacuaucuuucgugacauugauuacugggaacaugucuuuuagagaccugggaagagugauggucauggugggcgcuaccaugacggaugacauagguaugggagugacuuaucuugcccuacuagcagcuuucaaaguuagaccaacuuuugcagcuggacuacucuugagaaaacugaccuccaaggaauugaugauggccaccauaggaaucgcacuccuuucccaaagcaccuugccagagaccauucuagaacugacugaugcguuagccuugggcaugauggcccucaaaauagugagaaauauggaaaaauaccaauuggcagugacuaucauggcuauuucgugugucccaaaugcagugauauugcaaaacgcauggaaggugaguugcacaauauuggcagcgguguccguuucuccacugcuccuaacauccucacagcagaaagcggauuggauaccacuggcacugacgauaaaaggucucaacccaacagccauuuuucuaacaacucuuucgagaaccagcaagaaaaggagcuggccgcuaaaugaagcuaucauggcagucgggauggugagcauuuuagccaguucucuccuaaagaaugauauuccuaugacagguccauuaguggcuggagggcuccucaccguauguuacgugcucacuggacgaucggccgauuuggaacuggagagagcugccgauguaaaaugggaagaucaggcagaaauaucaggaagcagcccaauucugucaauaacaauaucagaagauggcagcaugucgauaaaaaaugaagaggaagaacaaacacugaccauacucauuagaacgggauuguuggugaucucaggagucuuuccaguaucgauaccaauuacggcagcagcaugguaccugugggaagugaagaaacaacgggcuggaguauugugggacgucccuucacccccaccagugggaaaagccgaacuggaagauggagccuauagaaucaagcaaagagggauucuuggauauucucagauuggagccggaguuuacaaagaaggaacauuccauacaauguggcacgucacacguggugcuguucugaugcauagagggaagaggauugaaccaucaugggcagaugucaagaaagaucuaauaucauauggaggaggcuggaagcuagaaggagaauggaaggaaggagaggaaguucaaguccuggcauuggaaccuggaaaaaaucccagagcuguccaaacgaaaccuggaauuuucaaaaccaacaccggaaccauaggcgcuguaucucuggacuuuuccccuggaacgucaggaucuccaauugucgacagaaaaggaaaaguugugggucuuuaugguaaugguguugucacaaggaguggagcauacguaagugccauagcccagaccgaaaaaagcauugaagacaauccagagaucgaagaugacauuuuccgaaagaaaagauugaccaucauggaccuccauccaggggcaggaaagacaaaaagauaccuuccagccauaguuagagaagccauaaaacguggcuugagaacauuaaucuuggcucccacuagagucguggcagcugaaauggaggaagcucuuagaggacucccaauaagauaccaaaccccagccaucagagccgagcacaccgggcgagagaucguggaccuaaugugucaugccacauuuacuaugaggcugcuaucaccagucagagugccaaauuacaaccugauuaucauggacgaagcccacuucacagacccagcaagcauagcagcuagaggauacauuucaacucgaguagagaugggugaagcagccgggauuuuuaugacagccacuccuccgggaagcagagacccauuuccucagagcaaugcaccaaucauggaugaggaaagagaaaucccugagcguucauggaauucaggacaugaaugggucacggauuuuaaagggaagacuguuugguuuguuccaaguauaaaagcaggaaaugacauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagacccuagacgcugcaugaaaccaguuauacuaacagauggcgaagagcgggugaucuuggcaggaccuaugccagugacccacucuagugcagcgcagagaagagggagaauaggaagaaauccaaaaaaugaaaaugaccaguacauauacaugggggaaccucucgaaaaugaugaagacugugcacacuggaaagaagcuaaaaugcuccuagauaacaucaacacacccgaaggaauuauuccuaguauguucgaaccagagcgugaaaaaguggaugccauugauggugaauaccguuugagaggagaagcaaggaaaaccuuuguggaccuaaugagaagaggggacuuaccagucugguuggccuacagaguggcagcugaaggcaucaacuacgcagacagaaagugguguuuugacggaauuaagaacaaccaaauacuggaagaaaauguggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagaaacgcacuggacaacuuggcugugcugcauacggcugagguagguggaaaggcguacacucacgcucucagugaacucccggagacucuggagacacugcuucuacugacacuccuggcagcagucacaggaggaaucuucuuauucuuaaugagcggaaaagguauagggaagaugacucugggaauguguugcauaaucacagcuagcauucuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauuuggaagcauuacaacccaggaaucugagagcaacauccuggacauagaucuacguccugcaucagcauggacgcuguaugccguggcuacaacauuugucacaccaauguugcgacauagcauugaaaauuccucaguaaaugucucccuaacagccauugcuaaccaagcuacagugcuaaugggucuugggaaaggauggccauugucaaagauggacaucggaguuccccuccuugccauuggaugcuacucacaagucaacccuauaacccucacagcagcucuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaacaccaccauugcagugucaauggcuaacaucuuuagggggagcuacuuggccggagcuggacuucucuuuuccaucaugaagaacacaacaaacacaagaagaggaacuggcaacguaggagagacacuuggagagaaauggaaaagccgauuaaaugcacugggaaaaagugaauuucagaucuacaagaaaaguggaauccaggaaguggauagaacucuagcaaaagaaggcaucaaaagaggagaaacggaccaccaugcugugucacgaggaucagcaaaacugagaugguucgucgagagaaacauggucacaccggaagggaaggugguggaucuugguugcggcagagggggcuggucauacuauugugggggauuaaagaauguaagagaagucaaaggccuaacaaaaggaggaccaggacacgaagaacccauccccaugucaacauauggguggaaucuagugcgucugcaaaguggggucgacguuuucuucaccccgccagaaaagugugauacauuguugugugacauaggggagucgucaccaaaucccacgauagaagcaggacgaacacucagaguccucaacuuaguggaaaauuggcugaacaauaacacccaauuuugcauaaagguccucaauccauauaugcccucagucauagaaaaaauggaaacacuacaaaggaaauauggaggagccuuagugaggaauccacucucacgaaacuccacgcaugaaauguacuggguaucuaaugcuaccgggaacauagugucaucagugaacaugauuucaaggauguugauuaacagauucacaaugaaacauaagaaagccaccuacgagccagauguugaccuaggaaguggaacccgcaacauuggaauugaaagugagauaccaaaucuagacauaauaggaaagagaauagagaaaauaaaacaagagcaugaaacaucauggcauuaugaccaagaccacccauacaaaacgugggcuuaccauggcagcuaugaaacaaaacaaacuggaucagcaucaucuauggugaacggaguggucagacugcugacaaaaccuugggacgucguuccuauggugacacagauggcaaugacagacacgacuccauuuggacaacagcgcguuuucaaagagaaaguggacacgagaacucaagaaccgaaggaaggcacaaagaaacugaugaaaauuacggcugaguggcuuuggaaagaacuaggaaaggaaaagacaccuagaauguguaccagagaagaauucacaagaaaagugagaagcaaugcagccuugggggccguauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuuuuuagaguuugaagcccuaggauuucugaaugaagaucacugguucuccagagggaacucccugaguggaguggaaggagaagggcugcacaggcuaggcuacauuuuaagagaggugggcaagaaggaaggaggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaaaagaccaaagaggcagugggcaagucgguaccuauggccuuaacacuuucaccaauauggaagcccaauuaauuagacagauggaaggagaaggaaucuucaaaagcauucagcaccugaccgccacagaagaaaucgcuguacagaacugguuagcaagaguggggcgugaaaggcuaucaagaauggccaucaguggagaugacuguguuguaaaaccuauagaugacagauuugcaagugcuuuaacagcucuaaaugacaugggaaaaguuaggaaagauauacaacaaugggaaccuucaagaggauggaacgauuggacacaggugccuuucuguucacaccauuuucaugaguuagucaugaaagauggucgcgugcucguagucccaugcagaaaccaagaugaacugauuggcagagcccgaauuucccagggagccggguggucuuugaaggagacggcuuguuuggggaagucuuacgcccaaauguggacccugauguacuuccacagacgugaccucagauuggcggcaaaugccauuugcucggcagucccgucacauuggguuccaacaagucgaacaaccugguccauacacgccaagcaugaauggaugacgacggaagacaugcuggcagucuggaacaggguguggauccaagaaaacccauggauggaagacaaaacuccaguggaaucaugggaagaagucccauaccuggggaaaagggaagaccaauggugcggcucauugauugggcuaacaagcagggcuaccugggcaaagaauauccagacagcaauaaaucaagucagaucccuuauaggcaaugagggauacacagacuacaugccauccaugaagagauucagaagggaagaggaagaggcagguguccugugguag

SEQ ID NO: 6390 - RNA, 9876 nt, Artificial Sequence
  derived and/or modified CDS sequence (wt) from DENV-2__JX286519__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguauuaacauguguacccucauggccauagaccuuggugaguugugugaagauacaaucacguacaaguguccccuccucagacaaaaugaaccagaagacauagauuguuggugcaacucuacauccacauggguaacuuaugggacauguaccaccacaggagaacacagaagagaaaaaagaucaguggcgcucguuccacauguggguaugggacuggagacacgaacugaaacauggaugucaucagaaggggccuggaagcauguucagagaauugaaaccuggaucuugagacauccagguuuuaccauaauggcagcgauccuggcauacaccauaggaacgacacacuuccaaagggccuugauuuucaucuuacugacagcuguugcuccuucaaugacaaugcgcugcauaggaauaucaaauagagacuucguagaagggguuucaggaggaagcuggguugacaucguuuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaaaucguacagccagaaaauuuagaauacaccaucgugauaacaccucacucaggagaagagcacgcuguagguaaugacacaggaaagcauggaaaggaaaucaaaauaacaccacagaguuccaccacagaagcagaacugacaggcuauggcacugucacgauggagugcucuccgagaacgggccucgacuucaaugagauggugcugcugcagauggaagacaaagcuuggcuggugcacaggcaaugguuccuagaccugccguugccauggcuacccggagcggauacacaaggaucaaauuggauacagaaagagacauuggucacuuucaaaaauccccacgccaagaaacaggaugucguugucuuagggucucaagaaggggccaugcacacggcacucacaggggcuacagaaauccagaugucaucaggaaacuuacuguucacgggacaucucaagugcaggcugagaauggacaaacuacagcucaaaggaaugucauacucuauguguacaggaaaguuuaaaaucgugaaggaaauagcagaaacacaacauggaacaauaguuaucagaguacaauaugaaggggacgguucuccauguaagaucccuuuugagauaacagauuuggaaaaaagacacgucuuaggacgccugauuacaguuaacccaaucguaacagaaaaagauagcccagucaacauagaagcagaacccccauucggagacaguuacaucaucguaggaguagagccgggacaacugaaacucaauugguuuaagaagggaaguuccaucggccaaauguuugagacaacaaugagaggagcaaagagaauggccauuuuaggugacacagccugggauuuuggaucccugggaggaguguuuacaucuauaggaaaggcucuccaucaaguuuucggagcaauuuauggggcugcuuuuaguggggucucauggacuaugaaaauccucauaggagucaucaucacauggauaggaaugaauucacguagcaccucacugucugugucgcuaguauuggugggagucgugacacuguaccugggagcuauggugcaggcugauagugguugcauugugagcuggaaaaauaaagaacugaaauguggcagcgggaucuucauuacagauaacguacacacauggacagagcaauauaaguuccaaccagaauccccuucaaaacuagcuucagcuauccaaaaagcucaugaagaaggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgauccuugcggccucagcccacugagcugaaguacucauggaaaacauggggaaaggcgaaaaugcucucuacagagucucauaaucagaccuuucuuauugauggcccugaaacagcagaaugccccaacacaaacagagcuuggaacucacuggaaguugaagacuaugguuuuggaguuuuuaccaccaauauauggcuaaaauugagagaaaaacaggauguguuuugugacucaaaacucaugucagcggccauuaaagacaacagagccguccaugccgauauggguuauuggauagaaagugcacucaaugacacauggaagauggagaaagccuccuucauugaaguuaaaagcugccacuggccaaagucacacacccuauggagcaauggaguauuagaaagugagaugauaauuccaaaaaauuuugccgggccagugucacaacacaacuacagaccaggcuaccauacacaaacagcaggaccuuggcaucuagguaagcuugagauggacuuugauuucugcgaaggaacuacagugguggugacugaggacuguggaaauagaggacccucuuuaagaacgaccacugccucuggaaagcucauaacagaauggugcugccgauccugcacacuaccaccucuaagauacagaggugaggauggaugcugguaugggauggaaaucagaccuuugaaagagaaagaagagaacuuggucaacuccuuggucacagccggacaugggcagauugacaacuuuucacuaggagucuugggaauggcacuguuccuggaagaaaugcuuaggacccgaguaggaacgaaacaugcaauacugcuaguugcacuaucuuucgugacauugauuacugggaacaugucuuuuagagaccugggaagagugauggucauggugggcgcuaccaugacggaugacauagguaugggagugacuuaucuugcccuacuagcagcuuucaaaguuagaccaacuuuugcagcuggacuacucuugagaaaacugaccuccaaggaauugaugauggccaccauaggaaucgcacuccuuucccaaagcaccuugccagagaccauucuagaacugacugaugcguuagccuugggcaugauggcccucaaaauagugagaaauauggaaaaauaccaauuggcagugacuaucauggcuauuucgugugucccaaaugcagugauauugcaaaacgcauggaaggugaguugcacaauauuggcagcgguguccguuucuccacugcuccuaacauccucacagcagaaagcggauuggauaccacuggcacugacgauaaaaggucucaacccaacagccauuuuucuaacaacucuuucgagaaccagcaagaaaaggagcuggccgcuaaaugaagcuaucauggcagucgggauggugagcauuuuagccaguucucuccuaaagaaugauauuccuaugacagguccauuaguggcuggagggcuccucaccguauguuacgugcucacuggacgaucggccgauuuggaacuggagagagcugccgauguaaaaugggaagaucaggcagaaauaucaggaagcagcccaauucugucaauaacaauaucagaagauggcagcaugucgauaaaaaaugaagaggaagaacaaacacugaccauacucauuagaacgggauuguuggugaucucaggagucuuuccaguaucgauaccaauuacggcagcagcaugguaccugugggaagugaagaaacaacgggcuggaguauugugggacgucccuucacccccaccagugggaaaagccgaacuggaagauggagccuauagaaucaagcaaagagggauucuuggauauucucagauuggagccggaguuuacaaagaaggaacauuccauacaauguggcacgucacacguggugcuguucugaugcauagagggaagaggauugaaccaucaugggcagaugucaagaaagaucuaauaucauauggaggaggcuggaagcuagaaggagaauggaaggaaggagaggaaguucaaguccuggcauuggaaccuggaaaaaaucccagagcuguccaaacgaaaccuggaauuuucaaaaccaacaccggaaccauaggcgcuguaucucuggacuuuuccccuggaacgucaggaucuccaauugucgacagaaaaggaaaaguugugggucuuuaugguaaugguguugucacaaggaguggagcauacguaagugccauagcccagaccgaaaaaagcauugaagacaauccagagaucgaagaugacauuuuccgaaagaaaagauugaccaucauggaccuccauccaggggcaggaaagacaaaaagauaccuuccagccauaguuagagaagccauaaaacguggcuugagaacauuaaucuuggcucccacuagagucguggcagcugaaauggaggaagcucuuagaggacucccaauaagauaccaaaccccagccaucagagccgagcacaccgggcgagagaucguggaccuaaugugucaugccacauuuacuaugaggcugcuaucaccagucagagugccaaauuacaaccugauuaucauggacgaagcccacuucacagacccagcaagcauagcagcuagaggauacauuucaacucgaguagagaugggugaagcagccgggauuuuuaugacagccacuccuccgggaagcagagacccauuuccucagagcaaugcaccaaucauggaugaggaaagagaaaucccugagcguucauggaauucaggacaugaaugggucacggauuuuaaagggaagacuguuugguuuguuccaaguauaaaagcaggaaaugacauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagacccuagacgcugcaugaaaccaguuauacuaacagauggcgaagagcgggugaucuuggcaggaccuaugccagugacccacucuagugcagcgcagagaagagggagaauaggaagaaauccaaaaaaugaaaaugaccaguacauauacaugggggaaccucucgaaaaugaugaagacugugcacacuggaaagaagcuaaaaugcuccuagauaacaucaacacacccgaaggaauuguuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugacggaauuaagaacaaccaaauacuggaagaaaauguggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagaagcgcacuggacaacuuggcugugcugcauacggcugagguagguggaaaggcguacacucacgcucucagugaacucccggagacucuggagacacugcuucuacugacacuccuggcagcagucacaggaggaaucuucuuauucuuaaugagcggaaaagguauagggaagaugacucugggaauguguugcauaaucacagcuagcauucuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauuuggaagcauuacaacccaggaaucugagagcaacauccuggacauagaucuacguccugcaucagcauggacgcuguaugccguggcuacaacauuugucacaccaauguugcgacauagcauugaaaauuccucaguaaaugucucccuaacagccauugcuaaccaagcuacagugcuaaugggucuugggaaaggauggccauugucaaagauggacaucggaguuccccuccuugccauuggaugcuacucacaagucaacccuauaacccucacagcagcucuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaacaccaccauugcagugucaauggcuaacaucuuuagggggagcuacuuggccggagcuggacuucucuuuuccaucaugaagaacacaacaaacacaagaagaggaacuggcaacguaggagagacacuuggagaaaaauggaaaagccgauuaaaugcacugggaaaaagugaauuucagaucuacaagaaaaguggaauccaggaaguggauagaacucuagcaaaagaaggcaucaaaagaggagaaacggaccaccaugcugugucacgaggaucagcaaaacugagaugguucgucgagagaaacauggucacaccggaagggaaggugguggaucuugguugcggcagagggggcuggucauacuauugugggggauuaaagaaugugagagaagucaaaggccuaacaaaaggaggaccaggacacgaagaacccauccccaugucaacauauggguggaaucuagugcgucugcaaaguggggucgacguuuucuucaccccgccagaaaagugugauacauuguuaugugacauaggggagucgucaccaaaucccacgauagaagcaggacgaacacucagaguccucaacuuaguggaaaauuggcugaacaauaacacccaauuuugcauaaagguccucaauccauauaugcccucagucauagaaaaaauggaaacacuacaaaggaaauauggaggagccuuagugaggaauccacucucacgaaacuccacgcaugaaauguacuggguaucuaaugcuaccgggaacauagugucaucagugaacaugauuucaaggauguugauuaacagauucacaaugaaacauaagaaagccaccuacgagccagauguugaccuaggaaguggaacccgcaacauuggaauugaaagugagauaccaaaucuagacauaauaggaaagagaauagagaaaauaaaacaagagcaugaaacaucauggcauuaugaccaagaccacccauacaaaacgugggcuuaccauggcagcuaugaaacaaaacaaacuggaucagcaucaucuauggugaacggaguggucagacugcugacaaaaccuugggacgucguuccuauggugacacagauggcaaugacagacacgacuccauuuggacaacagcgcguuuucaaagagaaaguggacacgagaacucaagaaccgaaggaaggcacaaagaaacugaugaaaauuacggcugaguggcuuuggaaagaacuaggaaaggaaaagacaccuagaauguguaccagagaagaauucacaagaaaagugagaagcaaugcagccuugggggccguauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuuuuuagaguuugaagcccuaggauuucugaaugaagaucacugguucuccagagggaacucccugaguggaguggaaggagaagggcugcacaggcuaggcuacauuuuaagagaggugggcaagaaggaaggaggagcaauguacgccgaugauacagcaggaugggacacaagaaucacacuagaagacuuaaaaaaugaagaaaugguaacaaaccacaugaaaggagaacacaagaaacuagccgaggccauauucaaguuaacguaccaaaacaagguggugcgugugcaaagaccaacaccaagaggcacaguaauggauaucauaucgagaaaagaccaaagaggcagugggcaagucgguaccuauggccuuaacacuuucaccaauauggaagcccaauuaauuagacagauggaaggagaaggaaucuucaaaagcauucagcaccugaccgccacagaagaaaucgcuguacagaacugguuagcaagaguggggcgugaaaggcuaucaagaauggccaucaguggagaugacuguguuguaaaaccuauagaugacagauuugcaagugcuuuaacagcucuaaaugacaugggaaaaguuaggaaagauauacaacaaugggaaccuucaagaggauggaacgauuggacacaggugccuuucuguucacaccauuuucaugaguuagucaugaaagauggucgcgugcucguagucccaugcagaaaccaagaugaacugauuggcagagcccgaauuucccagggagccggguggucuuugaaggagacggcuuguuuggggaagucuuacgcccaaauguggacccugauguacuuccacagacgugaccucagauuggcggcaaaugccauuugcucggcagucccgucacauuggguuccaacaagucgaacaaccugguccauacacgccaagcaugaauggaugacgacggaagacaugcuggcagucuggaacaggguguggauccaagaaaacccauggauggaagacaaaacuccaguggaaucaugggaagaagucccauaccuggggaaaagggaagaccaauggugcggcucauugauugggcuaacaagcagggcuaccugggcaaagaauauccagacagcaauaaaucaagucagaucccuuauaggcaaugagggauacacagacuacaugccauccaugaagagauucagaagggaagaggaagaggcagguguccugugguag

SEQ ID NO: 6391 - RNA, 9876 nt, Artificial Sequence
  derived and/or modified CDS sequence (wt) from DENV-2__KP188549__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaguugugugaagauacaaucacguacaaguguccccuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugaaacauggaugucaucagaaggggccuggaagcauguucagagaauugaaaccuggaucuugagacauccagguuuuaccauaauggcagcgauccuggcauacaccauaggaacgacacacuuccaaagggccuugauuuucaucuuacugacagcuguugcuccuucaaugacaaugcgcugcauaggaauaucaaauagagacuucguagaagggguuucaggaggaagcuggguugacaucguuuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaaugaagagcaggacaaaagguucaucugcaaacacuccaugguagacagaggauggggaaauggauguggauuauuuggaaagggaggcauugugaccugugcuauguuuacauguaaaaagaacauggaaggaaaaaucguacagccagaaaauuuggaauacaccaucgugauaacaccucacucaggagaagagcacgcuguagguaaugacacaggaaagcauggaaaggaaaucaaaauaacaccacagaguuccaccacagaagcagaacugacaggcuauggcacugucacgauggagugcucuccgagaacgggccucgacuucaaugagauggugcugcugcagauggaagacaaagcuuggcuggugcacaggcaaugguuccuagaccugccguugccauggcuacccggagcggauacacaaggaucaaauuggauacagaaagagacauuggucacuuucaaaaauccccacgccaagaaacaggaugucguugucuuagggucucaagaaggggccaugcacacggcacucacaggggcuacagaaauccagaugucaucaggaaacuuacuguucacgggacaucucaagugcaggcugagaauggacaaacuacagcucaaaggaaugucauacucuauguguacaggaaaguuuaaaaucgugaaggaaauagcagaaacacaacauggaacaauaguuaucagaguacaauaugaaggggacgguucuccaugcaagaucccuuuugagauaacagauuuggaaaaaagacacgucuuaggacgccugauuacaguuaacccaaucguaacagaaaaagauagcccagucaacauagaagcagaacccccauucggagacaguuacaucaucguaggaguagagccgggacaacugaaacucaauugguuuaagaagggaaguuccaucggccaaauguuugagacaacaaugagaggagcaaagagaauggccauuuuaggugacacagccugggauuuuggaucccugggaggaguguuuacaucuauaggaaaggcucuccaucaaguuuucggagcaaucuauggggcugcuuuuaguggggucucauggacuaugaaaauccucauaggagucaucaucacauggauaggaaugaauucacguagcaccucacugucugugucgcuaguauuggugggagucgugacacuguaccugggagcuauggugcaggcugauagugguugcauugugagcuggaaaaauaaagaacugaaauguggcagcgggaucuucauuacagauaacguacacacauggacagagcaauauaaguuccaaccagaauccccuucaaaacuagcuucagcuauccaaaaagcucaugaagaaggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgauccuugcggccucagcccacugagcugaaguacucauggaaaacauggggaaaggcgaaaaugcucucuacagagucucacaaucagaccuuucuuauugauggcccugaaacagcagaaugccccaacacaaacagagcuuggaacucacuggaaguugaagacuaugguuuuggaguuuuuaccaccaauauauggcuaaaauugagagaaaaacaggauguauuuugugacucaaaacucaugucagcggccauuaaagacaacagagccguccaugccgauauggguuauuggauagaaagugcacucaaugacacauggaagauggagaaagccuccuucauugaaguuaaaagcugccacuggccaaagucacacacccuauggagcaauggaguauuagaaagugagaugguaauuccaaaaaauuuugccgggccagugucacaacacaacuacagaccaggcuaccauacacaaacagcaggaccuuggcaucuagguaagcuugagauggacuuugauuucugcgaaggaacuacagugguggugacugaggacugugaaaaaagaggacccucuuuaagaacgaccacugccucuggaaagcucauaacagaauggugcugccgauccugcacacuaccaccucuaagauacagaggugaggauggaugcugguacgggauggaaaucagaccuuugaaagagaaagaagagaacuuggucaacuccuuggucacagccggacaugggcagauugacaacuuuucacuaggagucuugggaauggcacuguuccuggaagaaaugcuuaggacccgaguaggaacgaaacaugcaauacugcuaguugcacuaucuuucgugacauugauuacugggaacaugucuuuuagagaccugggaagagugauggucauggugggcgcuaccaugacggaugacauagguaugggagugacuuaucuugcccuacuagcagcuuucaaaguuagaccaacuuuugcagcuggacuacucuugagaaaacugaccuccaaggaauugaugauggccaccauaggaaucgcacuccuuucccaaagcaccuugccagagaccauucuagaacugacugacgcguuagccuuggguaugauggcccucaaaauagugagaaauauggaaaaauaccaauuggcagugacuaucauggcuauuucgugugucccaaaugcagugauauugcaaaacgcauggaaggugaguugcacaauauuggcagcgguguccguuucuccacugcuccuaacauccucacagcagaaagcggauuggauaccacuggcacugacgauaaaaggucucaacccaacagccauuuuucuaacaacucuuucgagaaccagcaagaaaaggagcuggccgcuaaaugaagcuaucauggcagucgggauggugagcauuuuagccaguucucuccuaaagaaugauauuccuaugacagguccauuaguggcuggagggcuccucaccguauguuacgugcucacuggacgaucggccgauuuggaacuggagagagcugccgauguaaaaugggaagaucaggcagaaauaucaggaagcagcccaauucugucgauaacaauaucagaagauggcagcaugucgauaaaaaaugaagaggaagaacaaacacugaccauacucauuagaacgggauuguuggugaucucaggagucuuuccaguaucgauaccaauuacggcagcagcaugguaccugugggaagugaagaaacaacgggcuggaguauugugggacgucccuucacccccaccagugggaaaagccgaacuggaagauggagccuauagaaucaagcaaagagggauucuuggauauucucagaucggagccggaguuuacaaagaaggaacauuccauacaauguggcacgucacacguggugcuguucugaugcauagagggaagaggauugaaccaucaugggcagacgucaagaaagaucuaauaucauauggaggaggcuggaagcuagaaggagaauggaaggaaggagaggaaguucaaguccuggcauuggaaccuggaaaaaaucccagagcuguccaaacgaaaccuggaauuuucaaaaccaacaccggaaccauaggcgcuguaucucuggacuuuuccccuggaacgucaggaucuccaauugucgacagaaaaggaaaaguugugggucuuuaugguaaugguguugucacaaggaguggagcauacguaagugccauagcccagacagaaaaaagcauugaagacaauccagagaucgaagaugacauuuuccgaaagaaaagauugaccaucauggaccuccauccaggggcaggaaagacaaaaagauaccuuccagccauaguuagagaagccauaaaacguggcuugagaacauuaauccuggcucccacuagagucguggcagcugaaauggaggaagcucuuagaggacucccaauaagauaccaaaccccagccaucagagccgagcacaccgggcgagagaucguggaccuaaugugucaugccacauuuacuaugaggcugcuaucaccagucagagugccaaauuacaaccugauuaucauggacgaagcccacuucacagacccagcaagcauagcagcuagaggauacauuucaacucgaguagagaugggugaagcagccgggauuuuuaugacagccacuccuccgggaagcagagacccauuuccucagagcaaugcaccaaucauggaugaggaaagagaaaucccugagcguucauggaauucaggacaugaaugggucacggauuuuaaagggaagacuguuugguuuguuccaaguauaaaagcaggaaaugacauagcagcuugucuuaggaaaaauggaaagaaagugauacaacucaguaggaagacuuuugacucugaguauguuaagacuagagccaaugauugggacuuuguggucacgacugacauuucagaaaugggugccaacuucaaggcugagaggguuauagacccuagacgcugcaugaaaccagucauacuaacagauggcgaagagcgggugaucuuggcaggaccuaugccagugacccacucuagugcagcgcaaagaagagggagaauaggaagaaauccaaaaaaugagaaugaccaguacauauacaugggggaaccucucgaaaaugaugaagacugugcacacuggaaagaagcuaaaaugcuccuagauaacaucaacacacccgaaggaauuauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauguggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagaaacgcacuggacaacuuggcugugcugcauacggcugagguagguggaaaggcguacacucacgcucucagugaacugccggagacucuggagacacugcuucuacugacacuccuggcagcagucacaggaggaaucuucuuauucuuaaugagcggaaaagguauagggaagaugacucugggaauguguugcauaaucacagcuagcauucuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauuuggaagcauuacaacccaggaaucugagagcaacauccuggacauagaucuacguccugcaucagcauggacgcuguaugccguggcuacaacauuugucacaccaauguugcgacauagcauugaaaauuccucaguaaaugucucccuaacagccauugcuaaccaagcuacagugcuaaugggucuugggaaaggauggccauugucaaagauggacaucggaguuccccuccuugccauuggaugcuauucacaagucaacccuauaacccucacagcagcucuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuggcgaccgggcccaucuccacacugugggaaggaaauccagggagguuuuggaacaccaccauugcagugucaauggcuaacaucuuuagggggagcuacuuggccggagcuggacuucucuuuuccaucaugaagaacacaacaaacacaagaagaggaacuggcaacguaggagagacacuuggagaaaaauggaaaagccgauuaaaugcacugggaaaaagugaauuucagaucuacaagaaaaguggaauccaggaaguggauagaacucuagcaaaagaaggcaucaaaagaggagaaacggaccaccaugcugugucacgaggaucagcaaaacugagaugguucgucgagagaaacauggucacaccggaagggaaggugguggaucuugguugcggcagagggggcuggucauacuauugugggggacuaaagaauguaagagaagucaaaggccuaacaaaaggaggaccaggacacgaagaacccauccccaugucaacauauggguggaaucuagugcgucugcaaaguggggucgacguuuucuucaccccgccagaaaagugugauacauuguugugugacauaggggagucgucaccaaaucccacgauagaagcaggacgaacacucagaguccucaacuuaguggaaaauuggcugaacaauaacacccaauuuugcauaaagguccucaauccauauaugcccucagucauagaaaaaauggaaacacuacaaaggaaauauggaggagccuuagugaggaauccacucucacgaaacuccacgcaugaaauguacuggguaucuaaugcuaccgggaacauagugucaucagugaacaugauuucaaggauguugauuaacagauucacaaugaaacauaagaaagccaccuacgagccagauguugaccuaggaaguggaacccguaacauuggaauugaaagugagacaccaaaucuagacauaauaggaaagagaauagagaaaauaaaacaagagcaugaaacaucauggcauuaugaccaagaccacccauacaaaacgugggcuuaccauggcagcuaugaaacaaaacaaacuggaucagcaucaucuauggugaacggaguggucagacugcugacaaaaccuugggacgucguuccaauggugacacagauggcaaugacagacacgacuccauuuggacaacagcgcguuuucaaagagaaaguggacacgagaacucaagaaccgaaggaaggcacaaagaaacugaugaaaauuacggcagaguggcuuuggaaagaacuaggaaaggaaaagacaccuagaauguguaccagagaagaauucacaagaaaagugagaagcaaugcagccuugggggccguauucacugaugagaacaaauggaaaucggcacgugaggcuguugaagaugguagguuuugggagcugguugauagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuuuuuagaguuugaagcccuaggauuucugaaugaagaucacugguucuccagagggaacucccugaguggaguggaaggagaagggcugcacaggcuaggcuacauuuuaagagaggugggcaagaaggaaggaggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaaaagaccaaagaggcagugggcaagucgguaccuauggccuuaacacuuucaccaauauggaagcccaauuaauuagacagauggaaggagaaggaaucuucaaaagcauucagcaccugaccgccacagaagaaaccgcuguacagaacugguuagcaagaguggggcgugaaaggcuaucaagaauggccaucaguggagaugacuguguuguaaaaccuauagaugacagauuugcaagugcuuuaacagcucuaaaugacaugggaaaaguuaggaaagauauacaacaaugggaaccuucaagaggauggaacgauuggacacaggugccuuucuguucacaccauuuucaugaguuagucaugaaagauggucgcgugcucguagucccaugcagaaaucaagaugaacugauuggcagagcccgaauuucccagggagccggguggucuuugaaggagacggcuuguuuggggaagucuuacgcccaaauguggacccugauguacuuccacagacgugaccucagauuggcggcaaaugccauuugcucggcagucccgucacauuggguuccaacaagucgaacaaccugguccauacacgccaagcaugaauggaugacgacggaagacaugcuggcagucuggaacaggguguggauucaagaaaacccauggauggaagacaaaacuccaguggaaucaugggaagaagucccauaccuggggaaaagggaagaccaauggugcggcucauugauugggcuaacaagcagggcuaccugggcaaagaauauccagacagcaauaaaucaagucagaucccuuauaggcaaugagggauacacagacuacaugccaucaaugaagagauucagaagggaagaggaagaggcagguguccugugguag

SEQ ID NO: 6392 - RNA, 9876 nt, Artificial Sequence
  derived and/or modified CDS sequence (wt) from DENV-2__KP188550__SS-prME
acagcaggcgugauuguuauguugauuccaacagugauggcguuccauuuaaccacacgcaauggagaaccacacaugaucguugguaggcaggagaaagggaaaagucuucuguucaaaacagaggaugguguuaacauguguacccucauggccauagaccuuggugaauugugugaagauacaaucacguacaaguguccccuccucagacaaaaugaaccagaagacauagauuguuggugcaacucuacguccacauggguaacuuaugggacauguacuaccacaggagaacacagaagagaaaaaagaucaguggcgcucguuccacauguggguaugggacuggagacacgaacugaaacauggaugucaucagaaggggccuggaagcauguucagagaauugaaaccuggaucuugagacauccagguuuuaccauaauggcagcgauccuggcauacaccauaggaacgacacacuuccaaagggccuugauuuucaucuuacugacagcugucgcuccuucaaugacaaugcgcugcauaggaauaucaaauagagacuucguagaagggguuucaggaggaagcuggguugacaucguuuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaaugaagagcaggacaagagguucaucugcaaacacuccaugguagacagaggauggggaaauggauguggauuauuuggaaagggaggcauugugaccugugcuauguuuacaugcaaaaagaacauggaaggaaaaaucguacagccagaaaauuuggaauacaccaucgugauaacaccucacucaggagaagagcacgcuguagguaaugacacaggaaagcauggcaaggaaaucaaaauaacaccacagaguucuaccacagaagcagaacugacaggcuauggcacugucacgauggagugcucuccgagaacgggccucgacuucaaugagauggugcugcugcagauggaagacaaagcuuggcuggugcacaggcaaugguuccuagaccugccguuaccauggcuacccggagcggauacacaaggaucaaauuggauacagaaagagacauuggucacuuucaaaaauccccacgccaagaaacaggaugucguugucuuagggucucaagaaggggccaugcacacggcacucacaggggcuacagaaauccagaugucaucaggaaacuuacuguucacgggacaucucaagugcaggcugagaauggacaaacuacagcucaaaggaaugucauacucuauguguacaggaaaguuuaaaaucgugaaggaaauagcagaaacacaacauggaacaauaguuaucagaguacaauaugaaggggacgguucuccaugcaagaucccuuuugagauaacagauuuggaaaaaagacacgucuuaggacgccugauuacagucaacccaaucgugacagaaaaagauagcccagucaacauagaagcagaaccuccauucggagacagcuacaucaucguaggaguagagccgggacaacugaaacucaauugguuuaagaaaggaaguuccaucggccaaauguuugagacaacaaugagaggagcaaagagaauggccauuuuaggugacacagccugggauuuuggaucccugggaggaguguuuacaucuauaggaaaggcucuccaucaaguuuucggagcaaucuauggggcugcuuuuaguggggucucauggacuaugaaaauccucauaggagucaucaucacauggauaggaaugaauucacguagcaccucacugucugugucgcuaguauuggugggagucgugacacuguaccugggagcuauggugcaggcugauagugguugcauugugagcuggaaaaauaaagaacugaaauguggcagcgggaucuucauuacagauaacguacacacauggacagaacaauauaaguuccaaccagaauccccuucaaaacuagcuucagcuauccaaaaagcucaugaagaaggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgauccuugcggccucagcccacugagcugaaguacucauggaaaacauggggaaaggcgaaaaugcucucuacagagucucacaaucagaccuuucuuauugauggcccugaaacagcagaaugccccaacacaaacagagcuuggaacucacuggaaguugaagacuaugguuuuggaguuuuuaccaccaauauauggcuaaaauugagagaaaaacaggauguauuuugugacucaaaacucaugucagcggccauuaaagacaacagagccguccaugccgauauggguuauuggauagaaagugcacucaaugacacauggaagauggagaaagccuccuucauugaaguuaaaagcugccacuggccaaagucacacacccucuggagcaauggaguauuagaaagugagaugauaauuccaaaaaauuuugcugggccagugucacaacacaacuacagaccaggcuaccauacacaaacagcaggaccuuggcaucuagguaagcuugagauggacuuugauuucugcgaaggaacuacagugguggugacugaggacuguggaaauagaggacccuccuuaagaacgaccacugccucuggaaagcucauaacagaauggugcugccgauccugcacacuaccaccucuaagauacagaggugaggauggaugcugguacgggauggaaaucagaccuuugaaagagaaagaagagaacuuggucaacuccuuggucacagccggacaugggcagauugacaacuuuucacuaggagucuugggaauggcacuguuccuggaagaaaugcuuaggacccgaguaggaacgaaacaugcaauacugcuaguugcacuaucuuucgugacauugauuacugggaacaugucuuuuagagaccugggaagagugauggucauggugggcgcuaccaugacggaugacauagguaugggagugacuuaucuugcccuacuagcagcuuucaaaguuagaccaacuuuugcagcuggacuacucuugagaaaacugaccuccaaggaauugaugauggccaccauaggaaucgcacuccuuucccaaagcaccuugccagagaccauucuagaacugacugaugcguuagccuugggcaugauggcccucaaaauagugagaaauauggaaaaauaccaauuggcagugacuaucauggcuauuucgugugucccaaaugcagugauauugcaaaacgcauggaaggugaguugcacaauauuggcagcgguguccguuucuccacugcuccuaacauccucacagcagaaagcggauuggauaccacuggcauugacgauaaaaggucucaacccaacagccauuuuucuaacuacucuuucgagaaccagcaagaaaaggagcuggccgcuaaaugaagccaucauggcagucgggauggugagcauuuuagccaguucucuccuaaagaaugacauuccuaugacagguccauuaguggcuggagggcuccucaccguauguuacgugcucacuggacgaucggccgacuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucauuagaacgggauuguuggugaucucaggagucuuuccaguaucgauaccaauuacggcagcagcaugguaccugugggaaguaaagaaacaacgggcuggaguauugugggacgucccuucacccccaccagugggaaaagccgaacuggaagauggagccuauagaaucaaacaaagagggauucuuggauauucucagauuggagccggaguuuacaaagaaggaacauuucauacaauguggcacgucacacguggugcuguucugaugcauagagggaagaggauugaaccaucaugggcagaugucaagaaagaucuaauaucauauggaggaggcuggaagcuagaaggagaauggaaggaaggagaggaaguccaaguccuggcauuggaaccuggaaaaaaucccagagcuguccaaacgaaaccuggaauuuucaaaaccaacaccggaaccauaggcgcuguaucucuggacuuuuccccuggaacgucaggaucuccaauugucgauagaaaaggaaaaguugugggucuuuacgguaaugguguugucacaaggaguggagcauacguaagcgccauagcccagaccgaaaaaagcauugaagacaauccagagaucgaagaugacauuuuccgaaagaaaagauugaccaucauggaccuccauccaggggcaggaaagacaaaaagauaccuuccagccauagucagagaagccauaaaacguggcuugagaacauuaauccuggcucccacuagagucguggcagcugaaauggaggaagcucuuagaggacuuccaauaagauaccaaaccccagccaucagagccgagcacaccgggcgagagaucguggaccuaaugugucaugccacauuuacuaugagguugcuaucaccagucagagugccaaauuacaaccugauuaucauggacgaagcccacuucacagacccagcaagcauagcagcuagaggauacauuucaacucgaguagagaugggugaagcugccgggauuuuuaugacagccacuccuccgggaagcagagacccauuuccucagagcaaugcaccaaucauggaugaggaaagagaaaucccugagcguucauggaauucaggacaugaaugggucacggauuuuaaagggaagacuguuugguuuguuccaaguauaaaagcuggaaaugacauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagacccuagacgcugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguauauauacaugggggaaccucucgaaaaugaugaagacugugcacacuggaaagaagcuaaaaugcucuuagauaacaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauguggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagaaacgcacuggacaacuuggcugugcugcauacggcugagguagguggaagggcgcauacccaugcucucagugaacugccggagacucuggagacacugcuucuacugacacuccuggcaacagucacaggaggaaucuucuuauucuuaaugagcggaaaagguauagggaagaugacucugggaauguguugcauaaucacagcuagcauucuccuaugguaugcacagauacaaccacacuggauagcagcuucaauaauauuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaucucggauuuggaaccauuacaacucaggaaucugagagcaacauccuggacauagaucuacguccugcaucagcauggacgcuguaugccguggcuacaacauuugucacaccaauguugcgacauagcauugaaaauuccucaguaaaugucucccuaacagccauugcuaaccaagcuacagugcuaaugggucuugggaaaggauggccauugucaaagauggacaucggaguuccccuccuugccauuggaugcuacucacaagucaacccuauaacucucacagcagcucuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaacaccaccauugcagugucaauggcuaacaucuuuagggggagcuacuuggccggagcuggacuucucuuuucuaucaugaagaacacaacaaacacaagaagaggaacuggcaacguaggagagacacuuggagaaaaauggaaaagccgauuaaaugcacugggaaaaagugaauuucagaucuacaagaaaaguggaauccaggaaguggauagaacccuagcaaaagaaggcaucaaaagaggagaaacggaccaccaugcugugucacgaggaucagcaaaacugagaugguucgucgagagaaacauggucacaccggaagggaaggugguggaucuugguugcggcagaggaggcuggucauacuauugugggggacuaaagaauguaagagaagucaaaggccuaacaaaaggaggaccaggacacgaagaacccauccccaugucaacauauggguggaaucuagugcgucugcaaaguggggucgacguuuucuucaccccgccagaaaagugugauacauuguugugugacauaggggagucgucaccaaaucccacgauagaagcaggacgaacacucagaguccucaauuuaguggaaaauuggcugaacaauaacacccaauuuugcauaaagguccucaauccauauaugcccucagucauagaaaaaauggaaacacuacaaaggaaauaugggggagccuuagugaggaauccacucucacgaaacuccacgcaugaaauguacuggguaucuaaugcuaccgggaacauagugucaucagugaacaugauuucaaggauguugauuaacagauucacaaugaaacauaagaaagccaccuacgagccagauguugaccuaggaaguggaacccgcaacauuggaauugaaagugagauaccaaaucuagacauaauaggaaagagaauagagaaaauaaaacaagagcaugaaacaucauggcauuaugaucaagaccacccauacaaaacgugggcuuaccauggcagcuaugaaacaaaacaaacuggaucagcaucaucuauggugaauggaguggucagacugcugacaaaaccuugggacgucgucccuauggugacacagauggcaaugacagacacgacuccauuuggacaacagcgcguuuuuaaagagaaaguggacacgagaacucaagaaccgaaggaaggcacaaagaaacugaugaaaauuacggcaaaguggcuuuggaaagaacuaggaaaggaaaagacaccuagaauguguaccagagaagaauucacaagaaaagugagaagcaaugcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuucugaaugaagaucacugguucuccagagggaacucccugaguggaguggaaggagaaggguugcacaggcuaggcuacauuuuaagagaggugggcaagaaggaaggaggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaaaagaccaaagaggcagugggcaagucgguaccuauggccuuaauacuuucaccaauauggaagcccaauuaauuagacagauggaaggagaaggaaucuucaaaaacauucagcaccugaccgccacagaagaaaucgcuguacagaacugguuagcaagaguggggcgugaaaggcuaucaagaauggccaucaguggagaugacuguguuguaaaaccuauagaugacagauuugcaagugcuuugacagcucuaaaugacaugggaaaaguuaggaaagauauacaacaaugggaaccuucaagaggauggaacgauuggacacaggugccuuucuguucacaccauuuucaugaguuagucaugaaagauggucgcgugcucguagucccaugcagaaaccaagaugaacugauuggcagagcccgaauuucccagggagccggguggucuuugaaggagacggcuuguuuggggaagucuuacgcccaaauguggacccugauguacuuccacagacgugaccucagauuggcggcaaaugccauuugcucggcagucccgucacauuggguuccaacaagucgaacaaccugguccauacacgccaagcaugaauggaugacgacggaagacaugcuggcagucuggaacaggguguggauccaagaaaacccauggauggaagacaaaacuccaguggaaucaugggaagaagucccauaccuggggaaaagggaagaccaauggugcggcucauugauugggcuaacaagcagggcuacaugggcaaagaauauccagacagcaauaaaucaagucagaucccuuauaggcaaugagggauacacagacuacaugccauccaugaagagauucagaagggaagaggaagaggcagguguccugugguag

SEQ ID NO: 6393 - RNA, 9876 nt, Artificial Sequence
  derived and/or modified CDS sequence (wt) from DENV-2__KP188553__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaguugugugaagauacaaucacguacaaguguccccuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugaaacauggaugucaucagaaggggccuggaagcauguucagagaauugaaaccuggaucuugagacauccagguuuuaccauaauggcagcgauccuggcauacaccauaggaacgacacacuuccaaagggccuugauuuucaucuuacugacagcuguugcuccuucaaugacaaugcgcugcauaggaauaucaaauagagacuucguagaagggguuucaggaggaagcuggguugacaucguuuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaaugaagagcaggacaaaagguucaucugcaaacacuccaugguagacagaggauggggaaauggauguggauuauuuggaaagggaggcauugugaccugugcuauguuuacauguaaaaagaacauggaaggaaaaaucguacagccagaaaauuuggaauacaccaucgugauaacaccucacucaggagaagagcacgcuguagguaaugacacaggaaagcauggaaaggaaaucaaaauaacaccacagaguuccaccacagaagcagaacugacaggcuauggcacugucacgauggagugcucuccgagaacgggccucgacuucaaugagauggugcugcugcagauggaagacaaagcuuggcuggugcacaggcaaugguuccuagaccugccguugccauggcuacccggagcggauacacaaggaucaaauuggauacagaaagagacauuggucacuuucaaaaauccccacgccaagaaacaagaugucguugucuuagggucucaagaaggggccaugcacacggcacucacaggggcuacagaaauccagaugucaucaggaaacuuacuguucacgggacaucucaagugcaggcugagaauggacaaacuacagcucaaaggaaugucauacucuauguguacaggaaaguuuaaaaucgugaaggaaauagcagaaacacaacauggaacaauaguuaucagaguacaauaugaaggggacgguucuccaugcaagaucccuuuugagauaacagauuuggaaaaaagacacgucuuaggacgccugauuacaguuaacccaaucguaacagaaaaagauagcccagucaacauagaagcagaacccccauucggagacaguuacaucaucguaggaguagagccgggacaacugaaacucaauugguuuaagaagggaaguuccaucggccaaauguuugagacaacaaugagaggagcaaagagaauggccauuuuaggugacacagccugggauuuuggaucccugggaggaguguuuacaucuauaggaaaggcucuccaucaaguuuucggagcaaucuauggggcugcuuuuaguggggucucauggacuaugaaaauccucauaggagucaucaucacauggauaggaaugaauucacguagcaccucacugucugugucgcuaguauuggugggagucgugacacuguaccugggagcuauggugcaggcugauagugguugcauugugagcuggaaaaauaaagaacugaaauguggcagcgggaucuucauuacagauaacguacacacauggacagagcaauauaaguuccaaccagaauccccuucaaaacuagcuucagcuauccaaaaagcucaugaagaaggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgauccuugcggccucagcccacugagcugaaguacucauggaaaacauggggaaaggcgaaaaugcucucuacagagucucacaaucagaccuuucuuauugauggcccugaaacagcagaaugccccaacacaaacagagcuuggaacucacuggaaguugaagacuaugguuuuggaguuuuuaccaccaauauauggcuaaaauugagagaaaaacaggauguauuuugugacucaaaacucaugucagcggccauuaaagacaacagagccguccaugccgauauggguuauuggauagaaagugcacucaaugacacauggaagauggagaaagccuccuucauugaaguuaaaagcugccacuggccaaagucacacacccuauggagcaauggaguauuagaaagugagaugguaauuccaaaaaauuuugccgggccagugucacaacacaacuacagaccaggcuaccauacacaaacagcaggaccuuggcaucuagguaagcuugagauggacuuugauuucugcgaaggaacuacagugguggugacugaggacugugaaaaaagaggacccucuuuaagaacgaccacugccucuggaaagcucauaacagaauggugcugccgauccugcacacuaccaccucuaagauacagaggugaggauggaugcugguacgggauggaaaucagaccuuugaaagagaaagaagagaacuuggucaacuccuuggucacagccggacaugggcagauugacaacuuuucacuaggagucuugggaauggcacuguuccuggaagaaaugcuuaggacccgaguaggaacgaaacaugcaauacugcuaguugcacuaucuuucgugacauugauuacugggaacaugucuuuuagagaccugggaagagugauggucauggugggcgcuaccaugacggaugacauagguaugggagugacuuaucuugcccuacuagcagcuuucaaaguuagaccaacuuuugcagcuggacuacucuugagaaaacugaccuccaaggaauugaugauggccaccauaggaaucgcacuccuuucccaaagcaccuugccagagaccauucuagaacugacugacgcguuagccuuggguaugauggcccucaaaauagugagaaauauggaaaaauaccaauuggcagugacuaucauggcuauuucgugugucccaaaugcagugauauugcaaaacgcauggaaggugaguugcacaauauuggcagcgguguccguuucuccacugcuccuaacauccucacagcagaaagcggauuggauaccacuggcacugacgauaaaaggucucaacccaacagccauuuuucuaacaacucuuucgagaaccagcaagaaaaggagcuggccgcuaaaugaagccaucauggcagucgggauggugagcauuuuagccaguucucuccuaaagaaugauauuccuaugacagguccauuaguggcuggagggcuccucaccguauguuacgugcucacuggacgaucggccgauuuggaacuggagagagcugccgauguaaaaugggaagaucaggcagaaauaucaggaagcagcccaauucugucaauaacaauaucagaagauggcagcaugucgauaaaaaaugaagaggaagaacaaacacugaccauacucauuagaacgggauuguuggugaucucaggagucuuuccaguaucgauaccaauuacggcagcagcaugguaccugugggaagugaagaaacaacgggcuggaguauugugggacgucccuucacccccaccagugggaaaagccgaacuggaagauggagccuauagaaucaagcaaagagggauucuuggauauucucagaucggagccggaguuuacaaagaaggaacauuccauacaauguggcacgucacacguggugcuguucugaugcauagagggaagaggauugaaccaucaugggcagacgucaagaaagaucuaauaucauauggaggaggcuggaagcuagaaggagaauggaaggaaggagaggaaguucaaguccuggcauuggaaccuggaaaaaaucccagagcuguccaaacgaaaccuggaauuuucaaaaccaacaccggaaccauaggcgcuguaucucuggacuuuuccccuggaacgucaggaucuccaauugucgacagaaaaggaaaaguugugggucuuuaugguaaugguguugucacaaggaguggagcauacguaagugccauagcccagacagaaaaaagcauugaagacaauccagagaucgaagaugacauuuuccgaaagaaaagauugaccaucauggaccuccauccaggggcaggaaagacaaaaagauaccuuccagccauaguuagagaagccauaaaacguggcuugagaacauuaauccuggcucccacuagagucguggcagcugaaauggaggaagcucuuagaggacucccaauaagauaccaaaccccagccaucagagccgagcacaccgggcgagagaucguggaccuaaugugucaugccacauuuacuaugaggcugcuaucaccagucagagugccaaauuacaaccugauuaucauggacgaagcccacuucacagacccagcaagcauagcagcuagaggauacauuucaacucgaguagagaugggugaagcagccgggauuuuuaugacagccacuccuccgggaagcagagacccauuuccucagagcaaugcaccaaucauggaugaggaaagagaaaucccugagcguucauggaauucaggacaugaaugggucacggauuuuaaagggaagacuguuugguuuguuccaaguauaaaagcaggaaaugacauagcagcuugucuuaggaaaaauggaaagaaagugauacccuacaguaggaagacuuuugacucugaguauguuaagacuagagccaaugauugggacuuuguggucacgacugacauuucagaaaugggugccaacuucaaggcugagaggguuauagacccuagacgcugcaugaaaccagucauacuaacagauggcgaagagcgggugaucuuggcaggaccuaugccagugacccacucuagugcagcgcaaagaagagggagaauaggaagaaauccaaaaaaugagaaugaccaguacauauacaugggggaaccucucgaaaaugaugaagacugugcacacuggaaagaagcuaaaaugcuccuagauaacaucaacacacccgaaggaauuauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauguggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagaaacgcacuggacaacuuggcugugcugcauacggcugagguagguggaaaggcguacacucacgcucucagugaacugccggagacucuggagacacugcuucuacugacacuccuggcagcagucacaggaggaaucuucuuauucuuaaugagcggaaaagguauagggaagaugacucugggaauguguugcauaaucacagcuagcauucuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauuuggaagcauuacaacccaggaaucugagagcaacauccuggacauagaucuacguccugcaucagcauggacgcuguaugccguggcuacaacauuugucacaccaauguugcgacauagcauugaaaauuccucaguaaaugucucccuaacagccauugcuaaccaagcuacagugcuaaugggucuugggaaaggauggccauugucaaagauggacaucggaguuccccuccuugccauuggaugcuauucacaagucaacccuauaacccucacagcagcucuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuggcgaccgggcccaucuccacacugugggaaggaaauccagggagguuuuggaacaccaccauugcagugucaauggcuaacaucuuuagggggagcuacuuggccggagcuggacuucucuuuuccaucaugaagaacacaacaaacacaagaagaggaacuggcaacguaggagagacacuuggagaaaaauggaaaagccgauuaaaugcacugggaaaaagugaauuucagaucuacaagaaaaguggaauccaggaaguggauagaacucuagcaaaagaaggcaucaaaagaggagaaacggaccaccaugcugugucacgaggaucagcaaaacugagaugguucgucgagagaaacauggucacaccggaagggaaggugguggaucuugguugcggcagagggggcuggucauacuauugugggggacuaaagaauguaagagaagucaaaggccuaacaaaaggaggaccaggacacgaagaacccauccccaugucaacauauggguggaaucuagugcgucugcaaaguggggucgacguuuucuucaccccgccagaaaagugugauacauuguugugugacauaggggagucgucaccaaaucccacgauagaagcaggacgaacacucagaguccucaacuuaguggaaaauuggcugaacaauaacacccaauuuugcauaaagguccucaauccauauaugcccucagucauagaaaaaauggaaacacuacaaaggaaauauggaggagccuuagugaggaauccacucucacgaaacuccacgcaugaaauguacuggguaucuaaugcuaccgggaacauagugucaucagugaacaugauuucaaggauguugauuaacagauucacaaugaaacauaagaaagccaccuacgagccagauguugaccuaggaaguggaacccguaacauuggaauugaaagugagacaccaaaucuagacauaauaggaaagagaauagagaaaauaaaacaagagcaugaaacaucauggcauuaugaccaagaccacccauacaaaacgugggcuuaccauggcagcuaugaaacaaaacaaacuggaucagcaucaucuauggugaacggaguggucagacugcugacaaaaccuugggacgucguuccaauggugacacagauggcaaugacagacacgacuccauuuggacaacagcgcguuuucaaagagaaaguggacacgagaacucaagaaccgaaggaaggcacaaagaaacugaugaaaauuacggcagaguggcuuuggaaagaacuaggaaaggaaaagacaccuagaauguguaccagagaagaauucacaagaaaagugagaagcaaugcagccuugggggccguauucacugaugagaacaaauggaaaucggcacgugaggcuguugaagaugguagguuuugggagcugguugauagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuuuuuagaguuugaagcccuaggauuucugaaugaagaucacugguucuccagagggaacucccugaguggaguggaaggagaagggcugcacaggcuaggcuacauuuuaagagaggugggcaagaaggaaggaggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaaaagaccaaagaggcagugggcaagucgguaccuauggccuuaacacuuucaccaauauggaagcccaauuaauuagacagauggaaggagaaggaaucuucaaaagcauucagcaccugaccgccacagaagaaaccgcuguacagaacugguuagcaagaguggggcgugaaaggcuaucaagaauggccaucaguggagaugacuguguuguaaaaccuauagaugacagauuugcaagugcuuuaacagcucuaaaugacaugggaaaaguuaggaaagauauacaacaaugggaaccuucaagaggauggaacgauuggacacaggugccuuucuguucacaccauuuucaugaguuagucaugaaagauggucgcgugcucguagucccaugcagaaaucaagaugaacugauuggcagagcccgaauuucccagggagccggguggucuuugaaggagacggcuuguuuggggaagucuuacgcccaaauguggacccugauguacuuccacagacgugaccucagauuggcggcaaaugccauuugcucggcagucccgucacauuggguuccaacaagucgaacaaccugguccauacacgccaagcaugaauggaugacgacggaagacaugcuggcagucuggaacaggguguggauucaagaaaacccauggauggaagacaaaacuccaguggaaucaugggaagaagucccauaccuggggaaaagggaagaccaauggugcggcucauugauugggcuaacaagcagggcuaccugggcaaagaauauccagacagcaauaaaucaagucagaucccuuauaggcaaugagggauacacagacuacaugccaucaaugaagagauucagaagggaagaggaagaggcagguguccugugguag

SEQ ID NO: 6394 - RNA, 9876 nt, Artificial Sequence
  derived and/or modified CDS sequence (wt) from DENV-2__KP188556__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaguugugugaagauacaaucacguacaaguguccccuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugaaacauggaugucaucagaaggggccuggaagcauguucagagaauugaaaccuggaucuugagacauccagguuuuaccauaauggcagcgauccuggcauacaccauaggaacgacacacuuccaaagggccuugauuuucaucuuacugacagcuguugcuccuucaaugacaaugcgcugcauaggaauaucaaauagagacuucguagaagggguuucaggaggaagcuggguugacaucguuuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaaugaagagcaggacaaaagguucaucugcaaacacuccaugguagacagaggauggggaaauggauguggauuauuuggaaagggaggcauugugaccugugcuauguuuacauguaaaaagaacauggaaggaaaaaucguacagccagaaaauuuggaauacaccaucgugauaacaccucacucaggagaagagcacgcuguaggcaaugacacaggaaagcauggaaaggaaaucaaaauaacaccacagaguuccaccacagaagcagaacugacaggcuauggcacugucacgauggagugcucuccgagaacgggccucgacuucaaugagauggugcugcugcagauggaagacaaagcuuggcuggugcacaggcaaugguuccuagaccugccguugccauggcuacccggagcggauacacaaggaucaaauuggauacagaaagagacauuggucacuuucaaaaauccccacgccaagaaacaggaugucguugucuuagggucucaagaaggggccaugcacacggcacucacaggggcuacagaaauccagaugucaucaggaaacuuacuguucacgggacaucucaagugcaggcugagaauggacaaacuacagcucaaaggaaugucauacucuauguguacaggaaaguuuaaaaucgugaaggaaauagcagaaacacaacauggaacaauaguuaucagaguacaauaugaaggggacgguucuccaugcaagaucccuuuugagauaacagauuuggaaaaaagacacgucuuaggacgccugauuacaguuaacccaaucguaacagaaaaagauagcccagucaacauagaagcagaacccccauucggagacaguuacaucaucguaggaguagagccgggacaacugaaacucaauugguuuaagaagggaaguuccaucggccaaauguuugagacaacaaugagaggagcaaagagaauggccauuuuaggugacacagccugggauuuuggaucccugggaggaguguuuacaucuauaggaaaggcucuccaucaaguuuucggagcaaucuauggggcugcuuuuaguggggucucauggacuaugaaaauccucauaggagucaucaucacauggauaggaaugaauucacguagcaccucacugucugugucgcuaguauuggugggagucgugacacuguaccugggagcuauggugcaggcugauagugguugcauugugagcuggaaaaauaaagaacugaaauguggcagcgggaucuucauuacagauaacguacacacauggacagagcaauauaaguuccaaccagaauccccuucaaaacuagcuucagcuauccaaaaagcucaugaagaaggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgauccuugcggccucagcccacugagcugaaguacucauggaaaacauggggaaaggcgaaaaugcucucuacagagucucacaaucagaccuuucuuauugauggcccugaaacagcagaaugccccaacacaaacagagcuuggaacucacuggaaguugaagacuaugguuuuggaguuuuuaccaccaauauauggcuaaaauugagagaaaaacaggauguauuuugugacucaaaacucaugucagcggccauuaaagacaacagagccguccaugccgauauggguuauuggauagaaagugcacucaaugacacauggaagauggagaaagccuccuucauugaaguuaaaaguugccacuggccaaagucacacacccuauggagcaauggaguauuagaaagugagaugguaauuccaaaaaauuuugccgggccagugucacaacacaacuacagaccaggcuaccauacacaaacagcaggaccuuggcaucuagguaagcuugagauggacuuugauuucugcgaaggaacuacagugguggugacugaggacugugaaaaaagaggacccucuuuaagaacgaccacugccucuggaaagcucauaacagaauggugcugccgauccugcacacuaccaccucuaagauacagaggugaggauggaugcugguacgggauggaaaucagaccuuugaaagagaaagaagagaacuuggucaacuccuuggucacagccggacaugggcagauugacaacuuuucacuaggagucuugggaauggcacuguuccuggaagaaaugcuuaggacccgaguaggaacgaaacaugcaauacugcuaguugcacuaucuuucgugacauugauuacugggaacaugucuuuuagagaccugggaagagugauggucauggugggcgcuaccaugacggaugacauagguaugggagugacuuaucuugcccuacuagcagcuuucaaaguuagaccaacuuuugcagcuggacuacucuugagaaaacugaccuccaaggaauugaugauggccaccauaggaaucgcacuccuuucccaaagcaccuugccagagaccauucuagaacugacugacgcguuagccuuggguaugauggcccucaaaauagugagaaauauggaaaaauaccaauuggcagugacuaucauggcuauuucgugugucccaaaugcagugauauugcaaaacgcauggaaggugaguugcacaauauuggcagcgguguccguuucuccacugcuccuaacauccucacagcagaaagcggauuggauaccacuggcacugacgauaaaaggucucaacccaacagccauuuuucuaacaacucuuucgagaaccagcaagaaaaggagcuggccgcuaaaugaagcuaucauggcagucgggauggugagcauuuuagccaguucucuccuaaagaaugauauuccuaugacagguccauuaguggcuggagggcuccucaccguauguuacgugcucacuggacgaucggccgauuuggaacuggagagagcugccgauguaaaaugggaagaucaggcagaaauaucaggaagcagcccaauucugucgauaacaauaucagaagauggcagcaugucgauaaaaaaugaagaggaagaacaaacacugaccauacucauuagaacgggauuguuggugaucucaggagucuuuccaguaucgauaccaauuacggcagcagcaugguaccugugggaagugaagaaacaacgggcuggaguauugugggacgucccuucacccccaccagugggaaaagccgaacuggaagauggagccuauagaaucaagcaaagagggauucuuggauauucucagaucggagccggaguuuacaaagaaggaacauuccauacaauguggcacgucacacguggugcuguucugaugcauagagggaagaggauugaaccaucaugggcagacgucaagaaagaucuaauaucauauggaggaggcuggaagcuagaaggagaauggaaggaaggagaggaaguucaaguccuggcauuggaaccuggaaaaaaucccagagcuguccaaacgaaaccuggaauuuucaaaaccaacaccggaaccauaggcgcuguaucucuggacuuuuccccuggaacgucaggaucuccaauugucgacagaaaaggaaaaguugugggucuuuaugguaaugguguugucacaaggaguggagcauacguaagugccauagcccagacagaaaaaagcauugaagacaauccagagaucgaagaugacauuuuccgaaagaaaagauugaccaucauggaccuccauccaggggcaggaaagacaaaaagauaccuuccagccauaguuagagaagccauaaaacguggcuugagaacauuaauccuggcucccacuagagucguggcagcugaaauggaggaagcucuuagaggacucccaauaagauaccaaaccccagccaucagagccgagcacaccgggcgagagaucguggaccuaaugugucaugccacauuuacuaugaggcugcuaucaccagucagagugccaaauuacaaccugauuaucauggacgaagcccacuucacagacccagcaagcauagcagcuagaggauacauuucaacucgaguagagaugggugaagcagccgggauuuuuaugacagccacuccuccgggaagcagagacccauuuccucagagcaaugcaccaaucauggaugaggaaagagaaaucccugagcguucauggaauucaggacaugaaugggucacggauuuuaaagggaagacuguuugguuuguuccaaguauaaaagcaggaaaugacauagcagcuugucuuaggaaaaauggaaagaaagugauacaacucaguaggaagacuuuugacucugaguauguuaagacuagagccaaugauugggacuuuguggucacgacugacauuucagaaaugggugccaacuucaaggcugagaggguuauagacccuagacgcugcaugaaaccagucauacuaacagauggcgaagagcgggugaucuuggcaggaccuaugccagugacccacucuagugcagcgcaaagaagagggagaauaggaagaaauccaaaaaaugagaaugaccaguacauauacaugggggaaccucucgaaaaugaugaagacugugcacacuggaaagaagcuaaaaugcuccuagauaacaucaacacacccgaaggaauuauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauguggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagaaacgcacuggacaacuuggcugugcugcauacggcugagguagguggaaaggcguacacucacgcucucagugaauugccggagacucuggagacacugcuucuacugacacuccuggcagcagucacaggaggaaucuucuuauucuuaaugagcggaaaagguauagggaagaugacucugggaauguguugcauaaucacagcuagcauucuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauuuggaagcauuacaacccaggaaucugagagcaacauccuggacauagaucuacguccugcaucagcauggacgcuguaugccguggcuacaacauuugucacaccaauguugcgacauagcauugaaaauuccucaguaaaugucucccuaacagccauugcuaaccaagcuacagugcuaaugggucuugggaaaggauggccauugucaaagauggacaucggaguuccccuccuugccauuggaugcuauucacaagucaacccuauaacccucacagcagcucuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauaccccaugauccaaaauuugaaaagcaguuaggacaaguaaugcuccuaauccucugcgugacucaaguauuaaugaugaggacuacaugggcuuugugugaggcucuaacccuggcgaccgggcccaucuccacacugugggaaggaaauccagggagguuuuggaacaccaccauugcagugucaauggcuaacaucuuuagggggagcuacuuggccggagcuggacuucucuuuuccaucaugaagaacacaacaaacacaagaagaggaacuggcaacguaggagagacacuuggagaaaaauggaaaagccgauuaaaugcacugggaaaaagugaauuucagaucuacaagaaaaguggaauccaggaaguggauagaacucuagcaaaagaaggcaucaaaagaggagaaacggaccaccaugcugugucacgaggaucagcaaaacugagaugguucgucgagagaaacauggucacaccggaagggaaggugguggaucuugguugcggcagagggggcuggucauacuauugugggggacuaaagaauguaagagaagucaaaggccuaacaaaaggaggaccaggacacgaagaacccauccccaugucaacauauggguggaaucuagugcgucugcaaaguggggucgacguuuucuucaccccgccagaaaagugugauacauuguugugugacauaggggagucgucaccaaaucccacgauagaagcaggacgaacacucagaguccucaacuuaguggaaaauuggcugaacaauaacacccaauuuugcauaaagguccucaauccauauaugcccucagucauagaaaaaauggaaacacuacaaaggaaauauggaggagccuuagugaggaauccacucucacgaaacuccacgcaugaaauguacuggguaucuaaugcuaccgggaacauagugucaucagugaacaugauuucaaggauguugauuaacagauucacaaugaaacauaagaaagccaccuacgagccagauguugaccuaggaaguggaacccguaacauuggaauugaaagugagacaccaaaucuagacauaauaggaaagagaauagagaaaauaaaacaagagcaugaaacaucauggcauuaugaccaagaccacccauacaaaacgugggcuuaccauggcagcuaugaaacaaaacaaacuggaucagcaucaucuauggugaacggaguggucagacugcugacaaaaccuugggacgucguuccaauggugacacagauggcaaugacagacacgacuccauuuggacaacagcgcguuuucaaagagaaaguggacacgagaacucaagaaccgaaggaaggcacaaagaaacugaugaaaauuacggcagaguggcuuuggaaagaacuaggaaaggaaaagacaccuagaauguguaccagagaagaauucacaagaaaagugagaagcaaugcagccuugggggccguauucacugaugagaacaaauggaaaucggcacgugaggcuguugaagaugguagguuuugggagcugguugauagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuuuuuagaguuugaagcccuaggauuucugaaugaagaucacugguucuccagagggaacucccugaguggaguggaaggagaagggcugcacaggcuaggcuacauuuuaagagaggugggcaagaaggaaggaggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaaaagaccaaagaggcagugggcaagucgguaccuauggccuuaacacuuucaccaauauggaagcccaauuaauuagacagauggaaggagaaggaaucuucaaaagcauucagcaccugaccgccacagaagaaaccgcuguacagaacugguuagcaagaguggggcgugaaaggcuaucaagaauggccaucaguggagaugacuguguuguaaaaccuauagaugacagauuugcaagugcuuuaacagcucuaaaugacaugggaaaaguuaggaaagauauacaacaaugggaaccuucaagaggauggaacgauuggacacaggugccuuucuguucacaccauuuucaugaguuagucaugaaagauggucgcgugcucguagucccaugcagaaaucaagaugaacugauuggcagagcccgaauuucccagggagccggguggucuuugaaggagacggcuuguuuggggaagucuuacgcccaaauguggacccugauguacuuccacagacgugaccucagauuggcggcaaaugccauuugcucggcagucccgucacauuggguuccaacaagucgaacaaccugguccauacacgccaagcaugaauggaugacgacggaagacaugcuggcagucuggaacaggguguggauucaagaaaacccauggauggaagacaaaacuccaguggaaucaugggaagaagucccauaccuggggaaaagggaagaccaauggugcggcucauugauugggcuaacaagcagggcuaccugggcaaagaauauccagacagcaauaaaucaagucagaucccuuauaggcaaugagggauacacagacuacaugccaucaaugaagagauucagaagggaagaggaagaggcagguguccugugguag

SEQ ID NO: 6395 - RNA, 9876 nt, Artificial Sequence
  derived and/or modified CDS sequence (wt) from DENV-2__GU369819__SS-prME
acagcaggcgugauuguuauguugauuccaacagcgauggcguuccauuuaaccacacgcaauggagaaccacacaugaucguugguaggcaggagaaagggaaaagucuucuguucaaaacagaggauggugucaacauguguacccucauggccauagaccuuggugaauugugugaagauacaaucacguacaaguguccucuccucagacaaaaugaaccagaagacauagauuguuggugcaacuccacguccacauggguaacuuaugggacauguaccaccacaggagaacacagaagagaaaaaagaucaguggcgcucguuccacauguggguaugggacuggagacacgaacugaaacauggaugucaucagaaggggccuggaaacauguccagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucugaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcuguagguaaugacacaggaaagcauggcaaggaaaucaaaauaacaccacagaguuccaucacagaagcagaacugacaggcuauggcacugucacgauggagugcucuccgagaacgggccucgacuucaaugagaugguguugcugcagauggaaaacaaagcuuggcuggugcacaggcaaugguuccuagaccugccgcuaccauggcugcccggagcggacacacaaggaucaaauuggauacagaaagagacauuggucacuuucaaaaauccccacgcgaagaaacaggaugucguuguuuuagggucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggucgcuugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcgucgugacacuguaccugggagcuauggugcgagcugauagugguugcguugugagcuggaaaaacaaagaacugaaauguggcagcgggaucuucaucacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccaucaugacaggagacauuaaaggaaucaugcaggcaggaaaacgauccuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuucaccaccaauauauggcugaaauugagagaaaaacaggauguauuuugugacucaaaacucaugucagcggccauuaaagacaacagagccguucaugccgauauggguuauuggauagaaagugcacucaaugacacauggaagauggagaaggccuccuucauugaaguuaaaagcugccacuggccaaagucacacacccuuuggagcaauggaguauuagaaagugagaugauaaucccaaaaaauuuugccgggccagugucacaacacaacuacagaccaggcuaccauacacaaacagcaggaccuuggcaucuagguaagcuugagauggacuuugaucuuugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacccgaauaggaacgaaacaugcaauacugcuaguugcaguaucuuuugugacauugauuacugggaacaugucuuuuagagaccugggaagagugaugguuauggugggcgcuaccaugacggaugacauagguaugggagugacuuaucuugcccuacuagcagcuuuuaaaguuagaccaacuuuugcagcuggacuacucuugagaaaacugaccuccaaggaauugaugauggccaccauaggaaucgcacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcagugauacugcaaaacgcauggaaggugaguugcacaauauuggcagcgguguccguuucuccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauucccaugacagguccauuaguggcuggagggcuccuuaccguauguuacgugcucacuggacgaucggccgauuuggaacuggagagagcugccgauguaaaaugggaagaucaggcagaaauaucaggaagcagcccaauccuaucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaagugaagaaacaacgggcuggaguauugugggacgucccuucacccccaccugugggaaaggcugaacuggaagauggagccuauagaaucaagcaaaaagggauucuuggauauucccagaucggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguccaaacgaaaccuggaauuuucaaaaccaacaccggaaccauaggcgccguaucucuggacuuuuccccuggaacgucaggaucuccaauugucgacagaaaaggaaaaguugugggucuuuacgguaaugguguugucacaaggaguggagcauauguaagugccauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaggaagcucuuagaggacuuccaauaagauaccaaaccccagccaucaaaaccgagcauaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaaucauggaugaggaaagagaaauuccugagcguucguggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucuugaaaaugaugaagacugugcacauuggaaagaagcuaaaaugcuccuagauaacaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauauagaaguggaaaucuggacaaaagaaggggaaaggaaaaaauuaaaacccagaugguuggaugcuaggaucuauucugacccacuggcacuaaaagaauucaaggaauuugcagcuggaagaaaaucucugacccugaaccuaaucacagaaauggguaggcuuccaacuuucaugacucagaaagcaagaaacgcacuggacaacuuggcugugcugcauacggcugaggcagguggaagggcguacaaucaugcucucagugaacugccggagacccuggagacacugcuuuuacugacacuccuggcaacagucacaggaggaaucuuuuuauucuugaugagcggaaggggcauagggaagaugacccugggaaugugcugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauucucacagugguggccgcaaccauggcaaacgagauggguuuccuggaaaaaaccaagaaagaccucggauugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccauugcuaaccaagcuacagugcuaaugggucuugggaaaggauggccauugucaaagauggacauuggaguuccccuccuugccauuggaugcuauucacaagucaacccuauaacucucacagcagcucuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaaaaacacaacaaacacaagaagaggaacuggcaacauaggagagacacuuggagaaaaauggaaaagucgauuaaacgcacugggaaaaagugaauuucaagucuacaagaaaaguggaauccaggaaguggauagaacccuagcaaaagaagguaucaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcguuugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguccucaacccauauaugccuucagucauagaaaaaauggaagcauuacaaaggaaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaagcaagagcaugaaacaucauggcacuaugaccaagaccacccauacaaaacgugggcauaccauggcagcuaugaaacaaaacagacuggaucagcaucauccauggugaacggaguggucaggcugcugacaaaaccuugggacguccuccccauggugacacagauggcaaugacagacacgacuccauuuggacaacagcgcguuuucaaagagaaaguggacacgagaacccaagaaccgaaagaaggcacgaagaaacuaaugaaaaucacggcagaguggcuguggaaagaacuaggaaagaaaaagacaccuaggaugugcaccagagaagaauucacaagaaaggugagaagcaaugcagccuugggggccauauucacugaugagaacaaguggaagucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuccugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacgccaagaggcacaguaauggauaucauaucgagaagagaccaaagaggcagugggcaagucggcaccuauggccuuaauacuuucaccaauauggaagcccaauuaauuagacagauggagggagaaggaaucuucaaaagcauucagcaccugacagccacagaagaaaucgcuguacagaacugguuagcaagaguggggcgugaaaggcuaucaagaauggcaaucaguggggaugauuguguuguaaaaccuauagaugauagauuugcaagugcuuuaacagcucuaaaugacaugggaaaaguuagaaaagauauacaacaaugggaaccuucaagaggauggaacgauuggacacaagugccuuucuguucacaccauuuucaugaguuagucaugaaagauggucgcgugcucguagucccaugcagaaaccaagaugaacugauugguagagcccgaauuucccagggagcuggguggucuuugaaggagacggccuguuuggggaagucuuacgcccaaauguggacccugauguacuuccacagacgugaccucagacuggcggcaaaugccauuugcucggcagucccgccacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaccaagucagaucccuuauaggcaaugaggaauacacagacuacaugccauccaugaagagauucagaagggaagaggaagaggcagguguccugugguag

SEQ ID NO: 6396 - RNA, 9876 nt, Artificial Sequence
  derived and/or modified CDS sequence (wt) from DENV-2__JX649147__SS-prME
acagcaggcgugauuauuauguugauuccaacagcgauggcguuccauuuaaccacacguaacggagaaccacacaugaucguugguagacaagagaaagggaaaagucuucuguucaaaacagaggauggugugaacauguguacccucauggccauagaucuuggugaacugugugaagauacaaucacguacaagugcccccuccucaggcagagugaaccagaagacauagauuguuggugcaacuccacguccacauggguaacuuaugggacguguaccaccacaggagaacauagaagagaaaaaagaucaguggcacucguuccacauguggguaugggauuggagacacgaacugaaacauggaugucgucagaaggggccuggaaacacgcucagagaauugaaaccuggaucuugagacauccaggcuuuaccauaauggcagcaauccuggcauacaccauaggaacgacacauuuccaaaaggcccugauuuucaucuuacugacagcugucgcuccuucaaugacaaugcguugcauaggaauaucaaauagagacuuuguagaagggguuucaggaggaagcuggguugacauagucuuagaacauggaaguugugugacgacaauggcaaaaaacaaaccaacauuggauuuugaacugauaaaaacagaagccaaggaaccugccacucuaaggaaguacuguauagaagcaaagcugaccaacacaacaacagaaucucguugcccaacacaaggggaacccagucuaaaugaagagcaggacaaaagguucgucugcaaacacuccaugguagacaggggauggggaaauggauguggauuauuuggaaagggaggcauugugaccugugcuauguucacaugcaaaaagaacauggaaggaaaaaucgugcaaccagaaaauuuggaauacaccaucgugauaacaccucacucaggagaagagcacgcuguagguaaugacacaggaaaacaugguaaggaaaucaaaauaacaccacagaguuccaucacagaagcagaacugacaggcuauggcacagucacgauggagugcucuccgagaacgggccuugacuucaaugagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuugggaucucaagaaggggccaugcacacggcacucacaggggccacagaaauccagaugucaucaggaaaccuacuauuuacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggagacggcucuccauguaagaucccuuuugaaauaauggauuuggaaaaaagacaugucuuaggucgccugauuacaguuaacccgaucguaacagaaaaagauagcccagucaacauagaagcagaaccuccauucggagacagcuauaucaucauaggaguagagccgggacaauugaaacucaacugguuuaagaaaggaaguuccaucggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugccuucaguggggucucauggacuaugaaaauccucauaggagucaucaucacauggauaggaaugaauucacguagcaccucacugucugugucacuaguauuggugggagucauaacacuguaccuaggagccauggugcaggcugauagugguugcguugugagcuggaaaaacaaagaacugaaaugugguagcgggaucuucaucacagauaacgugcacacauggacagaacaauauaaguuccaaccagaauccccuucaaaacuagcuucagccauccaaaaagcucaugaagaaggcauuuguggaauccgcucaguaacaagauuggagaaucugauguggaaacaaauaacaccagaauugaaucacauucuaucagaaaaugagguaaaguugaccauuaugacaggagacaucaaaggaaucaugcaggcaggaaaacgaucucugcggccccagcccacugagcugaaguauucauggaaaacauggggaaaggcgaaaaugcucuccacagagucucacaaccagaccuuucucauugauggcccugaaacagcagaaugccccaacaaaaacagagcuuggaacucgcuggaaguugaagacuaugguuuuggagucuucaccaccaauauauggcuaaaauugagagaaaaacaggauguguuuugugacucaaaacucaugucagcagccauaaaagacaauagagccguccaugccgauauggguuauuggauagaaagugcacucaaugacacauggaagauggagaaggccucuuuuauugaaguuaaaagcugccacuggccaaagucacacacccucuggaguaauggaguauuagaaagugagaugauaauuccaaaaaguuuugcugggccagugucacaacacaacuacagaccaggcuauuacacgcaaacagcaggaccuuggcaucuagguaagcuugagauggacuuugauuucugcgaaggaacuacagugguggugacugaagacugcggaaauagaggacccucuuuaagaacgaccacugccucuggaaaacucauaacagaauggugcugccgauccugcacauuaccaccucuaagauacagaggugaggauggaugcugguaugggauggaaaucagaccauuaaaagagaaagaagagaauuuagucaacuccuuggucacagccggacaugggcagauugacaacuuuucacuaggagucuuaggaauggcacuauuccuggaagaaaugcucaggacacgaguaggaacgaaacaugcaauacugcuaguugcaguuucuuuugugacauugauuacugggaacauguccuuuagagaccugggaagagugaugguuauggugggcgcuaccaugacggaugacauagguaugggagugacuuaucuugcccuacuagcagcuuucaaaguuagaccaacuuuugcagcuggacuacuacugaaaaagcugaccuccaaggaauuaaugauggcuaccauaggaaucgcacuccuuucucaaagcaccauaccagagaccauucuugaacuaacugaugcguuagccuugggcaugaugguccuuaaaauagugagaaauauggaaaaguaucaauuggcagugacuaucauggccaucucgugcgucccaaaugcagugauacugcaaaacgcauggaaggugagcugcacaauauuggcagcgguguccguuucuccacugcuuuuaacauccucacagcagaaagcggauuggauaccacuggcauugacgauaaaaggucucaauccaacagccauuuuucuaacaacucuuucgagaaccagcaagaaaaggagcuggccgcuaaacgaagcuaucauggcagucgggauggugagcauuuuagccaguucucucuuaaagaaugacauucccaugacagguccauuaguggccggagggcuccuuacuguguguuacgugcucacuggacgaucggccgauuuggaacuggagagagccaccgaugucaaaugggaagaucaggcagaaauaucaggaagcagcccaauccugucaauaacaauaucagaagauggcagcaugucgauaaaaaaugaagaggaagaacaaacacugaccauacucaucagaacgggauugcuagugaucucaggacucuuuccaaugucaauaccaauuacagcagcagcaugguaccugugggaagugaagaaacaacgggcuggaguauugugggacgucccuucacccccacccgugggaaaggccgaacuggaagauggagccuauagaaucaagcaaaaagggauucuuggauauucucagauuggagccggaguuuacaaagaaggaacauuccauacaauguggcacgucacacguggcgcuguucugaugcauagagggaagaggauugaaccaucaugggcggacgucaagaaagaccuaauaucauauggaggaggcuggaagcucgaaggagaauggaaggaaggagaggaaguccaaguccuggcauuggaaccuggaaaaaauccaagagcuguccaaacgaaaccuggacuuuucaaaaccaacaccggaaccauaggcgcuguaucucuggacuuuucccccggaacgucaggaucuccaauugucgauagaaaaggaaaaguugugggucuuuauggcaaugguguugucacaaggaguggagcauacgugagugcuauagcccagaccgagaaaagcauugaagacaauccagagaucgaagaugacauuuuccgaaagaaaagauugaccaucauggaccuccauccaggagcgggaaagacaaaaagauaccuuccagccauaguuagagaggccauaaaacguggcuugagaacauuaauccuggcccccacuagagucguggcagcugaaauggaggaagcucuuagaggacuuccaauaagauaccaaaccccagccaucagagccgagcacaccgggcgggagauuguggaccuaaugugucaugccacauuuacuaugaggcugcuaucaccagucagagugccaaauuacaaccugaucaucauggacgaagcucacuucacagacccagcaaguauagcagcuagaggauacauuucaacucgaguagagaugggugaagcagcugggauuuucaugacagccacuccuccgggaaguagagacccauuuccucagagcaaugcaccaaucauggaugaggaaagagaaaucccugagcguucguggaacucuggacaugaaugggucacggauuuuaaagggaagacuguuugguuuguuccaaguauaaaagcgggaaaugacauagcagcuugucucaggaaaaauggaaagaaagugauacaacucaguaggaagaccuuugacucugaguauguuaagacuaggaccaaugauugggacuuuguggucacaaccgacauuucagaaaugggugccaacuucaaggcugagaggguuauagaccccagacguugcaugaaaccaguuauacuaacagauggcgaagagcgggugaucuuggcaggacccaugccaguaacccacucuagugcagcgcaaagaagagggagaauaggaagaaauccaaaaaaugaaaaugaccaguacauauacaugggggaaccucuggaaaaugaugaagacugugcacauuggaaagaagcuaaaaugcuccuagacaacaucaacacaccugaaggaaucauuccuaguauguucgaaccagagcgugaaaagguggaugccauugauggugaauaccgcuugagaggagaagcaagaaaaaccuuuguggaccuaaugagaagaggggacuuaccagucugguuggccuacagaguggcagcugaaggcaucaacuacgcagacagaaggugguguuuugauggaguuaagaacaaccaaauacuggaagaaaacguggaaguggaaauuuggacaaaagaaggggaaaggaagaaauuaaaacccagaugguuggaugcuaggaucuauucugacccacuggcacuaaaagaauuuaaggaauuugcagcuggaagaaaguccuugacccugaaccuaaucacagaaaugggaaggcuuccaacuuucaugacucagaaggcaagagacgcacuggauaaccuagcugugcugcacacggcugaggcagguggaagggcguacaaucaugcucucagugaacugccggagacccuggagacacugcuuuuacugacacuccuggcuacagucacgggaggaauuuucuuauucuuaaugagcggaaaagguguggggaagaugacccugggaaugugcugcauaaucacggcuagcauccuccuaugguaugcacagauacaaccacacuggauagcagccucaauaauauuggaguucuuucucauaguuuugcucauuccagaaccagaaaaacagagaacaccccaagauaaccaauugaccuacguugucauagccauccucacagugguggccgcaaccauggcaaacgagauggguuuccuggaaaaaaccaagaaagaccucggauugggaagcauugcaacccaggaaccugagagcaacauccuggacauagaucuacguccugcgucagcauggacgcuguaugccguggcuacaacauuugucacaccaauguuaagacauagcauugaaaauuccucagugaaugugucccuaacagccauugcuaaccaagccacagugcuaaugggucuugggaaaggauggccauugucaaagauggacaucggaguuccccuccuugccauuggaugcuacucacaagucaaccccauaacucucacagcagcucuucuuuuauugauagcacauuaugccauuauagggccaggacuucaagcgaaagcaaccagagaagcucagaaaagagcagcagcaggcaucaugaaaaacccaacagucgauggaauaacagugauugaccuagauccaauaccuuaugauccaaaauuugaaaaacaguuaggacaaguaaugcuccuaauucucugcgugacucaaguauuaaugaugaggacuacaugggcucugugugaggcucuaaccuuagcgaccgggcccaucuccacauugugggaagguaauccagggagguuuuggaacacuaccauugcagugucaauggccaacaucuuuagagggagcuacuuggccggagcuggacuucuuuuuuccauuaugaagaacacaacaaauacaagaagaggaacuggcaacauaggagagacgcuuggagagaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaauauggucacaccagaagggaaagugguggaccucgguugcggcagagggggcuggucauacuauugugggggacuaaagaauguaagagaagucaaaggccugacaaaaggaggaccaggacacgaagaacccauccccaugucaacauauggguggaaucuaguacgucugcagaguggaguugauguuuucuucacuccgccagaaaagugugauacauuguugugugacauaggggagucgucaccaaaucccacgauagaagcaggacgaacacucagaguccucagcuugguggaaaauugguugaacaaugacacccaauuuugcauaaagguucucaacccauauaugcccucaguuauagaaaaaauggaaacacugcaaaggaaauauggaggagccuuggugaggaauccacucucacgaaacuccacacaugagauguacuggguauccaaugcuacugggaacauagugucaucagugaacaugauuucaaggaugcugauuaacagauucacaaugaaacacaagaaagccaccuacgagccagauguugaccuagggaguggaacucgcaacauuggaauugaaagugagauaccaaaucuagacauaauaggaaagagaauagagaaaauaaagcaagagcaugaaacaucauggcacuaugaccaagaccacccauacaaaacaugggcuuaccauggcagcuaugaaacaaaacagacuggaucagcaucauccauggugaacggaguggucagacugcugacaaaaccuugggacgucgucccuaugguaacacagauggcaaugacagacacgacuccauuuggacaacagcgcguuuucaaagagaaaguggacacgagaacccaagaaccgaaggaaggcacaaagaaacugaugaaaaucacggcagaguggcuuuggaaagaacuaggaaagaaaaagacacccaggauguguaccagagaagaauucacaagaaaagugagaagcaaugcagccuugggagccauauucacugaugagaacaaauggaagucggcacgcgaggcuguugaagauaguagguucugggagcugguugacaaggaaagaaaucuccaucuugaaggaaagugugaaacauguguguacaacaugaugggaaagagagaaaagaaacuaggggaguucggcaaggcaaaagguagcagagccauaugguacauguggcuuggagcacgcuuccuggaguuugaagccuugggauucuugaaugaagaucacugguucuccagagagaacucccugaguggaguggaaggagaagggcugcacaagcuaggcuacauucuaagagacgugagcaagaaggaaggaggagcaauguacgccgaugauacagcaggaugggacacaagaaucacacuagaagacuuaaaaaaugaagaaaugguaacaaaccacauggaaggagaacacaagaaacuagccgaggccauauuuaaauuaacguaccaaaacaagguggugcgugugcaaagaccaacaccaagaggcacaguaauggauaucauaucgagaagagaccaaagaggcagugggcaagucggcaccuauggccuuaacacuuucaccaauauggaagcccaauuaauuagacagauggagggagaaggaauuuucaaaagcauucagcaccugacagucacagaagaaaucgccguacaggacugguuagcaagaguggggcgugaaagguuaucaagaauggccaucaguggagaugauuguguuguaaaaccuuuagaugacagauuugcaagugcuuuaacagcucuaaaugacaugggaaaaguuaggaaagacauacaacaaugggaaccuucaagaggauggaacgauuggacacaagugccuuucuguucacaccauuuucaugaguuaaucaugaaagacggucgcgugcucguaguuccaugcagaaaccaagaugaacugaucggcagggcccgaauuucccagggagcuggguggucuuugaaggagacggccuguuuggggaagucuuacgcucaaauguggagccugauguacuuccacagacgugaccucaggcuggcggcaaaugcuauuugcucggcagucccgucacauuggguuccaacaagucgaacaaccuggucuauacacgccaaacaugaauggaugacgacggaagacaugcugacaguuuggaacaggguguggauccaagaaaauccauggauggaagacaaaacuccaguggagucaugggaggaagucccauauuugggaaaaagagaagaccaauggugcggcucuuugauugggcuaacaagcagggcuaccugggcaaagaacauccaaacugcaauaaaucaagucagaucccuuauaggcaaugaggaauacacagauuacaugccauccaugaagagauucagaagggaagaggaagaggcagguguccugugguag

SEQ ID NO: 6397 - RNA, 9876 nt, Artificial Sequence
  derived and/or modified CDS sequence (wt) from DENV-2__KF704356__SS-prME
acugcaggcaugaucauuaugcugauuccaacagugauggcguuccauuuaaccacacguaacggagaaccacacaugaucgucaguagacaagagaaagggaaaagucuucuauuuaacacaggggauggugugcacauguguacccucauggccaugcaccuuggugaauugugugaagauacaaucacguacaaguguccucuucucaggcagaaugaaccagaagacauagauuguuggugcaacucuacguccacauggguaacuuacgggacguguaccaccacaggagaacacagaagagaaaaaagaucaguggcacucguuccacaugugggaaugggacuggagacacgaacugaaacauggaugucaucagaaggggccuggaaacaugcccagagaauugaaacuuggaucuugagacauccaggcuuuaccauaauggcagcaauccuggcauacaccauaggaacgacacauuuccaaagagcccugauuuucaucuuacugacagcugucgcuccuucaaugacaaugcguugcauaggaauaucaaauagagacuuuguagaagggguuucaggaggaagcuggguugacauagucuuagaacauggaagcugugugacgacgauggcaaaaaacaaaccaacauuggaucuugaacugauaaaaacagaagccaaacaaccugccacucuaaggaaguacuguauagaggcaaagcugaccaacacaacaacagaaucucgcugcccaacacaaggagaacccagccuaaaugaagagcaggacaaaagguucgucugcaaacacuccaugguggacagaggauggggaaauggauguggacuauuuggaaaaggaagcauugugaccugugcuauguucacaugcaaaaagaucaugaaaggaaaagucgugcaaccagaaaacuuggaauacaccauugugauaacaccucacucaggggaagagcaugcagucggaaaugauacaggaaaacauggcaaggaaaucaaaauaacaccacagaguuccaucacagaagcagaguugacaggcuauggcacugucacgauggagugcucuccgagaacgggccucgacuucaaugagaugguguugcugcaaauggaagauaaagcuuggcuggugcacaggcaaugguuccuagaccugccguugccauggcugcccggagcggacacacaaggaucaaauuggauacagaaagagacauuggucacuuucaaaaauccccaugcgaagaaacaggauguuguuguuuugggaucccaagaaggggccaugcacacagcacucacaggggccacagaaauccagaugucaucaggaaacguacuguucacaggacaucucaagugcaggcugaggauggacaaacuacagcucaaaggaaugucauacucuaugugcacaggaaaguuuaaagucgugaaggaaauagcagaaacacaacauggaacaauaguuaucagaguacaauaugaaggggacgguucuccauguaagaucccuuuugagauaauggauuuggaaaaaagacauguuuuaggucgccugauuacagucaacccaaucguaacaggaaaagauagcccagucaacauagaagcagaaccuccauucggagacagcuacaucaucauaggaguagagccgggacaauugaagcucaacugguuuaagaaaggaaguucuaucggccaaauguuugcgacaacaaugaggggagcgaagagaauggccauuuuaggugacacagcuugggauuuuggaucccugggaggaguguuuacaucuauaggaaaggcucuccaccaaguuuucggagcaaucuauggggcugccuucaguggggucucauggacuaugaaaauccucauaggagucauuaucacauggauaggaaugaauucacgcagcaccucacugucugugucacuaguauuggugggagucgugacgcuguauuugggaguuauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaugaagagggcauuuguggaauccgcucaguaacaagacuggaaaaucugauguggaaacaaauaacaccagaauugaaucacauucuaucagaaaaugaggugaaguugacuauuaugacaggagacaucaaaggaaucaugcaggcaggaaaacgaucucugcggccccagcccaccgagcugaaguauucauggaaaacauggggcaaagcgaaaaugcucucuacagagucucauaaccagaccuuucucauugauggccccgaaacagcagaaugccccaacacaaacagagcuuggaauucgcuggaaguugaagacuauggcuuuggaguauucaccaccaauauauggcuaaaguugagagaagagcaggauguauucugcgacucaaaacucaugucagcggccauaaaagacaacagagccguccaugccgauauggguuauuggauagaaagugcacucaaugacacauggaagauagagaaagccucuuucaucgaaguuaaaagcugccacuggccaaagucacacacccucuggagcaauggagugcuagaaagugagaugauaauuccaaagaauuucgcuggaccagugucacaacacaacuacagaccaggcuaccauacacaaacagcgggaccauggcaucuagguaagcuugagauggacuuugauuucugcgaaggaaccacagugguggugacugaggacuguggaaauagaggacccucuuuaagaacaacuacugccucuggaaaacucauaacagaauggugcugccgaucuugcacauuaccaccgcuaagauacagaggugaggacggaugcugguacgggauggaaaucagaccauugaaagagaaagaagagaauuuggucaacuccuuggucacagccggacaugggcagauugacaacuuuucacuaggagucuugggaauggcauuguuccuggaagaaaugcucaggacccgaguaggaacgaaacaugcaauacuacuaguugcaguuucuuuugugacauugaucacagggaacauguccuuuagagaccugggaagagugaugguuauggugggcgcuacuaugacggaugacauagguaugggcgugacuuaucuugcccuacuagcagccuucaaagucagaccaacuuuugcagcuggacuacucuugagaaaguugaccuccaaggaauugaugaugacuaccauaggaaucguacuccucucccagagcaccauaccagagaccauucuugaacugacugaugcguuagccuugggcaugaugguucucaaaauggugagaaaaauggaaaaguaucaauuggcagugacuaucauggcuaucuugugcgucccaaaugcagugauauuacaaaacacauggaaagugaguugcacaauauuggcagugguguccguuuccccacuguucuuaacauccucacagcagaaagcggauuggauaccauuagcauugacgaucaagggucucaauccaacagcuauuuuucuaacaacccuuucaagaaccaacaagaaaaggagcuggccacuaaaugaggcuaucauggcagucgggauggugagcauuuuggccaguucacuccuaaagaaugacauucccaugacaggaccauuaguggcuggagggcuccucacugugugcuacgugcucacuggacgaucggccgauuuggaacuggagagagccgccgaugucaaaugggaagaucaggcagagauaucaggaagcaguccaauccugucaauaacaauaucagaagaugguagcaugucgauaaaaaacgaagaggaagaacaaacacugaccauacucauuagaacaggauugcuggugaucucaggacuuuuuccuguaucaauaccaaucacugcagcagcaugguaccugugggaagugaagaaacaacgggcuggaguauugugggaugucccuucacccccacccgugggaaaggcugaacuggaagauggagccuauagaaucaagcaaaaagggauucuuggauauucccagaucggagccggaguuuacaaagaaggaacauuccauacaauguggcaugucacacguggcgcuguucuaaugcauaaaggaaagaggauugaaccaucaugggcggacgucaagaaagaccuaauaucauauggaggaggcuggaagcuagaaggagaauggaaggaaggagaagaaguccaggucuuggcauuggagccuggaaaaaauccaagagccguccaaacaaaaccuggucuuuucaaaaccaacgccggaaccauaggugccguaucucuggacuuuucuccuggaaccucaggaucuccaaucaucgacagaaaaggaaaaguugugggucuuuaugguaaugguguuguuacaaggaguggagcauaugugagugcuauagcccagacugaaaaaagcauugaagacaauccagagaucgaagaugacauuuuucgaaagagaaaauugaccaucauggaccuccacccaggagcgggaaagacgaagagauaccuuccagccauagucagagaggcuauaaaacggggccugaggacauuaauccuggcccccacuagagucguggcagcugaaauggaggaagcccuaagaggacuuccaauaagauaccaaaccccagccaucagagcugagcacaccgggcgggagauuguggaccuaaugugucaugccacauucacuaugaggcugcuaucaccaguuagagugccaaauuacaaccugaucaucauggacgaagcccauuucacagacccagcaaguauagcggcuagaggauacaucucaacucgaguagagaugggugaggcagcugggauuuucaugacagccacuccuccgggaagcagagacccauucccucagagcaaugcaccaaucauggaugaagaaagagaaaucccugaacguucguggaguucuggacaugagugggucacggauuuuaaagggaagacuguuugguucguuccaaguauaagagcaggaaaugauauagcagcuugccugagaaaaaauggaaagaaagugauacaacucaguaggaagaccuuugauucugaguaugucaagacuagaaccaaugauugggacuucgugguuacaacugacauuucagaaaugggugccaacuucaaggcugagaggguuauagaccccagacgcugcaugaaaccaguuauacuaacagauggugaagagcgggugauccuggcaggaccuaugccagugacccacucuagugcagcacaaagaagagggagaauaggaagaaauccaaaaaaugaaaaugaccaguacauauacaugggggaaccucuggaaaaugaugaagacugugcacacuggaaagaagcuaaaaugcuccuagauaacaucaacacaccugaaggaaucauuccuagcauguucgaaccagagcgugaaaagguggaugccauugauggugaauaccgcuugagaggagaagcaaggaaaaccuuuguggaccuaaugagaagaggagaccuaccagucugguuggccuacagaguggcagcugaaggcaucaacuacgcagacagaaggugguguuuugauggaauuaagaacaaccaaaucuuggaagaaaauguggagguggaaaucuggacaaaagaaggggaaaggaagaaauuaaaacccagaugguuggaugccaggaucuacucugacccacuggcgcuaaaggaauucaaggaguuugcagcuggaagaaagucccugacccugaaccuaaucacagaaauggguaggcuuccaacuuucaugacucagaaggcaagagacgcacuggacaacuuagcaguguugcacacggcugaagcagguggaagggcguacaaucaugcucucagugaacugccggagacccuggagacauugcuuuuacugacacuucuggcuacagucacaggaggaaucuuuuuauucuugaugagcggaagggguauagggaagaugacccugggaaugugcugcauaaucacggcuaguauucuccuaugguacgcacaaauacagccacacuggauagcagcuucaauaauacuggaguuuuuucucauaguuuugcuuauuccagaaccagaaaagcagagaacaccccaagauaaccaauugaccuacguugucauagccauccucacagugguggccgcaaccauggcaaacgagauggguuuccuggaaaaaacgaagaaagaucucggauugggaagcauuacaacccagcaacccgagagcaacauccuggacauagaucuacgucccgcaucagcauggacgcuguaugcuguggccacaacauuugucacaccaauguugagacacagcauugaaaauuccucagugaacgugucccuaacagcuauugccaaccaagccacaguguuaaugggucuugggaaaggauggccauugucaaagauggacaucggaguuccccuucucgccauuggaugcuacucacaagucaaccccauaacucucacagcagcucuuuucuuacugguagcacauuaugccaucauagggccaggacuccaagcaaaagcaaccagagaagcucagaaaagagcagcagcgggcaucaugaaaaacccaacuguugauggaauaacagugauugaccuagauccaauacccuaugauccaaaguuugaaaagcaguugggacaaguaaugcuccuaguccucugcgugacucaaguguugaugaugaggacuacaugggcucugugugaggcuuuaaccuuagcgaccgggccuaucuccacauugugggaaggaaauccagggagguuuuggaacacuaccauugcagugucaauggcuaacauuuucagagggaguuacuuggccggagcuggacuucucuuuuccaucaugaagaauacaaccaacacgagaaggggaacuggcaacaugggagagacgcuuggagagaaauggaaaagccgauugaacgcauuggggaaaagugaauuccagaucuacaagaaaaguggaauccaggaaguggauagaaccuuagcaaaagaaggcauuaaaagaggagaaacggaccaucacgcugugucgcgaggcucagcaaaacugagaugguucgucgagagaaauauggucacaccagaagggaaaguaguggaccucgguugcggcagaggaggcuggucauacuauugugggggacuaaagaauguaagagaagucaaaggccuaacaaaaggaggaccaggacaugaagaacccauccccaugucaacauauggguggaaucuaguacgucuucaaaguggaguugacguuuucuucacuccgccagaaaagugugacacauuguugugugacauaggggagucgucaccaaaucccacgguagaagcaggacgaacacucagaguccuuaacuuaguggaaaauugguugaacaacaacacccaauuuugcauaaagguucucaacccauacaugcccucagucauagaaaaaauggaagcacuacaaaggaaauauggaggagccuuagugaggaauccacucucacgaaacuccacacaugagauguacuggguauccaaugccuccgggaacauagugucaucagugaacaugauuucaaggauguugaucaacagauucacaaugagacacaagaaagccacuuucgagccagauguagaccucggaagcggaacccgcaacaucggaauugaaagugagauaccaaaccuagacauaaucgggaaaagaauagaaaaaauaaaacaagaguaugaaacaucauggcacuaugaccaagaccacccauacaaaacgugggcuuaccauggcagcuaugaaacaaaacaaacuggaucagcaucauccauggugaacggaguggucagacugcugacaaaaccuugggacgucguccccauggugacacagauggcaaugacagacacgacuccauuuggacaacagcgcguuuuuaaagaaaaaguggacacgagaacccaagaaccgaaagaaggcacaaagaaacuaaugaaaaucacggcagaguggcuuuggaaagaacuagggaagaaaaagacaccuaggaugugcacuagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugaaacauguguguacaacaugaugggaaaaagagagaagaagcuaggggaguucggcaaggcaaaaggcagcagagccauaugguacauguggcuuggagcacgcuucuuagaguuugaagcccuaggauucuugaaugaagaucacugguucuccagagagaacucccugaguggaguggaaggagaagggcugcacaagcuagguuacauuuuaagagacgugagcaagaaagagggaggagcaauguaugccgaugacaccgcaggaugggacacaagaaucacacuagaagaccuaaaaaaugaagaaaugguaacaaaccacauggaaggagaacacaagaaacuagccgaggccauuuucaaauuaacguaccaaaacaagguggugcgugugcaaagaccaacaccaagaggcacaguaauggauaucauaucgagaagagaccaaagagguaguggacaaguugguaccuauggacucaauacuuucaccaauauggaagcccaacuaaucagacagauggagggagaaggagucuucaaaaacauucagcaccugacagucacagaagaaaucgccgugcaaaacugguuagcaagaguagggcgcgaaagguuaucaagaauggccaucaguggagaugauuguguugugaaaccuuuagaugacagguucgcaagcgcuuuaacagcucuaaaugacaugggaaagguuaggaaagacauacaacaaugggaaccuucaagaggauggaacgauuggacacaagugcccuucuguucacaccauuuccaugaguuaaucaugaaagacggccgcguacuuguaguuccaugcagaaaccaagaugaacugauugguagagcccgaauuucccagggagcuggguggucuuugcgagagacggccuguuuggggaaguccuacgcccaaauguggagcuugauguacuuccacagacgugaccucaggcuggcggcuaaugcuauuugcucggcagucccaucacauuggguuccaacaaguagaacaaccugguccauacacgccaaacaugaauggaugacaacggaagacaugcugacagucuggaacaggguguggauucaagaaaacccauggauggaagacaaaacuccaguggaaucaugggaggaaaucccauacuuggggaaaagagaagaccaauggugcggcucauugauugggcuaacaagcagggccaccugggcaaagaacauccaaacagcaauaaaucaaguuagaucccuuauaggcaaugaggaauacacagauuacaugccauccaugaaaagauucagaagagaagaggaagaggcaggaguccugugguag

SEQ ID NO: 6398 - RNA, 9876 nt, Artificial Sequence
  derived and/or modified CDS sequence (wt) from DENV-2__KF704355__SS-prME
acugcaggcaugaucauuaugcugauuccaacagugauggcguuccauuuaaccacacguaacggagaaccacacaugaucgucaguagacaagagaaagggaaaagucuucuauuuaaaacaggggauggugugaacauguguacccucauggccauggaccuuggugaauugugugaagauacaaucacguacaaguguccuuuucucaggcagaaugaaccagaagacauagauuguuggugcaacucuacguccacauggguaacuuacgggacguguaccaccacaggagaacacagaagagaaaaaagaucaguggcacucguuccacaugugggaaugggacuggagacacgaacugaaacauggaugucaucagaaggggccuggaaacaugcccagagaauugaaacuuggaucuugagacauccaggcuuuaccauaauggcagcaauccuggcauacaccauaggaacgacacauuuccaaagagcccugauuuucaucuuacugacagcugucgcuccuucaaugacaaugcguugcauaggaauaucaaauagagacuuuguagaagggguuucaggaggaagcuggguugacauagucuuagaacauggaagcugugugacgacgauggcaaaaaacaaaccaacauuggaucuugaacugauaaaaacagaagccaaacaaccugccacucuaaggaaguacuguauagaggcaaagcugaccaacacaacaacagaaucucgcugcccaacacaaggagaacccagccuaaaugaagagcaggacaaaagguucgucugcaaacacuccaugguggacagaggauggggaaauggauguggacuauuuggaaaaggaagcauugugaccugugcuauguucacaugcaaaaagaucaugaaaggaaaagucgugcaaccagaaaacuuggaauacaccauugugauaacaccucacucaggggaagagcaugcagucggaaaugauacaggaaaauauggcaaggaaaucaaaauaacaccacagaguuccaucacagaagcagaguugacaggcuauggcacugucacgauggagugcucuccgagaacgggccucgacuucaaugagaugguguugcugcaaauggaagauaaagcuuggcuggugcacaggcaaugguuccuagaccugccguugccauggcugcccggagcggacacacaaggaucaaauuggauacagaaagagacauuggucacuuucaaaaauccccaugcgaagaaacaggauguuguuguuuugggaucccaagaaggggccaugcacacagcacucacaggggccacagaaauccagaugucaucaggaaacguacuguucacaggacaucucaagugcaggcugaggauggacaaacuacagcucaaaggaaugucauacucuaugugcacaggaaaguuuaaagucgugaaggaaauagcagaaacacaacauggaacaauaguuaucagaguacaauaugaaggggacgguucuccauguaagaucccuuuugagauaauggauuuggaaaaaagacauguuuuaggucgccugauuacagucaacccaaucguaacaggaaaagauagcccagucaacauagaagcagaaccuccauucggagacagcuacaucaucauaggaguagagccgggacaauugaagcucaacugguuuaagaaaggaaguucuaucggccaaauguuugggacaacaaugaggggagcgaagagaauggccauuuuaggugacacagcuugggauuuuggaucccugggaggaguguuuacaucuauaggaaaggcucuccaccaaguuuucggagcaaucuauggggcugccuucaguggggucucauggacuaugaaaauccucacaggagucauuaucacauggauaggaaugaauucacgcagcaccucacugucugugucacuaguauuggugggagucgugacgcuguauuugggaguuauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaugaagagggcauuuguggaauccgcucaguaacaagacuggaaaaucugauguggaaacaaauaacaccagaauugaaucacauucuaucagaaaaugaggugaaguugacuauuaugacaggagacaucaaaggaaucaugcaggcaggaaaacgaucucugcggccccagcccacugagcugaaguauucauggaaaacauggggcaaagcgaaaaugcucucuacagagucucauaaccagaccuuucucauugauggccccgaaacagcagaaugccccaacacaaacagagcuuggaauucgcuggaaguugaagacuauggcuuuggaguauucaccaccaauauauggcuaaaguugagagaaaagcaggauguauucugcgacucaaaacucaugucagcggccauaaaagacaacagagccguccaugccgauauggguuauuggauagaaagugcacucaaugacacauggaagauagagaaagccucuuucaucgaaguuaaaagcugccacuggccaaagucacacacccucuggagcaauggagugcuagaaagugagaugauaauuccaaagaauuucgcuggaccagugucacaacacaacuacagaccaggcuaccauacacaaacagcgggaccauggcaucuagguaagcuugagauggacuuugauuucugcgaaggaaccacagugguggugacugaggacuguggaaauagaggacccucuuuaagaacaacuacugccucuggaaaacucauaacagaauggugcugccgaucuugcacauuaccaccgcuaagauacagaggugaggacggaugcugguacgggauggaaaucagaccauugaaagagaaagaagagaauuuggucaacuccuuggucacagccggacaugggcagauugacaacuuuucacuaggagucuugggaauggcauuguuccuggaagaaaugcucaggacccgaguaggaacgaaacaugcaauacuacuaguugcaguuucuuuugugacauugaucacagggaacauguccuuuagagaccugggaagagugaugguuauggugggcgcuacuaugacggaugacauagguaugggcgugacuuaucuugcccuacuagcagccuucaaagucagaccaacuuuugcagcuggacuacucuugagaaaguugaccuccaaggaauugaugaugacuaccauaggaaucguacuccucucccagagcaccauaccagagaccauucuugaacugacugaugcguuagccuugggcaugaugguucuuaaaauggugagaaaaauggaaaaguaucaauuggcagugacuaucauggccaucuugugcgucccaaaugcugugauauuacaaaacgcauggaaagugaguugcacaauauuggcagugguguccguuuccccacuguucuuaacauccucacagcagaaagcggauuggauaccauuagcauugacgaucaagggucucaauccaacagcuauuuuucuaacaacccuuucaagaaccaacaagaaaaggagcuggccacuaaaugaggcuaucauggcagucgggauggugagcauuuuggccaguucucuccuaaagaaugacauucccaugacaggaccauugguggcuggagggcuccucacugugugcuacgugcucacuggacgaucggccgauuuggaacuggagagagccgccgaugucaaaugggaagaucaggcagagauaucaggaagcaguccaauccugucaauaacaauaucagaagaugguagcaugucgauaaaaaacgaagaggaagaacaaacacugaccauacucauuagaacaggauugcuggugaucucaggacuuuuuccuguaucaauaccaaucacggcagcagcaugguaccugugggaagugaagaaacaacgggcuggaguauugugggaugucccuucacccccacccgugggaaaggcugaacuggaagauggagccuauagaaucaagcaaaaagggauucuuggauauucccagaucggagccggaguuuacaaagaaggaacauuccauacaauguggcaugucacacguggcgcuguucuaaugcauaaaggaaagaggauugaaccaucaugggcggacgucaagaaagaccuaauaucauauggaggaggcuggaagcuagaaggagaauggaaggaaggagaagaaguccaggucuuggcauuggagccuggaaaaaauccaagagccguccaaacaaaaccuggucuuuucaaaaccaacgccggaaccauaggugccguaucucuggacuuuucuccuggaaccucaggaucuccaaucaucgacagaaaaggaaaaguugugggucuuuaugguaaugguguuguuacaaggaguggagcauaugugagugcuauagcccagacugaaaaaagcauugaagacaauccagagaucgaagaugacauuuuucgaaagagaaaauugaccaucauggaccuccacccaggagcgggaaagacgaagagauaccuuccagccauagucagagaggcuauaaaacggggccugaggacauuaauccuggcccccacuagagucguggcagcugaaauggaggaagcccuaagaggacuuccaauaagauaccaaaccccagccaucagagcugagcacaccgggcgggagauuguggaccuaaugugucaugccacauucacuaugaggcugcuaucaccaguuagagugccaaauuacaaccugaucaucauggacgaagcccauuucacagacccagcaaguauagcggcuagaggauacaucucaacucgaguagagaugggugaggcagcugggauuuucaugacagccacuccuccgggaagcagagacccauucccucagagcaaugcaccaaucauggaugaagaaagagaaaucccugaacguucguggaguucuggacaugagugggucacggauuuuaaagggaagacuguuugguucguuccaaguauaagagcaggaaaugauauagcagcuugccugagaaaaaauggaaagaaagugauacaacucaguaggaagaccuuugauucugaguaugucaagacuagaaccaaugauugggacuucgugguuacaacugacauuucagaaaugggugccaacuucaaggcugagaggguuauagaccccagacgcugcaugaaaccaguuauacuaacagauggugaagagcgggugauccuggcaggaccuaugccagugacccacucuagugcagcacaaagaagagggagaauaggaagaaauccaaaaaaugaaaaugaccaguacauauacaugggggaaccucuggaaaaugaugaagacugugcacacuggaaagaagcuaaaaugcuccuagauaacaucaacacaccugaaggaaucauuccuagcauguucgaaccagagcgugaaaagguggaugccauugauggugaauaccgcuugagaggagaagcaaggaaaaccuuuguggaccuaaugagaagaggagaccuaccagucugguuggccuacagaguggcagcugaaggcaucaacuacgcagacagaaggugguguuuugauggaauuaagaacaaccaaaucuuggaagaaaauguggagguggaaaucuggacaaaagaaggggaaaggaagaaauuaaaacccagaugguuggaugccaggaucuacucugacccacuggcgcuaaaggaauucaaggaguuugcagcuggaagaaagucccugacccugaaccuaaucacagaaauggguaggcuuccaacuuucaugacucagaaggcaagagacgcacuggacaacuuagcaguguugcacacggcugaagcagguggaagggcguacaaucaugcucucagugaacugccggagacccuggagacauugcuuuuacugacacuucuggcuacagucacaggaggaaucuuuuuauucuugaugagcggaagggguauagggaagaugacccugggaaugugcugcauaaucacggcuaguauucuccuaugguacgcacaaauacagccacacuggauagcagcuucaauaauacuggaguuuuuucucauaguuuugcuuauuccagaaccagaaaagcagagaacaccccaagauaaccaauugaccuacguugucauagccauccucacagugguggccgcaaccauggcaaacgagauggguuuccuggaaaaaacgaagaaagaucucggauugggaagcaucacaacccagcaacccgagagcaacauccuggacauagaucuacgucccgcaucagcauggacgcuguaugcuguggccacaacauuugucacaccaauguugagacacagcauugaaaauuccucagugaacgugucccuaacagcuauugccaaccaagccacaguguuaaugggucuugggaaaggauggccauugucaaagauggacaucggaguuccccuucucgccauuggaugcuacucacaagucaaccccauaacucucacagcagcucuuuucuuacugguagcacauuaugccaucauagggccaggacuccaagcaaaagcaaccagagaagcucagaaaagagcagcagcgggcaucaugaaaaacccaacuguugauggaauaacagugauugaccuagauccaauacccuaugauccaaaguuugaaaagcaguugggacaaguaaugcuccuaguccucugcgugacucaaguguugaugaugaggacuacaugggcucugugugaggcuuuaaccuuagcgaccgggccuaucuccacauugugggaaggaaauccagggagguuuuggaacacuaccauugcagugucaauggcuaacauuuucagagggaguuacuuggccggagcuggacuucucuuuuccaucaugaagaauacaaccaacacgagaaggggaacuggcaacauaggagagacgcuuggagagaaauggaaaagccgauugaacgcauuggggaaaagugaauuccagaucuacaagaaaaguggaauccaggaaguggauagaaccuuagcaaaagaaggcauuaaaagaggagaaacggaccaucacgcugugucgcgaggcucagcaaaacugagaugguucgucgagagaaauauggucacaccagaagggaaaguaguggaccucgguugcggcagaggaggcuggucauacuauugugggggacuaaagaauguaagagaagucaaaggccuaacaaaaggaggaccaggacaugaagaacccauccccaugucaacauauggguggaaucuaguacgucuucaaaguggaguugacguuuucuucacuccgccagaaaagugugacacauuguugugugacauaggggagucgucaccaaaucccacgguagaagcaggacgaacacucagaguccuuaacuuaguggaaaauugguugaacaacaacacccaauuuugcauaaagguucucaacccauacaugcccucagucauagaaaaaauggaagcacuacaaaggaaauauggaggagccuuagugaggaauccacuuucacgaaacuccacacaugagauguacuggguauccaaugccuccgggaacauagugucaucagugaacaugauuucaaggauguugaucaacagauucacaaugagacacaagaaagccacuuacgagccagauguagaccucggaagcggaacccgcaacaucggaauugaaagugagauaccaaaccuagacauaaucgggaaaagaauagaaaaaauaaaacaagaguaugaaacaucauggcacuaugaccaagaccacccauacaaaacgugggcuuaccauggcagcuaugaaacaaaacaaacuggaucagcaucauccauggugaacggaguggucagacugcugacaaaaccuugggacgucguccccauggugacacagauggcaaugacagacacgacuccauuuggacaacagcgcguuuuuaaagaaaaaguggacacgagaacccaagaaccgaaagaaggcacaaagaaacuaaugaaaaucacggcagaguggcuuuggaaagaacuagggaagaaaaagacaccuaggaugugcacuagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugaaacauguguguacaacaugaugggaaaaagagagaagaagcuaggggaguucggcaaggcaaaaggcagcagagccauaugguacauguggcuuggagcacgcuucuuagaguuugaagcccuaggauucuugaaugaagaucacugguucuccagagagaacucccugaguggaguggaaggagaagggcugcacaagcuaggauacaucuuaagagacgugagcaagaaagagggaggagcaauguaugccgaugacaccgcaggaugggacacaagaaucacacuagaagaccuaaaaaaugaagaaaugguaacaaaccacauggaaggagaacacaagaaacuagccgaggccauuuucaaauuaacguaccaaaacaagguggugcgugugcaaagaccaacaccaagaggcacaguaauggauaucauaucgagaagagaccaaagagguaguggacaaguugguaccuauggacucaauacuuucaccaauauggaagcccaacuaaucagacagauggagggagaaggagucuucaaaaacauucagcaccugacagucacagaagaaaucgccgugcaaaacugguuagcaagaguagggcgcgaaagguuaucaagaauggccaucaguggagaugauuguguugugaaaccuuuagaugacagguucgcaagcgcuuuaacagcucuaaaugacaugggaaagguuaggaaagacauacaacaaugggaaccuucaagaggauggaacgauuggacacaagugcccuucuguucacaccauuuccaugaguuaaucaugaaagacggccgcguacuuguaguuccaugcagaaaccaagaugaacugauugguagagcccgaauuucccaaggagcuggguggucuuugcgagagacggccuguuuggggaaguccuacgcccaaauguggagcuugauguacuuccacagacgugaccucaggcuggcggcuaaugcuauuugcucggcagucccaucacauuggguuccaacaaguagaacaaccugguccauacacgccaaacaugaauggaugacaacggaagacaugcugacagucuggaacaggguguggauucaagaaaacccauggauggaagacaaaacuccaguggaaucaugggaggaaaucccauacuuggggaaaagagaagaccaauggugcggcucauugauugggcuaacaagcagggccaccugggcaaagaacauccaaacagcaauaaaucaaguuagaucccuuauaggcaaugaggaauacacagauuacaugccauccaugaaaagauucagaagagaagaggaagaggcaggaguccugugguag

SEQ ID NO: 6399 - RNA, 9876 nt, Artificial Sequence
  derived and/or modified CDS sequence (wt) from DENV-2__KF704354__SS-prME
acugcaggcaugaucauuaugcugauuccaacagugauggcguuccauuuaaccacacguaacggagaaccacacaugaucgucaguagacaagagaaagggaaaagucuucuauuuaaaacagaggauggugugaacauguguacccucauggccauggaccuuggugaauugugugaagauacaaucacguacaaguguccuuuucucaggcagaaugaaccagaagacauagauuguuggugcaacucuacguccacauggguaacuuacgggacguguaccaccacaggagaacacagaagagaaaaaagaucaguggcacucguuccacaugugggaaugggacuggagacacgaacugaaacauggaugucaucagaaggggccuggaaacaugcccagagaauugaaacuuggaucuugagacauccaggcuuuaccauaauggcagcaauccuggcauacaccauaggaacgacacauuuccaaagagcccugauuuucaucuuacugacagcugucgcuccuucaaugacaaugcguugcauaggaauaucaaauagagacuuuguagaagggguuucaggaggaagcuggguugacauagucuuagaacauggaagcugugugacgacgauggcaaaaaacaaaccaacauuggauuuugaacugauaaaaacagaagccaaacaaccugccacucuaaggaaguacuguauagaggcaaagcugaccaacacaacaacagaaucucgcugcccaacacaaggagaacccagccuaaaugaagagcaggacaaaagguucgucugcaaacacuccaugguggacagaggauggggaaauggauguggacuauuuggaaaaggaggcauugugaccugugcuauguucacaugcaaaaagaucaugaaaggaaaagucgugcaaccagaaaacuuggaauacaccauugugauaacaccucacucaggggaagagcaugcagucggaaaugauacaggaaaacauggcaaggaaaucaaaauaacaccacagaguuccaucacagaagcagaguugacaggcuauggcacugucacgauggagugcucuccgagaacgggccucgacuucaaugagaugguguugcugcaaauggaaaauaaagcuuggcuggugcacaggcaaugguuccuagaccugccguugccauggcugcccggagcggacacacaaggaucaaauuggauacagaaagagacauuggucacuuucaaaaauccccaugcgaagaaacaggauguuguuguuuugggaucccaagaaggggccaugcacacagcacucacaggggccacagaaauccagaugucaucaggaaacguacuguucacaggacaucucaagugcaggcugaggauggacaaacuacagcucaaaggaaugucauacucuaugugcacaggaaaguuuaaagucgugaaggaaauagcagaaacacaacauggaacaauaguuaucagaguacaauaugaaggggacgguucuccauguaagaucccuuuugagauaauggauuuggaaaaaagacauguuuuaggucgccugauuacagucaacccaaucguaacaggaaaagauagcccagucaacauagaagcagaaccuccauucggagacagcuacaucaucauaggaguagagccgggacaauugaagcucaacugguuuaagaaaggaaguucuaucggccaaauguuugcgacaacaaugaggggagcgaagagaauggccauuuuaggugacacagcuugggauuuuggaucccugggaggaguguuuacaucuauaggaaaggcucuccaccaaguuuucggagcaaucuauggggcugccuucaguggggucucauggacuaugaaaauccucauaggagucauuaucacauggauaggaaugaauucacgcagcaccucacugucugugucacuaguauuggugggagucgugacgcuguauuugggaguuauggugcaggccgauagugguugcguugugagcuggaaaaacaaagaacugaaauguggcaguggaauuuucaucacagacaacgugcacacauggacagaacaauacaaguuccaaccagaauccccuucaaaacuagcuucagcuauccagaaagcucaugaagagggcauuuguggaauccgcucaguaacaagacuggaaaaucugauguggaaacaaauaacaccagaauugaaucacauucuaucagaaaaugaggugaaguugacuauuaugacaggagacaucaaaggaaucaugcaggcaggaaaacgaucucugcggccccagcccaccgagcugaaguauucauggaaaacauggggcaaagcgaaaaugcucucuacagagucucauaaccagaccuuucucauugauggccccgaaacagcagaaugccccaacacaaacagagcuuggaauucgcuggaaguugaagacuauggcuuuggaguauucaccaccaauauauggcuaaaguugagagaagagcaggauguauucugcgacucaaaacucaugucagcggccauaaaagacaacagagccguccaugccgauauggguuauuggauagaaagugcacucaaugacacauggaagauagagaaagccucuuucaucgaaguuaaaagcugccacuggccaaagucacacacccucuggaguaauggagugcuagaaagugagaugauaauuccaaagaauuucgcuggaccagugucacaacacaacuacagaccaggcuaccauacacaaacagcgggaccauggcaucuagguaagcuugagauggacuuugauuucugcgaaggaaccacagugguggugacugaggacuguggaaauagaggacccucuuuaagaacaacuacugccucuggaaaacucauaacagaauggugcugccgaucuugcacauuaccaccgcuaagauacagaggugaggacggaugcugguacgggauggaaaucagaccauugaaagagaaagaagagaauuuggucaacuccuuggucacagccggacaugggcagauugacaacuuuucacuaggagucuugggaauggcauuguuccuggaagaaaugcucaggacccgaguaggaacgaaacaugcaauacuacuaguugcaguuucuuuugugacauugaucacagggaacauguccuuuagagaccugggaagagugaugguuauggugggcgcuacuaugacggaugacauagguaugggcgugacuuaucuugcccuacuagcagccuucaaagucagaccaacuuuugcagcuggacuacucuugagaaaguugaccuccaaggaauugaugaugacuaccauaggaaucguacuccucucccagagcaccauaccagagaccauucuugaacugacugaugcguuagccuugggcaugaugguccucaaaauggugagaaaaauggaaaaguaucaauuggcagugacuaucauggcuaucuugugcgucccaaaugcagugauauuacaaaacacauggaaagugaguugcacaauauuggcagugguguccguuuccccacuguucuuaacauccucacagcagaaagcggauuggauaccauuagcauugacgaucaagggucucaauccaacagcuauuuuucuaacaacccuuucaagaaccaacaagaaaaggagcuggccacuaaaugaggcuaucauggcagucgggauggugagcauuuuggccaguucacuccuaaagaaugacauucccaugacaggaccauuaguggcuggagggcuccucacugugugcuacgugcucacuggacgaucggccgauuuggaacuggagagagccgccgaugucaaaugggaagaucaggcagagauaucaggaagcaguccaauccugucaauaacaauaucagaagaugguagcaugucgauaaaaaacgaagaggaagaacaaacacugaccauacucauuagaacaggauugcuggugaucucaggacuuuuuccuguaucaauaccaaucacugcagcagcaugguaccugugggaagugaagaaacaacgggcuggaguauugugggaugucccuucacccccacccgugggaaaggcugaacuggaagauggagccuauagaaucaagcaaaaagggauucuuggauauucccagaucggagccggaguuuacaaagaaggaacauuccauacaauguggcaugucacacguggcgcuguucuaaugcauaaaggaaagaggauugaaccaucaugggcggacguuaagaaagaccuaauaucauauggaggaggcuggaggcuagaaggagaauggaaggaaggagaagaaguccaggucuuggcauuggagccuggaaaaaauccaagagccguccaaacaaaaccuggucuuuucaaaaccaacgccggaaccauaggugccguaucucuggacuuuucuccuggaaccucaggaucuccaaucaucgacaaaaaaggaaaaguugugggucuuuaugguaaugguguuguuacaaggaguggagcauaugugagugcuauagcccagacugaaaaaagcauugaagacaauccagagaucgaagaugacauuuuucgaaagagaaaauugaccaucauggaccuccacccaggagcgggaaagacgaagagauaccuuccagccauagucagagaggcuauaaaacggggccugaggacauuaauccuggcccccacuagagucguggcagcugaaauggaggaagcccuaagaggacuuccaauaagauaccaaaccccagccaucagagcugagcacaccgggcgggagauuguggaccuaaugugucaugccacauucacuaugaggcugcuaucaccaguuagagugccaaauuacaaccugaucaucauggacgaagcccauuucacagacccagcaaguauagcggcuagaggauacaucucaacucgaguagagaugggugaggcagcugggauuuucaugacagccacuccuccgggaagcagagacccauucccucagagcaaugcaccaaucauggaugaagaaagagaaaucccugaacguucguggaguucuggacaugagugggucacggauuuuaaagggaagacuguuugguucguuccaaguauaaaagcaggaaaugauauagcagcuugccugagaaaaaauggaaagaaagugauacaacucaguaggaagaccuuugauucugaguaugucaagacuagaaccaaugauugggacuucgugguuacaacugacauuucagaaaugggugccaacuucaaggcugagaggguuauagaccccagacgcugcaugaaaccaguuauacuaacagauggugaagagcgggugauccuggcaggaccuaugccagugacccacucuagugcagcacaaagaagagggagaauaggaagaaauccaaaaaaugaaaaugaccaguacauauacaugggggaaccucuggaaaaugaugaagacugugcacacuggaaagaagcuaaaaugcuccuagauaacaucaacacaccugaaggaaucauuccuagcauguucgaaccagagcgugaaaagguggaugccauugauggugaauaccgcuugagaggagaagcaaggaaaaccuuuguggaccuaaugagaagaggagaccuaccagucugguuggccuacagaguggcagcugaaggcaucaacuacgcagacagaaggugguguuuugauggaauuaagaacaaccaaaucuuggaagaaaauguggagguggaaaucuggacaaaagaaggggaaaggaagaaauuaaaacccagaugguuggaugccaggaucuacucugacccacuggcgcuaaaggaauucaaggaguuugcagcuggaagaaagucccugacccugaaccuaaucacagaaauggguaggcuuccaacuuucaugacucagaaggcaagagacgcacuggacaacuuagcaguguugcacacggcugaagcagguggaagggcguacaaucaugcucucagugaacugccggagacccuggagacauugcuuuuacugacacuucuggcuacagucacaggaggaaucuuuuuauucuugaugagcggaagggguauagggaagaugacccugggaaugugcugcauaaucacggcuaguauucuccuaugguacgcacaaauacagccacacuggauagcagcuucaauaauacuggaguuuuuucucauaguuuugcuuauuccagaaccagaaaagcagagaacaccccaagauaaccaauugaccuacguugucauagccauccucacagugguggccgcaaccauggcaaacgagauggguuuccuggaaaaaacgaagaaagaucucggauggggaagcauuacaacccagcaacccgagagcaacauccuggacauagaucuacgucccgcaucagcauggacgcuguaugcuguggccacaacauuugucacaccaauguugagacacagcauugaaaauuccucagugaacgugucccuaacagcuauugccaaccaagccacaguguuaaugggucuugggaaaggauggccauugucaaagauggacaucggaguuccccuucucgccauuggaugcuacucacaagucaaccccauaacucucacagcagcucuuuucuuacugguagcacauuaugccaucauagggccaggacuccaagcaaaagcaaccagagaagcucagaaaagagcagcagcgggcaucaugaaaaacccaacuguugauggaauaacagugauugaccuagauccaauacccuaugauccaaaguuugaaaagcaguugggacaaguaaugcuccuaguccucugcgugacucaaguguugaugaugaggacuacaugggcucugugugaggcuuuaaccuuagcgaccgggccuaucuccacauugugggaaggaaauccagggagguuuuggaacacuaccauugcagugucaauggcuaacauuuuuagagggaguuacuuggccggagcuggacuucucuuuuccaucaugaagaauacaaccaacacgagaaggggaacuggcaacaugggagagacgcuuggagagaaauggaaaagccgauugaacgcauuggggaaaagugaauuccagaucuacaagaaaaguggaauccaggaaguggauagaaccuuagcaaaagaaggcauuaaaagaggagaaacggaccaucacgcugugucgcgaggcucagcaaaacugagaugguucgucgagagaaauauggucacaccagaagggaaaguaguggaccucgguugcggcagaggaggcuggucauacuauugugggggacuaaagaauguaagagaagucaaaggccuaacaaaaggaggaccaggacaugaagaacccauccccaugucaacauauggguggaaucuaguacgucuucaaaguggaguugacguuuucuucacuccgccagaaaagugugacacauuguugugugacauaggggagucgucaccaaaucccacgguagaagcaggacgaacacucagaguccuuaacuuaguggaaaauugguugaacaacaacacccaauuuugcauaaagguucucaacccauacaugcccucagucauagagaaaauggaagcacuacaaaggaaauauggaggagccuuagugaggaauccacucucacgaaacuccacacaugagauguacuggguauccaaugccuccgggaacauagugucaucagugaacaugauuucaaggauguugaucaacagauucacaaugagacacaagaaagccacuuucgagccagauguagaccucggaagcggaacccgcaacaucggaauugaaagugagauaccaaaccuagacauaaucgggaaaagaauagaaaaaauaaaacaagaguaugaaacaucauggcacuaugaccaagaccacccauacaaaacgugggcuuaccauggcagcuaugaaacaaaacaaacuggaucagcaucauccauggugaacggaguggucagacugcugacaaaaccuugggacgucguccccaugguaacacagauggcaaugacagacacgacuccauuuggacaacagcgcguuuuuaaagaaaaaguggacacgagaacccaagaaccgaaagaaggcacaaagaaacuaaugaaaaucacggcagaguggcuuuggaaagaacuagggaagaaaaagacaccuaggaugugcacuagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugaaacauguguguacaacaugaugggaaaaagagagaagaagcuaggggaguucggcaaggcaaaaggcagcagagccauaugguacauguggcuuggagcacgcuucuuagaguuugaagcccuaggauucuugaaugaagaucacugguucuccagagagaacucccugaguggaguggaaggagaagggcugcacaagcuagguuacauuuuaagagacgugagcaagaaagagggaggagcaauguaugccgaugacaccgcaggaugggacacaagaaucacacuagaagaccuaaaaaaugaagaaaugguaacaaaccacauggaaggagaacacaagaaacuagccgaggccauuuucaaauuaacguaccaaaacaagguggugcgugugcaaagaccaacaccaagaggcacaguaauggauaucauaucgagaagagaccaaagagguaguggacaaguugguaccuauggacucaauacuuucaccaauauggaagcccaacuaaucagacagauggagggagaaggagucuucaaaaacauucagcaccugacagucacagaagaaaucgccgugcaaaacugguuagcaagaguagggcgcgaaagguuaucaagaauggccaucaguggagaugauuguguugugaaaccuuuagaugacagguucgcaagcgcuuuaacagcucuaaaugacaugggaaagguuaggaaagacauacaacaaugggaaccuucaagaggauggaacgauuggacacaagugcccuucuguucacaccauuuccaugaguuaaucaugaaagacggccgcguacuuguaguuccaugcagaaaccaagaugaacugauugguagagcccgaauuucccagggagcuggguggucuuugcgagagacggccuguuuggggaaguccuacgcccaaauguggagcuugauguacuuccacagacgugaccucaggcuggcggcuaaugcuauuugcucggcagucccaucacauuggguuccaacaaguagaacaaccugguccauacacgccaaacaugaauggaugacaacggaagacaugcugacagucuggaacaggguguggauucaagaaaacccauggauggaagacaaaacuccaguggaaucaugggaggaaaucccauacuuggggaaaagagaagaccaauggugcggcucauugauugggcuaacaagcagggccaccugggcaaagaacauccaaacagcaauaaaucaaguuagaucccuuauaggcaaugaggaauacacagauuacaugccauccaugaaaagauucagaagagaagaggaagaggcaggaguccugugguag

SEQ ID NO: 6400 - RNA, 9876 nt, Artificial Sequence
  derived and/or modified CDS sequence (wt) from DENV-2__KF704357__SS-prME
acugcaggcaugaucauuaugcugauuccaacagugauggcguuccauuuaaccacacguaacggagaaccacacaugaucgucaguagacaagagaaagggaaaagucuucuauuuaaaacaggggauggugugaacauguguacccucauggccauggaccuuggugaauugugugaagauacaaucacguacaaguguccucuucucaggcagaaugaaccagaagacauagauuguuggugcaacucuacguccacauggguaacuuacgggacguguaccaccacaggagaacacagaagagaaaaaagaucaguggcacucguuccacaugugggaaugggacuggagacacgaacugaaacauggaugucaucagaaggggccuggaaacaugcccagagaauugaaacuuggaucuugagacauccaggcuuuaccauaauggcagcaauccuggcauacaccauaggaacgacacauuuccaaagagcccugauuuucaucuuacugacagcugucgcuccuucaaugacaaugcguugcauaggaauaucaaauagagacuuuguagaagggguuucaggaggaagcuggguugacauagucuuagaacauggaagcugugugacgacgauggcaaaaaacaaaccaacauuggaucuugaacugauaaaaacagaagccaaacaaccugccacucuaaggaaguacuguauagaggcaaagcugaccaacacaacaacagaaucucgcugcccaacacaaggagaacccagccuaaaugaagagcaggacaaaagguucgucugcaaacacuccaugguggacagaggauggggaaauggauguggacuauuuggaaaaggaagcauugugaccugugcuauguucacaugcaaaaagaucaugaaaggaaaagucgugcaaccagaaaacuuggaauacaccauugugauaacaccucacucaggggaagagcaugcagucggaaaugauacaggaaaacauggcaaggaaaucaaaauaacaccacagaguuccaucacagaagcagaguugacaggcuauggcacugucacgauggagugcucuccgagaacgggccucgacuucaaugagaugguguugcugcaaauggaagauaaagcuuggcuggugcacaggcaaugguuccuagaccugccguugccauggcugcccggagcggacacacaaggaucaaauuggauacagaaagagacauuggucacuuucaaaaauccccaugcgaagaaacaggauguuguuguuuugggaucccaagaaggggccaugcacacagcacucacaggggccacagaaauccagaugucaucaggaaacguacuguucacaggacaucucaagugcaggcugaggauggacaaacuacagcucaaaggaaugucauacucuaugugcacaggaaaguuuaaagucgugaaggaaauagcagaaacacaacauggaacaauaguuaucagaguacaauaugaaggggacgguucuccauguaagaucccuuuugagauaauggauuuggaaaaaagacauguuuuaggucgccugauuacagucaacccaaucguaacaggaaaagauagcccagucaacauagaagcagaaccuccauucggagacagcuacaucaucauaggaguagagccgggacaauugaagcucaacugguuuaagaaaggaaguucuaucggccaaauguuugcgacaacaaugaggggagcgaagagaauggccauuuuaggugacacagcuugggauuuuggaucccugggaggaguguuuacaucuauaggaaaggcucuccaccaaguuuucggagcaaucuauggggcugccuucaguggggucucauggacuaugaaaauccucauaggagucauuaucacauggauaggaaugaauucacgcagcaccucacugucugugucacuaguauuggugggagucgugacgcuguauuugggaguuauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaugaagagggcauuuguggaauccgcucaguaacaagacuggaaaaucugauguggaaacaaauaacaccagaauugaaucacauucuaucagaaaaugaggugaaguugacuauuaugacaggagacaucaaaggaaucaugcaggcaggaaaacgaucucugcggccccagcccaccgagcugaaguauucauggaaaacauggggcaaagcgaaaaugcucucuacagagucucauaaccagaccuuucucauugauggccccgaaacagcagaaugccccaacacaaacagagcuuggaauucgcuggaaguugaagacuauggcuuuggaguauucaccaccaauauauggcuaaaguugagagaagagcaggauguauucugcgacucaaaacucaugucagcggccauaaaagacaacagagccguccaugccgauauggguuauuggauagaaagugcacucaaugacacauggaagauagagaaagccucuuucaucgaaguuaaaagcugccacuggccaaagucacacacccucuggagcaauggagugcuagaaagugagaugauaauuccaaagaauuucgcuggaccagugucacaacacaacuacagaccaggcuaccauacacaaacagcgggaccauggcaucuagguaagcuugagauggacuuugauuucugcgaaggaaccacagugguggugacugaggacuguggaaauagaggacccucuuuaagaacaacuacugccucuggaaaacucauaacagaauggugcugccgaucuugcacauuaccaccgcuaagauacagaggugaggacggaugcugguacgggauggaaaucagaccauugaaagagaaagaagagaauuuggucaacuccuuggucacagccggacaugggcagauugacaacuuuucacuaggagucuugggaauggcauuguuccuggaagaaaugcucaggacccgaguaggaacgaaacaugcaauacuacuaguugcaguuucuuuugugacauugaucacagggaacauguccuuuagagaccugggaagagugaugguuauggugggcgcuacuaugacggaugacauagguaugggcgugacuuaucuugcccuacuagcagccuucaaagucagaccaacuuuugcagcuggacuacucuugagaaaguugaccuccaaggaauugaugaugacuaccauaggaaucguacuccucucccagagcaccauaccagagaccauucuugaacugacugaugcguuagccuugggcaugaugguccucaaaauggugagaaaaauggaaaaguaucaauuggcagugacuaucauggcuaucuugugcgucccaaaugcagugauauuacaaaacacauggaaagugaguugcacaauauuggcagugguguccguuuccccacuguucuuaacauccucacagcagaaagcggauuggauaccauuagcauugacgaucaagggucucaauccaacagcuauuuuucuaacaacccuuucaagaaccaacaagaaaaggagcuggccacuaaaugaggcuaucauggcagucgggauggugagcauuuuggccaguucacuccuaaagaaugacauucccaugacaggaccauuaguggcuggagggcuccucacugugugcuacgugcucacuggacgaucggccgauuuggaacuggagagagccgccgaugucaaaugggaagaucaggcagagauaucaggaagcaguccaauccugucaauaacaauaucagaagaugguagcaugucgauaaaaaacgaagaggaagaacaaacacugaccauacucauuagaacaggauugcuggugaucucaggacuuuuuccuguaucaauaccaaucacugcagcagcaugguaccugugggaagugaagaaacaacgggcuggaguauugugggaugucccuucacccccacccgugggaaaggcugaacuggaagauggagccuauagaaucaagcaaaaagggauucuuggauauucccagaucggagccggaguuuacaaagaaggaacauuccauacaauguggcaugucacacguggcgcuguucuaaugcauaaaggaaagaggauugaaccaucaugggcggacguuaagaaagaccuaauaucauauggaggaggcuggaagcuagaaggagaauggaaggaaggagaagaaguccaggucuuggcauuggagccuggaaaaaauccaagagccguccaaacaaaaccuggucuuuucaaaaccaacgccggaaccauaggugccguaucucuggacuuuucuccuggaaccucaggaucuccaaucaucgacagaaaaggaaaaguugugggucuuuaugguaaugguguuguuacaaggaguggagcauaugugagugcuauagcccagacugaaaaaagcauugaagacaauccagagaucgaagaugacauuuuucgaaagagaaaauugaccaucauggaccuccacccaggagcgggaaagacgaagagauaccuuccagccauagucagagaggcuauaaaacggggccugaggacauuaauccuggcccccacuagagucguggcagcugaaauggaggaagcccuaagaggacuuccaauaagauaccaaaccccagccaucagagcugagcacaccgggcgggagauuguggaccuaaugugucaugccacauucacuaugaggcugcuaucaccaguuagagugccaaauuacaaccugaucaucauggacgaagcccauuucacagacccagcaaguauagcggcuagaggauacaucucaacucgaguagagaugggugaggcagcugggauuuucaugacagccacuccuccgggaagcagagacccauucccucagagcaaugcaccaaucauggaugaagaaagagaaaucccugaacguucguggaguucuggacaugagugggucacggauuuuaaagggaagacuguuugguucguuccaaguauaagagcaggaaaugauauagcagcuugccugagaaaaaauggaaagaaagugauacaacucaguaggaagaccuuugauucugaguaugucaagacuagaaccaaugauugggacuucgugguuacaacugacauuucagaaaugggugccaacuucaaggcugagaggguuauagaccccagacgcugcaugaaaccaguuauacuaacagauggugaagagcgggugauccuggcaggaccuaugccagugacccacucuagugcagcacaaagaagagggagaauaggaagaaauccaaaaaaugaaaaugaccaguacauauacaugggggaaccucuggaaaaugaugaagacugugcacacuggaaagaagcuaaaaugcuccuagauaacaucaacacaccugaaggaaucauuccuagcauguucgaaccagagcgugaaaagguggaugccauugauggugaauaccgcuugagaggagaagcaaggaaaaccuuuguggaccuaaugagaagaggagaccuaccagucugguuggccuacagaguggcagcugaaggcaucaacuacgcagacagaaggugguguuuugauggaauuaagaacaaccaaaucuuggaagaaaauguggagguggaaaucuggacaaaagaaggggaaaggaagaaauuaaaacccagaugguuggaugccaggaucuacucugacccacuggcgcuaaaggaauucaaggaguuugcagcuggaagaaagucccugacccugaaccuaaucacagaaauggguaggcuuccaacuuucaugacucagaaggcaagagacgcacuggacaacuuagcaguguugcacacggcugaagcagguggaagggcguacaaucaugcucucagugaacugccggagacccuggagacauugcuuuuacugacacuucuggcuacagucacaggaggaaucuuuuuauucuugaugagcggaagggguauagggaagaugacccugggaaugugcugcauaaucacggcuaguauucuccuaugguacgcacaaauacagccacacuggauagcagcuucaauaauacuggaguuuuuucucauaguuuugcuuauuccagaaccagaaaagcagagaacaccccaagauaaccaauugaccuacguugucauagccauccucacagugguggccgcaaccauggcaaacgagauggguuuccuggaaaaaacgaagaaagaucucggauugggaagcaucacaacccagcaacccgagagcaacauccuggacauagaucuacgucccgcaucagcauggacgcuguaugcuguggccacaacauuugucacaccaauguugagacacagcauugaaaauuccucagugaacgugucccuaacagcuauugccaaccaagccacaguguuaaugggucuugggaaaggauggccauugucaaagauggacaucggaguuccccuucucgccauuggaugcuacucacaagucaaccccauaacucucacagcagcucuuuucuuacugguagcacauuaugccaucauagggccaggacuccaagcaaaagcaaccagagaagcucagaaaagagcagcagcgggcaucaugaaaaacccaacuguugauggaauaacagugauugaccuagauccaauacccuaugauccaaaguuugaaaagcaguugggacaaguaaugcuccuaguccucugcgugacucaaguguugaugaugaggacuacaugggcucugugugaggcuuuaaccuuagcgaccgggccuaucuccacauugugggaaggaaauccagggagguuuuggaacacuaccauugcagugucaauggcuaacauuuucagagggaguuacuuggccggagcuggacuucucuuuuccaucaugaagaauacaaccaacacgagaaggggaacuggcaacaugggagagacgcuuggagagaaauggaaaagccgauugaacgcauuggggaaaagugaauuccagaucuacaagaaaaguggaauccaggaaguggauagaaccuuagcaaaagaaggcauuaaaagaggagaaacggaccaucacgcugugucgcgaggcucagcaaaacugagaugguucgucgagagaaauauggucacaccagaagggaaaguaguggaccucgguugcggcagaggaggcuggucauacuauugugggggacuaaagaauguaagagaagucaaaggccuaacaaaaggaggaccaggacaugaagaacccauccccaugucaacauauggguggaaucuaguacgucuucaaaguggaguugacguuuucuucacuccgccagaaaagugugacacauuguugugugacauaggggagucgucaccaaaucccacgguagaagcaggacgaacacucagaguccuuaacuuaguggaaaauugguugaacaacaacacccaauuuugcauaaagguucucaacccauacaugcccucagucauagaaaaaauggaagcacuacaaaggaaauauggaggagccuuagugaggaauccacucucacgaaacuccacacaugagauguacuggguauccaaugccuccgggaacauagugucaucagugaacaugauuucaaggauguugaucaacagauucacaaugagacacaagaaagccacuuucgagccagauguagaccucggaagcggaacccgcaacaucggaauugaaagugagauaccaaaccuagacauaaucgggaaaagaauagaaaaaauaaaacaagaguaugaaacaucauggcacuaugaccaagaccacccauacaaaacgugggcuuaccauggcagcuaugaaacaaaacaaacuggaucagcaucauccauggugaacggaguggucagacugcugacaaaaccuugggacgucguccccaugguaacacagauggcaaugacagacacgacuccauuuggacaacagcgcguuuuuaaagaaaaaguggacacgagaacccaagaaccgaaagaaggcacaaagaaacuaaugaaaaucacggcagaguggcuuuggaaagaacuagggaagaaaaagacaccuaggaugugcacuagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugaaacauguguguacaacaugaugggaaaaagagagaagaagcuaggggaguucggcaaggcaaaaggcagcagagccauaugguacauguggcuuggagcacgcuucuuagaguuugaagcccuaggauucuugaaugaagaucacugguucuccagagagaacucccugaguggaguggaaggagaagggcugcacaagcuagguuacauuuuaagagacgugagcaagaaagagggaggagcaauguaugccgaugacaccgcaggaugggacacaagaaucacacuagaagaccuaaaaaaugaagaaaugguaacaaaccacauggaaggagaacacaagaaacuagccgaggccauuuucaaauuaacuuaccaaaacaagguggugcgugugcaaagaccaacaccaagaggcacaguaauggauaucauaucgagaagagaccaaagagguaguggacaaguugguaccuauggacucaauacuuucaccaauauggaagcccaacuaaucagacagauggagggagaaggagucuucaaaaacauucagcaccugacagucacagaagaaaucgccgugcaaaacugguuagcaagaguagggcgcgaaagguuaucaagaauggccaucaguggagaugauuguguugugaaaccuuuagaugacagguucgcaagcgcuuuaacagcucuaaaugacaugggaaagguuaggaaagacauacaacaaugggaaccuucaagaggauggaacgauuggacacaagugcccuucuguucacaccauuuccaugaguuaaucaugaaagacggccgcguacuuguaguuccaugcagaaaccaagaugaacugauugguagagcccgaauuucccagggagcuggguggucuuugcgagagacggccuguuuggggaaguccuacgcccaaauguggagcuugauguacuuccacagacgugaccucaggcuggcggcuaaugcuauuugcucggcagucccaucacauuggguuccaacaaguagaacaaccugguccauacacgccaaacaugaauggaugacaacggaagacaugcugacagucuggaacaggguguggauucaagaaaacccauggauggaagacaaaacuccaguggaaucaugggaggaaaucccauacuuggggaaaagagaagaccaauggugcggcucauugauugggcuaacaagcagggccaccugggcaaagaacauccaaacagcaauaaaucaaguuagaucccuuauaggcaaugaggaauacacagauuacaugccauccaugaaaagauucagaagagaagaggaagaggcaggaguccugugguag

SEQ ID NO: 6401 - RNA, 9876 nt, Artificial Sequence
  derived and/or modified CDS sequence (wt) from DENV-2__KF704358__SS-prME
acugcaggcaugaucauuaugcugauuccaacagugauggcguuccauuuaaccacacguaacggagaaccacacaugaucgucaguagacaagagaaagggaaaagucuucuauuuaacacaggggauggugugcacauguguacccucauggccaugcaccuuggugaauugugugaagauacaaucacguacaaguguccucuucucaggcagaaugaaccagaagacauagauuguuggugcaacucuacguccacauggguaacuuacgggacguguaccaccacaggagaacacagaagagaaaaaagaucaguggcacucguuccacaugugggaaugggacuggagacacgaacugaaacauggaugucaucagaaggggccuggaaacaugcccagagaauugaaacuuggaucuugagacauccaggcuuuaccauaauggcagcaauccuggcauacaccauaggaacgacacauuuccaaagagcccugauuuucaucuuacugacagcugucgcuccuucaaugacaaugcguugcauaggaauaucaaauagagacuuuguagaagggguuucaggaggaagcuggguugacauagucuuagaacauggaagcugugugacgacgauggcaaaaaacaaaccaacauuggaucuugaacugauaaaaacagaagccaaacaaccugccacucuaaggaaguacuguauagaggcaaagcugaccaacacaacaacagaaucucgcugcccaacacaaggagaacccagccuaaaugaagagcaggacaaaagguucgucugcaaacacuccaugguggacagaggauggggaaauggauguggacuauuuggaaaaggaagcauugugaccugugcuauguucacaugcaaaaagaucaugaaaggaaaagucgugcaaccagaaaacuuggaauacaccauugugauaacaccucacucaggggaagagcaugcagucggaaaugauacaggaaaacauggcaaggaaaucaaaauaacaccacagaguuccaucacagaagcagaguugacaggcuauggcacugucacgauggagugcucuccgagaacgggccucgacuucaaugagaugguguugcugcaaauggaagauaaagcuuggcuggugcacaggcaaugguuccuagaccugccguugccauggcugcccggagcggacacacaaggaucaaauuggauacagaaagagacauuggucacuuucaaaaauccccaugcgaagaaacaggauguuguuguuuugggaucccaagaaggggccaugcacacagcacucacaggggccacagaaauccagaugucaucaggaaacguacuguucacaggacaucucaagugcaggcugaggauggacaaacuacagcucaaaggaaugucauacucuaugugcacaggaaaguuuaaagucgugaaggaaauagcagaaacacaacauggaacaauaguuaucagaguacaauaugaaggggacgguucuccauguaagaucccuuuugagauaauggauuuggaaaaaagacauguuuuaggucgccugauuacagucaacccaaucguaacaggaaaagauagcccagucaacauagaagcagaaccuccauucggagacagcuacaucaucauaggaguagagccgggacaauugaagcucaacugguuuaagaaaggaaguucuaucggccaaauguuugcgacaacaaugaggggagcgaagagaauggccauuuuaggugacacagcuugggauuuuggaucccugggaggaguguuuacaucuauaggaaaggcucuccaccaaguuuucggagcaaucuauggggcugccuucaguggggucucauggacuaugaaaauccucacaggagucauuaucacauggauaggaaugaauucacgcagcaccucacugucugugucacuaguauuggugggagucgugacgcuguauuugggaguuauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaugaagagggcauuuguggaauccgcucaguaacaagacuggaaaaucugauguggaaacaaauaacaccagaauugaaucacauucuaucagaaaaugaggugaaguugacuauuaugacaggagacaucaaaggaaucaugcaggcaggaaaacgaucucugcggccccagcccaccgagcugaaguauucauggaaaacauggggcaaagcgaaaaugcucucuacagagucucauaaccagaccuuucucauugauggccccgaaacagcagaaugccccaacacaaacagagcuuggaauucgcuggaaguugaagacuauggcuuuggaguauucaccaccaauauauggcuaaaguugagagaaaagcaggauguauucugcgacucaaaacucaugucagcggccauaaaagacaacagagccguccaugccgauauggguuauuggauagaaagugcacucaaugacacauggaagauagagaaagccucuuucaucgaaguuaaaagcugccacuggccaaagucacacacccucuggagcaauggagugcuagaaagugagaugauaauuccaaagaauuucgcuggaccagugucacaacacaacuacagaccaggcuaccauacacaaacagcgggaccauggcaucuagguaagcuugagauggacuuugauuucugcgaaggaaccacagugguggugacugaggacuguggaaauagaggacccucuuuaagaacaacuacugccucuggaaaacucauaacagaauggugcugccgaucuugcacauuaccaccgcuaagauacagaggugaggacggaugcugguacgggauggaaaucagaccauugaaagagaaagaagagaauuuggucaacuccuuggucacagccggacaugggcagauugacaacuuuucacuaggagucuugggaauggcauuguuccuggaagaaaugcucaggacccgaguaggaacgaaacaugcaauacuacuaguugcaguuucuuuugugacauugaucacagggaacauguccuuuagagaccugggaagagugaugguuauggugggcgcuacuaugacggaugacauagguaugggcgugacuuaucuugcccuacuagcagccuucaaagucagaccaacuuuugcagcuggacuacucuugagaaaguugaccuccaaggaauugaugaugacuaccauaggaaucguacuccucucccagagcaccauaccagagaccauucuugaacugacugaugcguuagccuugggcaugaugguucucaaaauggugagaaaaauggaaaaguaucaauuggcagugacuaucauggcuaucuugugcgucccaaaugcagugauauuacaaaacacauggaaagugaguugcacaauauuggcagugguguccguuuccccacuguucuuaacauccucacagcagaaagcggauuggauaccauuagcauugacgaucaagggucucaauccaacagcuauuuuucuaacaacccuuucaagaaccaacaagaaaaggagcuggccacuaaaugaggcuaucauggcagucgggauggugagcauuuuggccaguucacuccuaaagaaugacauucccaugacaggaccauuaguggcuggagggcuccucacugugugcuacgugcucacuggacgaucggccgauuuggaacuggagagagccgccgaugucaaaugggaagaucaggcagagauaucaggaagcaguccaauccugucaauaacaauaucagaagaugguagcaugucgauaaaaaacgaagaggaagaacaaacacugaccauacucauuagaacaggauugcuggugaucucaggacuuuuuccuguaucaauaccaaucacugcagcagcaugguaccugugggaagugaagaaacaacgggcuggaguauugugggaugucccuucacccccacccgugggaaaggcugaacuggaagauggagccuauagaaucaagcaaaaagggauucuuggauauucccagaucggagccggaguuuacaaagaaggaacauuccauacaauguggcaugucacacguggcgcuguucuaaugcauaaaggaaagaggauugaaccaucaugggcggacgucaagaaagaccuaauaucauauggaggaggcuggaagcuagaaggagaauggaaggaaggagaagaaguccaggucuuggcauuggagccuggaaaaaauccaagagccguccaaacaaaaccuggucuuuucaaaaccaacgccggaaccauaggugccguaucucuggacuuuucuccuggaaccucaggaucuccaaucaucgacaaaaaaggaaaaguugugggucuuuaugguaaugguguuguuacaaggaguggagcauaugugagugcuauagcccagacugaaaaaagcauugaagacaauccagagaucgaagaugacauuuuucgaaagagaaaauugaccaucauggaccuccacccaggagcgggaaagacgaagagauaccuuccagccauagucagagaggcuauaaaacggggccugaggacauuaauccuggcccccacuagagucguggcagcugaaauggaggaagcccuaagaggacuuccaauaagauaccaaaccccagccaucagagcugagcacaccgggcgggagauuguggaccuaaugugucaugccacauucacuaugaggcugcuaucaccaguuagagugccaaauuacaaccugaucaucauggacgaagcccauuucacagacccagcaaguauagcggcuagaggauacaucucaacucgaguagagaugggugaggcagcugggauuuucaugacagccacuccuccgggaagcagagacccauucccucagagcaaugcaccaaucauggaugaagaaagagaaaucccugaacguucguggaguucuggacaugagugggucacggauuuuaaagggaagacuguuugguucguuccaaguauaagagcaggaaaugauauagcagcuugccugagaaaaaauggaaagaaagugauacaacucaguaggaagaccuuugauucugaguaugucaagacuagaaccaaugauugggacuucgugguuacaacugacauuucagaaaugggugccaacuucaaggcugagaggguuauagaccccagacgcugcaugaaaccaguuauacuaacagauggugaagagcgggugauccuggcaggaccuaugccagugacccacucuagugcagcacaaagaagagggagaauaggaagaaauccaaaaaaugaaaaugaccaguacauauacaugggggaaccucuggaaaaugaugaagacugugcacacuggaaagaagcuaaaaugcuccuagauaacaucaacacaccugaaggaaucauuccuagcauguucgaaccagagcgugaaaagguggaugccauugauggugaauaccgcuugagaggagaagcaaggaaaaccuuuguggaccuaaugagaagaggagaccuaccagucugguuggccuacagaguggcagcugaaggcaucaacuacgcagacagaaggugguguuuugauggaauuaagaacaaccaaaucuuggaagaaaauguggagguggaaaucuggacaaaagaaggggaaaggaagaaauuaaaacccagaugguuggaugccaggaucuacucugacccacuggcgcuaaaggaauucaaggaguuugcagcuggaagaaagucccugacccugaaccuaaucacagaaauggguaggcuuccaacuuucaugacucagaaggcaagagacgcacuggacaacuuagcaguguugcacacggcugaagcagguggaagggcguacaaucaugcucucagugaacugccggagacccuggagacauugcuuuuacugacacuucuggcuacagucacaggaggaaucuuuuuauucuugaugagcggaagggguauagggaagaugacccugggaaugugcugcauaaucacggcuaguauucuccuaugguacgcacaaauacagccacacuggauagcagcuucaauaauacuggaguuuuuucucauaguuuugcuuauuccagaaccagaaaagcagagaacaccccaagauaaccaauugaccuacguugucauagccauccucacagugguggccgcaaccauggcaaacgagauggguuuccuggaaaaaacgaagaaagaucucggauugggaagcauuacaacccagcaacccgagagcaacauccuggacauagaucuacgucccgcaucagcauggacgcuguaugcuguggccacaacauuugucacaccaauguugagacacagcauugaaaauuccucagugaacgugucccuaacagcuauugccaaccaagccacaguguuaaugggucuugggaaaggauggccauugucaaagauggacaucggaguuccccuucucgccauuggaugcuacucacaagucaaccccauaacucucacagcagcucuuuucuuacugguagcacauuaugccaucauagggccaggacuccaagcaaaagcaaccagagaagcucagaaaagagcagcagcgggcaucaugaaaaacccaacuguugauggaauaacagugauugaccuagauccaauacccuaugauccaaaguuugaaaagcaguugggacaaguaaugcuccuaguccucugcgugacucaaguguugaugaugaggacuacaugggcucugugugaggcuuuaaccuuagcgaccgggccuaucuccacauugugggaaggaaauccagggagguuuuggaacacuaccauugcagugucaauggcuaacauuuuuagagggaguuacuuggccggagcuggacuucucuuuuccaucaugaagaauacaaccaacacgagaaggggaacuggcaacaugggagagacgcuuggagagaaauggaaaagccgauugaacgcauuggggaaaagugaauuccagaucuacaagaaaaguggaauccaggaaguggauagaaccuuagcaaaagaaggcauuaaaagaggagaaacggaccaucacgcugugucgcgaggcucagcaaaacugagaugguucgucgagagaaauauggucacaccagaagggaaaguaguggaccucgguugcggcagaggaggcuggucauacuauugugggggacuaaagaauguaagagaagucaaaggccuaacaaaaggaggaccaggacaugaagaacccauccccaugucaacauauggguggaaucuaguacgucuucaaaguggaguugacguuuucuucacuccgccagaaaagugugacacauuguugugugacauaggggagucgucaccaaaucccacgguagaagcaggacgaacacucagaguccuuaacuuaguggaaaauugguugaacaacaacacccaauuuugcauaaagguucucaacccauacaugcccucagucauagaaaaaauggaagcacuacaaaggaaauauggaggagccuuagugaggaauccacucucacgaaacuccacacaugagauguacuggguauccaaugccuccgggaacauagugucaucagugaacaugauuucaaggauguugaucaacagauucacaaugagacacaagaaagccacuuucgagccagauguagaccucggaagcggaacccgcaacaucggaauugaaagugagauaccaaaccuagacauaaucgggaaaagaauagaaaaaauaaaacaagaguaugaaacaucauggcacuaugaccaagaccacccauacaaaacgugggcuuaccauggcagcuaugaaacaaaacaaacuggaucagcaucauccauggugaacggaguggucagacugcugacaaaaccuugggacgucguccccauggugacacagauggcaaugacagacacgacuccauuuggacaacagcgcguuuuuaaagaaaaaguggacacgagaacccaagaaccgaaagaaggcacaaagaaacuaaugaaaaucacggcagaguggcuuuggaaagaacuagggaagaaaaagacaccuaggaugugcacuagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugaaacauguguguacaacaugaugggaaaaagagagaagaagcuaggggaguucggcaaggcaaaaggcagcagagccauaugguacauguggcuuggagcacgcuucuuagaguuugaagcccuaggauucuugaaugaagaucacugguucuccagagagaacucccugaguggaguggaaggagaagggcugcacaagcuagguuacauuuuaagagacgugagcaagaaagagggaggagcaauguaugccgaugacaccgcaggaugggacacaagaaucacacuagaagaccuaaaaaaugaagaaaugguaacaaaccacauggaaggagaacacaagaaacuagccgaggccauuuucaaauuaacguaccaaaacaagguggugcgugugcaaagaccaacaccaagaggcacaguaauggauaucauaucgagaagagaccaaagagguaguggacaaguugguaccuauggacucaauacuuucaccaauauggaagcccaacuaaucagacagauggagggagaaggagucuucaaaaacauucagcaccugacagucacagaagaaaucgccgugcaaaacugguuagcaagaguagggcgcgaaagguuaucaagaauggccaucaguggagaugauuguguugugaaaccuuuagaugacagguucgcaagcgcuuuaacagcucuaaaugacaugggaaagguuaggaaagacauacaacaaugggaaccuucaagaggauggaacgauuggacacaagugcccuucuguucacaccauuuccaugaguuaaucaugaaagacggccgcguacuuguaguuccaugcagaaaccaagaugaacugauugguagagcccgaauuucccagggagcuggguggucuuugcgagagacggccuguuuggggaaguccuacgcccaaauguggagcuugauguacuuccacagacgugaccucaggcuggcggcuaaugcuauuugcucggcagucccaucacauuggguuccaacaaguagaacaaccugguccauacacgccaaacaugaauggaugacaacggaagacaugcugacagucuggaacaggguguggauucaagaaaacccauggauggaagacaaaacuccaguggaaucaugggaggaaaucccauacuuggggaaaagagaagaccaauggugcggcucauugauugggcuaacaagcagggccaccugggcaaagaacauccaaacagcaauaaaucaaguuagaucccuuauaggcaaugaggaauacacagauuacaugccauccaugaaaagauucagaagagaagaggaagaggcaggaguccugugguag

SEQ ID NO: 6402 - RNA, 9876 nt, Artificial Sequence
  derived and/or modified CDS sequence (wt) from DENV-2__KF041232__SS-prME
accgcaggcgugaucaucaugcugauuccaacagcgauggcguuccauuuaaccacacgcaacggagaaccacacaugaucgucagcaaacaggagaaagggaaaagucucuuguuuaaaacagaggauggugugaacaugugcacccucauggccauggaccuuggugaacugugugaagacacaaucacuuauaacuguccucuucucaggcagaaugaaccagaagauauagauuguugguguaacgccacguccacauggguaacuuaugggacaugcacugccacaggagaacacagaagggaaaaaagaucaguggcacuugucccacaugugggaaugggauuggagacacgaacugaaacguggaugucaucagaaggggccuggaaacacgcccagaggauugaaaccuggaucuugagacauccagguuuuaccauaauggcagcaaucuuggcauacaccauaggaacgacauauuuccaaagaguccugauauucaucuuacugacagcugucgcuccuucaaugacaaugcgcuguauuggaauaucaaauagagacuuuguggaagggguuucaggaggaagcuggguugacauagucuuagaacauggaagcugugugacaacgauggcaaaaaacaaaccaacauuggacuuugaacugauaaaaacagaagccaagcaaccugccacucuaaggaaguacuguauagaggcaaagcugaccaacacaacaacagcaucucgaugcccaacacaaggggaacccagccuaaaugaagaacaggacaaaagguuugucugcaaacauuccaugguagacagaggauggggaaauggauguggauuauuuggaaagggaggcauugugaccugugcuauguucacaugcaaaaaaaacauggaagggaaaauugugcaaccagaaaaccuggaauacaccauugugguaacaccucauucaggggaagagaaugcaguuggaaaugacacaggaaaacauggcaaggaaaucaaagugacaccacagaguuccauuacagaagcagaacugacaggcuacggcacugucacgauggagugcucuccaagaacgggccucgacuucaaugagaugguguugcugcaaauggaaaacaaggccuggcuggugcacaggcaaugguucuuagaccugccguuaccauggcugcccggagcggacauacaaggaucaaauuggauacagaaggagacguuggucacuuucaaaaacccccaugcgaagaaacaggauguuguuguuuuaggaucccaagaaggggcuaugcauacagcacucacaggggccacggaaauccagaugucaucaggaaaccuacuguucacaggacaucucaagugcaggcugagaauggauaaauuacagcucaaaggaaugucauacucuauguguacaggaaaguuuaaaguuguaaaggaaauagcagaaacacaacauggaacaauaguugucagaguacaauaugaaggggauggcucuccauguaaaaucccuuuugagauaauggauuuggaaaaaagacaugucuuaggucgccugauuacagucaacccaaucgucacagaaaaagacaguccagucaacauagaagcagaacccccauucggagacagcuacaucauuauaggaguagaaccgggacaacugaagcucagcugguuuaagaaaggaagcucaaucggccaaauguucgaaacaacaaugagaggagcgaagagaauggccauuuuaggugacacagccugggauuuuggaucccugggaggaguguucacaucuauaggaaaggcccuccaccaaguuuuuggagcuaucuauggggcugccuucagugggguuucauggacuaugaaaauccucauaggaguugucaucacauggauaggaaugaauucacguagcaccucacugucugugucacuaguauuagugggagucgugacauuguacuugggagcuauggugcaggcugauagugguuguguugugaguuggaaaaacaaagaacugaaauguggcagugggauuuucaucacagacaauguacacacauggacagaacaauacaaauuccaaccagaaucccccucaaagcuggcuucagcuauccagaaagcucaugaagaaggcauuuguggaauccgcucaguaacaagauuggagaaucuaauguggaaacaaauaacaccagaacugaaucacauucuaucagaaaaugagguaaaguugucuaucaugacaggggacaucaaaggaaucaugcaggcaggaaaacgaucccugcggccucagcccacugagcugaaauauucauggaaaacguggggcaaagcgaaaaugcucuccacagagccucauaaccagaccuuucucauugauggccccgaaacagcagaaugucccaacacaaacagagcuuggaacucacuagaaguugaagacuauggcuuugggguauucaccaccaacauauggcugaaguugaaagaaaggcaggauguguuuugugacucaaaacucaugucagcggccauaaaagacaacagagccguccaugccgauauggguuauuggauagaaagcgcacuuaaugacacauggaagauagaaaaagcuucuuuuaucgaaguuaaaaguugccacuggccaaaaucacacacucucuggaguaacggagugcuagaaagugagaugauaauuccaaagaauuuugcuggaccaguaucgcaacauaauuacagaccaggcuaucacacacaaacggcaggaccuuggcaucuaggcaagcuugagauggacuuugauuuuugcgaaggaaccacagugguggugacugaggacugcggaaauagaggacccucucuaagaacaacuacugcuucuggaaaacucauaacagaauggugcugccgauccugcacauuaccaccacuaagauacagaggcgaggauggaugcugguacggaauggaaaucagaccauugaaagagaaagaagagaacuuggucaauucuuuggucacagccggacaugggcagauugacaacuucucacuaggagucuugggaauggcacuguuccuggaagaaaugcucaggacccgaguaggaacaaaacaugcaguauuacugguugcaguuucuuucaugacauugaucacagggaacaugucuuuccgagaccuggggagagugaugguuauggugggggccgcuaugacggaugacauagguaugggcgugacuuaucuugccuuacuagcagccuucaaaguuagaccaacuuuugcagcuggacugcuuuugagaaagcugaccuccaaggaauugaugaugaccaccauaggaaucguacuccucucccagagcaccacaccagagacuauacuugaacugacugaugcguuggcuuugggcaugaugauucucaagauagugagaaacauggaaaaguaucaauuggcagugacuaucauggcuaucuuauguguuccaaaugcagugauauuacaaaaugcauggaaagugagcugcacaauacuggcagcgguguccguauccccacugcucuuaacaucuucgcagcagaaagcggauuggauaccauuggcauugacgaucaaaggucucaauccaacagccauuuuccuaacaacccuuucaagaacuaacaagaaaaggaguuggccacuaaaugaggcuaucauggcagucgggauggugagcauuuuagcuaguucucucuugaagaaugacauucccaugacaggaccauuaguggcuggagggcuucucacuguguguuacgugcucacuggaagaucggccgaccuggaacuagagagagccgccgacguuagaugggaagaucaggcagaaauaucaggaaguaguccaauucugucaauaacaauaucggaagauggcagcaugucgauaaaaaaugaagaggaagaacaaacacugaccauacucauuagaacaggauugcuggugauaucaggacuuuuccccguaucaauaccaaucacggcagcagcaugguaccugugggaagugaagaaacaacgggcuggaguauugugggacguuccuucacccccaccugugggaaaggccgaacuggaagauggagccuacagaaucaagcagaaagggauucuuggauacucccagaucggagcuggaguuuacaaagaaggaacauuccacacaauguggcacgucacacguggcgcuguucuaaugcacaaagggaagaggauugaaccaucaugggcggaugucaggaaagaccuaauaucguauggaggaggcuggaagcuagaaggagaauggaaggaaggagaagaaguccaggucuuggcauuagagccuggaaagaauccaagagccguccaaacaaaacccggucuuuuuaagacuaacacuggaaccauaggcgcugugucccuagacuuuucuccuggaacgucaggaucuccaaucgucgacaaaaaaggaaaagucgugggucucuaugguaauggugucgucacaaggaguggaacauaugugagugccauagcccagacugaaaaaagcauugaagacaauccagagauugaagaugauaucuuucggaaaaaaagauugaccauuauggaccuccacccaggagcgggaaagacgaaaagauaccuuccagcaauaguuagagaggccauaaaacgaggcuuaagaacauuaauccuggcccccacuagaguuguggcagcugaaauggaagaagcucuuagaggacuuccaauaagauaccaaaccccagccaucagagcugagcacacugggcgagaaaucguggauuuaaugugucaugccacauuuaccaugaggcuguuaucaccaguuagagugccaaauuacaacuugaucauuauggaugaagcccauuucacagacccagcaagcauagcagcuagaggauacauuucaacucgaguagagaugggugaagcagcugggauuuucaugacagccacucccccgggaagcagagacccauuuccucaaagcaaugcaccaaucauggaugaagagagggaaaucccugaacguucguggaacucuggacaugaguggguuacagauuucaaagggaagacuguuugguuuguuccgagcauaaaagcagguaaugauauagcagcuugccugagaaaaaauggaaagaaagugauacaacucaguaggaagaccuuugauucugaauacauuaagaccaggaccaaugauugggacuuuguggucacgacugacauuucagaaaugggugcuaacuucaaggcugaaaggguuauagaccccaggcgcugcaugaaaccagucauacuaacggacggugaagagcgggugauccuggcaggacccaugccaguaacccacucuagugcagcacaaagaagagggagaauaggaagaaauccaaaaaaugaaaaugaccaguacauauacaugggggaaccucuggaaaaugaugaagacugcgcacacuggaaagaagccaagaugcuuuuagacaacaucaacacgccugaaggaaucauucccagcauguucgaaccagagcgugaaaagguggaugcuauugauggugaauaccgcuuaagaggagaagcgaggaaaaccuuuguggaucuaaugagaagaggagaccuaccagucuggcuggccuacagaguggcagccgaaggcauuaacuaugcagacagaaggugguguuuugauggaaucaagaacaaccaaaucuuagaagaaaauguggaaguggaaaucuggacaaaagaaggggaaaggaagaaacugaaacccagauggcuggaugcucggaucuacucugacccacuggcgcucaaagaauucaaagaguuugcagcuggaagaaaaucccugacccugaauuuaaucacagaaauggguaggcuuccaacuuuuaugacucagaaagcaaggaacgcacuggacaacuuagcaguccugcauacggcugaagcaggcggaagggcguacaaccaugcucucagugaacugccagagacucuggagacauugcuuuugcugacacuuuuggccacagucacgggcggaaucuuuuuauuuuugaugaguggcaaagguauagggaaaaugacccugggaaugugcugcauaaucacggccaguauucuccuaugguacgcacaaauacagccacacuggauagcagcuucaauaauacuggaguuuuuucucauagucuugcucauuccagagccagaaaagcaaagaacaccccaagauaaccaauugacuuacguugucauagccauccucacagugguggccgcaaccauggcaaaugagaugggguuccuggaaaaaacgaagaaagauuucggacugggaagcauugcaacccagcaacccgagagcaacauccuggacauagaucuacguccugcaucagcauggacccuguaugcaguggccacaacauuuaucacaccaauguugagacauagcauugaaaauuccucagugaacgugucucuaacagccauugcuaaucaagccacagugcuaaugggucuugggaaaggauggccauugucgaagauggacauuggaguuccccuucucgccaucgggugcuauucacaagucaaccccauaacccucacagcagcccuucuuuuauugguagcacauuacgcuaucauagggccaggacuccaagcgaaagcaaccagagaagcgcagaaaagagcagcagcaggcaucaugaaaaacccaacuguggauggaauaacagugauugaccuagauccaauacccuaugacccaaaauuugagaagcagcugggacaaguaaugcuccuaguccucugcgugacucaaguacugaugaugaggacuacaugggcuuugugugaggcucuaaccuuagcgaccgggcccaucuccacauugugggaaggaaauccagggagauucuggaauacaaccauugcagugucaauggcuaacauuuuuagaggaaguuaccuagcuggagcuggacuucucuuuuccaucaugaagaacacaaccaacacaagaaggggaacuggcaacacaggagagacgcuuggagagaaauggaaaaaccgauugaauucauuggggaagagugaauuccagauuuacaagagaagcggaauucaggaaguggauagaaccuuggcaaaagaaggcauuaaaagaggagaaacggaccaucaugcugugucgcgaggcucagcaaagcugagaugguucgucgagagaaaccugguuacaccagaggggaaaguaguggaccucgguugcgguagagggggcuggucauacuauugugggggucuaaagaauguaagagaagucaaaggccuaacaaaaggaggaccaggacacgaagaacccauucccaugucaacauauggguggaaucuugugcgucuccaaaguggaguugaugucuucuuuacuccaccagaaaaaugugacacauuguugugugauauaggggagucgucaccaaaucccacgguugaagcuggacgaacacucagaguccuaaacuugguagaaaauuggcugaacaacaacacccaauuuugcauaaagguucuuaacccauacaugcccucagucauagaaaaaauggaaacgcugcaaaggaaauacggaggagcuuuggugaggaauccccucucaagaaauuccacacaugagauguauuggguauccaaugcuuccgggaacauagugucaucagugaacaugauuucaaggauguugaucaauagauuuacaaugagacauaagaaggccacauacgagccagauguugaccucggaagcggaacccgcaacaucggaaucgaaagugagacaccaaaccuagacauaauugggaaaagaauagaaaaaauaaaacaagagcaugagacaucauggcacuaugaccaagaccacccauauaaaacgugggccuaccauggcagcuacgaaacaaaacagacuggaucagcaucauccauggugaauggaguaguuagacugcugacaaaaccuugggacgucaucccuauggugacacagauggcaaugacagacacgaccccauuuggacaacagcguguuuucaaagagaaaguggacacgagaacccaagaaccgaaagaaggcacgaagaaacuaaugaaaaucacggccgaauggcucuggaaagaacuagggaagaaaaagacaccuagaaugugcacuagagaagaauucgcaagaaaggugagaagcaaugcagcccuaggugccauauucacugaugagaacaaguggaagucggcacgugaggcuguugaagacaguagauuuugggaacuaguugacaaggaaaggaaucuccaucuugaaggaaagugugagacauguguguacaacaugaugggaaagagagagaagaagauaggggaauucggcaaagcaaaaggcagcagagccauaugguacauguggcuuggagcacgcuucuuagaguuugaagcccuaggauuucugaaugaagaucacugguuuuccagagagaacucucugagcggaguggaaggagaagggcugcacaagcuggguuacauucuaagagaaguaagcaagaaagaaggaggagcaauguacgccgacgacacagcaggaugggauacaagaaucacacuagaggaccuaaaaaaugaagagaugguaacaaaccauauggaaggagaacacaagaaacuugcugaggccaucuucaaauuaacguaccaaaacaagguggugcgugugcaaagacccacaccaagaggcacaguaauggauauuauaucgagaagagaccaaagagguaguggacaaguuggcaccuauggccucaacaccuuuaccaauaugggagcccaacuaaucagacagauggagggagagggagucuuuaaaggcauccagcaucugacagccacagaagaaguugcagugcaagacugguuagcaagaguggggcgugagagguuaucaagaauggccaucaguggagaugauugcguugugaaacccuuagaugacagguuugcaaacgcuuuaacagcucuaaaugacaugggaaagguuaggaaagacauacaacaaugggaaccuucaagaggauggaacgacuggacacaagugccuuucuguucacaccauuuccaugaguuaaucaugaaagacggucgugugcucguaguuccauguagaaaccaagaugaacugauugguagagcucgaauuucccagggagccggguggucuuugcgggagacggccugucuggggaagucuuacgcccaaauguggagccugauguacuuccacagacgugaccucaggcuggcagcaaacgcuauuugcucggcaguuccaucacauuggguuccgacaagucgaacaaccugguccauacacgccagacaugaauggaugacaacagaagacaugcugacagucuggaacaggguguggauucaagaaaacccauggauggaagacaaaacuccaguggaaucaugggaggaaaucccauacuuggggaaaagagaagaccaaugguguggcucauugauaggguuaacaagcagggccaccugggcaaggaacauccaaacagcaauaaaccaaguuagauccuuaauaggcagugaggaauacacagacuacaugccauccaugaaaagauucagaagagaagaggaagaggcaggggucuugugguag

SEQ ID NO: 6403 - RNA, 9876 nt, Artificial Sequence
  derived and/or modified CDS sequence (wt) from DENV-2__KF041233__SS-prME
accgcaggcgugaucaucaugcugauuccaacagcgauggcguuccauuuaaccacacgcaacggagaaccacacaugaucgucagcaaacaagagaaagggaaaagucucuuguuuaaaacagaggauggugugaacaugugcacccucauggccauggaccuuggugaacugugugaagacacaaucacuuauaacuguccucuucucaggcagaaugaaccagaagauauagauuguugguguaacuccacguccacauggguaacuuaugggacaugcacugccacaggagaacacagaagggaaaaaagaucaguggcacucgucccacaugugggaaugggauuggagacacgaacugaaacguggaugucaucagaaggggccuggaaacacgcccagagaauugaaaccuggaucuugagacauccagguuuuaccauaauggcagcaaucuuggcauacaccauaggaacgacauauuuccaaagaguccugaucuucaucuuacugacagcugucgcuccuucaaugacaaugcguuguauuggaauaucaaauagagacuuuguggaagggguuucaggaggaagcuggguugacauagucuuagaacauggaagcugugugacaacgauggcaaaaaacaaaccaacauuggacuuugaacugauaaaaacagaagccaagcaaccugccacucuaaggaaguacugcauagaggcaaagcugaccaacacaacaacagcaucucgaugcccaacacaaggggaacccagccuaaaugaagaacaggacaaaagguuugucugcaaacauuccaugguagacagaggauggggaaauggauguggauuauuuggaaagggaggcauugugaccugugcuauguucacaugcaaaaaaaacauggaagggaaaauugugcaaccagaaaaccuggaauacaccauugugguaacaccucauucaggggaagagaaugcaguuggaaaugacacaggaaaacauggcaaggaaaucaaagugacaccacagaguuccauuacagaagcagaacugacaggcuacggcacugucacgauggagugcucuccaagaacgggccucgacuucaaugagaugguguugcugcaaauggaaaacaaggcuuggcuggugcacaggcaaugguucuuagaccugccguuaccaugguugcccggagcggacauacaaggaucaaauuggauacagaaggagacguuggucacuuucaaaaauccccaugcgaagaaacaggauguuguuguuuuaggaucccaagaaggggcuaugcauacagcacuuacaggggccacggaaauccagaugucaucaggaaaccuacuguucacaggacaucucaagugcaggcugagaauggauaaauuacagcucaaaggaaugucauacucuauguguacaggaaaguuuaaaguuguaaaggaaauagcagaaacacaacauggaacaauaguugucagaguacaauaugaaggggauggcucuccauguaaaaucccuuuugagauaauggauuuggaaaaaagacaugucuuaggucgccugauuacagucaacccaaucgucacagaaaaagacaguccagucaacauagaagcagaacccccauucggagacagcuacaucauuauaggaguagaaccgggacaacugaagcucagcugguuuaagaaaggaagcucaaucggccaaauguucgagacaacaaugagaggagcgaagagaauggccauuuuaggugacacagccugggauuuuggaucccugggaggaguguucacaucuauaggaaaggcccuccaccaaguuuuuggagcaaucuauggggcugccuucagugggguuucauggacuaugaaaauccucauaggaguugucaucacauggauaggaaugaauucacguagcaccucacugucugugucacuaguauuagugggagucgugacauuguacuugggaguuauggugcaggcugauagugguuguguugugaguuggaaaaacaaagaacugaaauguggcagugggauuuucaucacagacaauguacacacauggacagaacaauacaaauuccaaccagaaucccccucaaagcuggcugcagcuauccagaaagcucaugaagaaggcauuuguggaauccgcucaguaacaagacuggagaaucuaauguggaaacaaauaacaccagaacugaaucacauucuaucagaaaaugagguaaaguuaucuaucaugacaggggacaucaaaggaaucaugcaggcaggaaaacgaucccugcggccucagcccacugagcugaaauauucauggaaaacguggggcaaagcgaaaaugcucuccacagagccucauaaccagaccuuucucauugauggccccgaaacagcagaaugucccaacacaaacagagcuuggaacucacuagaaguugaagacuauggcuuugggguauucaccaccaacauauggcugaaguugaaagaaaggcaggauguguuuugugacucaaaacucaugucagcggccauaaaagacaacagagccguccaugccgauauggguuauuggauagaaagcgcacuuaaugacacauggaagauagaaaaagcuucuuuuaucgaaguuaaaaguugccacuggccaaaaucacacacucucuggaguaacggagugcuagaaagugagaugauaauuccaaagaauuuugcuggaccaguaucgcaacauaauuacagaccaggcuaucacacacaaacggcaggaccuuggcaucuaggcaagcuugagauggacuuugauuuuugcgaaggaaccacagugguggugacugaggacugcggaaauagaggacccucucuaagaacaacuacugcuucuggaaaacucauaacagaauggugcugccgauccugcacauuaccaccacuaagauacagaggcgaggauggaugcugguacggaauggaaauuagaccauugaaagagaaagaagagaacuuggucaauucuuuggucacagccggacauggacagauugacaacuucucacuaggagucuugggaauggcacuguuccuggaagaaaugcucaggacccgaguaggaacaaaacaugcaguauuacugauugcaguuucuuucaugacauugaucacagggaacaugucuuuccgagaccuggggagagugaugguuauggugggggccgcuaugacggaugacauagguaugggcgugacuuaucuugccuuacuagcagccuucaaaguuagaccaacuuuugcagcuggacugcuuuugagaaagcugaccuccaaggaauugaugaugaccaccauaggaaucguacuccucucccagagcaccacaccagagacuauacuugaacugacugaugcguuggcuuugggcaugaugauucucaagauagugagaaacauggaaaaguaucaauuggcagugaccaucauggcuaucuuauguguuccaaaugcagugauauuacaaaaugcauggaaagugagcugcacaauacuggcagcgguguccguauccccacugcucuuaacaucuucgcagcagaaagcggauuggauaccauuggcauugacgaucaaaggucucaauccaacagccauuuuccuaacaacccuuucaagaacuaacaagaaaaggaguuggccacuaaaugaggcuaucauggcagucgggauggugagcauuuuagcuaguucucucuugaagaaugacauucccaugacaggaccauuaguggcuggagggcuucucacuguguguuacgugcucacuggaagaucggccgaccuggaacuagagagagccgccgacguuagaugggaagaucaggcagaaauaucaggaagcaguccaauucugucaauaacaauaucggaagauggcagcaugucgauaaaaaaugaagaggaagaacaaacauugaccauacucauuagaacaggauugcuggugauaucaggacuuuuccccguaucaauaccaaucacggcagcagcaugguaccugugggaagugaagaaacaacgggcuggaguauugugggacguuccuucacccccaccugugggaaaggccgaacuggaagauggagcuuacagaaucaagcagaaagggauucuuggauacucccagaucggagcuggaguuuacaaagaaggaacauuccacacaauguggcacgucacacguggugcuguucuaaugcacaaagggaagaggauugaaccaucaugggcggaugucaggaaagaccuaauaucguauggaggaggcuggaagcuagaaggagaauggaaggaaggagaagaaguccaggucuuggcauuagagccuggaaagaauccaagagccguccaaacaaaacccggucuuuuuaagacuaacaccggaaccauaggcgcugugucccuagacuuuucuccuggaacgucaggaucuccaaucgucgacaaaaaaggaaaagucgugggucucuaugguaauggugucgucacaaggaguggaacauaugugagugccauagcccagacugaaaaaagcauugaagacaauccagagauugaagaugauaucuuucggaaaaaaaaauugaccauuauggaccuccacccaggagcgggaaagacgaaaagauaccuuccagcaauaguuagagaggccauaaaacgaggcuuaagaacauuaauccuggcccccacuagagucguggcagcugaaauggaggaagcucuuagaggacuuccaauaagauaccaaaccccagccaucagagcugagcacacugggcgagaaaucguggauuuaaugugucaugccacauuuaccaugaggcuguuaucaccaguuagagugccaaauuacaacuugaucauuauggaugaagcccauuucacagacccagcaagcauagcagcuagaggauacauuucaacucgaguagagaugggagaagcagcugggauuuucaugacagccacucccccgggaagcagagacccauuuccucaaagcaaugcaccaaucauggaugaagaaagggaaaucccugaacguucguggaacucuggacaugaguggguuacagauuucaaagggaagacuguuugguuuguuccgaguauaaaagcgggcaaugauauagcagcuugccugagaaaaaauggaaagaaagugauacaacucaguaggaagaccuuugauucugaauacaucaagacuaggaccaaugauugggacuuuguggucacgacugacauuucagaaaugggugcuaacuucaaggcugaaaggguuauagaccccaggcgcugcaugaaaccagucauacuaacggacggugaagagcgggugauccuggcaggacccaugccagugacccacucuagugcagcacaaagaagagggagaauaggaagaaauccaaaaaaugaaaaugaccaguacauauacaugggggaaccucuggaaaaugaugaagacugcgcacacuggaaagaagccaagaugcuuuuagacaacaucaacacgccugaaggaaucauucccagcauguucgaaccagagcgugaaaagguggaugcuauugauggugaauaccgcuuaagaggagaagcgaggaaaaccuuuguggaucuaaugagaagaggagaccuaccagucuggcuggccuacagaguggcagccgaaggcauuaacuaugcagacagaaggugguguuuugauggaaucaagaacaaccaaaucuuagaagaaaauguggaaguggaaaucuggacaaaagaaggggaaaggaagaaacugaaacccagauggcuggaugcucggaucuacucugacccacuggcgcucaaagaauucaaagaguuugcagcuggaagaaaaucccugacccugaauuuaaucacagaaauggguaggcuuccaacuuuuaugacucagaaagcaaggaacgcacuggacaacuuagcaguccugcauacggcugaagcaggcggaagggcguacaaucaugcucucagugaacugccagaaacucuggagacauugcuuuugcugacacuuuuggccacagucacgggcggaaucuuucuauucuugaugaguggcaaagguauagggaaaaugacccugggaaugugcugcauaaucacggccaguauucuccuaugguacgcacaaauacagccacacuggauagcagcuucaauaauacuggaguuuuuucucauagucuugcucauuccagagccagaaaagcaaagaacaccccaagauaaccaauugacuuacguugucauagccauccucacagugguggccgcaaccauggcaaaugagaugggguuccuggaaaaaacgaagaaagauuucggauugggaagcauugcaacccagcaacccgagagcaacauccuggacauagaucuacguccugcaucagcauggacccuguaugcaguggccacaacauuuaucacaccaauguugagacauagcauugaaaauuccucagugaacgugucucuaacagccauugcuaaucaagccacagugcuaaugggucuugggaaaggauggccauugucgaaaauggauauuggaguuccccuucucgccaucgggugcuauucacaagucaaccccauaacccucacagcagcccuucuuuuauugguagcacauuacgcuaucauagggccaggacuccaagcgaaagcaaccagagaagcgcagaaaagagcagcagcaggcaucaugaaaaacccaacuguggauggaauaacagugauugaccuagauccaauacccuaugacccaaaauuugagaagcagcugggacaaguaaugcuccuaguccucugcgugacucaaguacugaugaugaggacuacaugggcuuugugugaggcucuaaccuuagcgaccgggcccaucuccacauugugggaaggaaauccagggagauucuggaauacaaccauugcagugucaauggcuaacauuuuuagaggaaguuaccuagcuggagcuggacuucucuuuuccaucaugaagaacacaaccaacacaagaaggggaacuggcaacacaggagagacgcuuggagagaaauggaaaaaccgauugaauucauuggggaagagugaauuccagauuuacaagagaagcggaauucaggaaguggauagaaccuuggcaaaagaaggcauuaaaagaggagaaacggaccaucaugcuguaucgcgaggcucagcaaagcugagaugguucgucgagagaaaccugguuacaccagaggggaaaguaguggaccucgguugcgguagagggggcuggucauacuauugugggggucuaaagaauguaagagaagucaaaggccuaacaaaaggaggaccaggacacgaagaacccauucccaugucaacauauggguggaaucuugugcgucuccaaaguggaguugaugucuucuuuacuccaccagaaaaaugugacacauuguugugugauauaggggagucgucaccaaaucccacgguugaagcuggacgaacacucagaguccuaaacuugguagaaaauuggcugaacaacaacacccaauuuugcauaaagguucuuaacccauacaugcccucagucauagaaaaaauggaaacgcugcaaaggaaauacggaggagcuuuggugaggaauccccucucaagaaauuccacacaugagauguauuggguauccaaugcuuccgggaacauagugucaucagugaacaugauuucaaggauguugaucaauagauuuacaaugagacauaagaaggccacauacgagccagauguugaccucggaagcggaacccgcaacaucggaaucgaaagugagacaccaaaccuagacauaauugggaaaagaauagaaaaaauaaaacaagagcaugagacaucauggcacuaugaccaagaccacccauauaaaacgugggccuaccauggcagcuacgaaacaaaacagacuggaucagcaucauccaugguaaauggaguaguuagacugcugacaaaaccuugggacgucaucccuauggugacacagauggcaaugacagacacgaccccauuuggacaacagcguguuuucaaagagaaaguggacacgagaacccaagaaccgaaagaaggcacgaagaaacuaaugaaaaucacggccgaauggcucuggaaagaacuagggaagaaaaagacaccuagaaugugcacuagagaagaauucgcaagaaaggugagaagcaaugcagcccuaggugccauauucacugaugagaacaaguggaagucggcacgugaggcuguugaagacaguagauuuugggaacuaguugacaaggaaaggaaucuccaucuugaaggaaagugugagacauguguguacaacaugaugggaaagagagagaagaagauaggggaauucggcaaagcaaaaggcagcagagccauaugguacauguggcuuggagcacgcuucuuagaguuugaagcccuaggauuucugaaugaagaucacugguuuuccagagagaacucucugagcggaguggaaggagaagggcugcacaagcuggguuacauucuaagagaagugagcaagaaagaaggaggagcaauguacgccgacgacacagcaggaugggauacaagaaucacacuagaggaccuaaaaaaugaagagaugguaacaaaccauauggaaggagaacacaagaaacuugcugaggccaucuucaaauuaacguaccaaaacaagguggugcgugugcaaagacccacaccaagaggcacaguaauggauauuauaucgagaagagaccaaagagguaguggacaaguuggcaccuauggccucaacaccuuuaccaauaugggagcccaacuaaucagacagauggagggagagggagucuuuaaaggcauccagcaucugacagccacagaagaaguugcagugcaagacugguuagcaagaguggggcgugagagguuaucaagaauggccaucaguggagaugauuguguugugaaacccuuagaugacagguuugcaagcgcuuuaacagcucuaaaugacaugggaaagguuaggaaagacauacaacaaugggaaccuucaagaggauggaacgacuggacacaagugccuuucuguucacaccauuuccaugaguuaaucaugaaagacggucgugugcucguaguuccauguagaaaccaagaugaacugauugguagagcucgaauuucccagggagccggguggucuuugcgggagacagccugucuggggaagucuuacgcccaaauguggagccugauguacuuccacagacgugaccucaggcuggcagcaaacgcuauuugcucggcaguuccaucacauuggguuccgacaagucgaacaaccugguccauacacgccagacaugaauggaugacaacagaagacaugcugacagucuggaacaggguguggauucaagaaaacccauggauggaagacaaaacucuaguggaaucaugggaggaaaucccauacuuggggaaaagagaagaccaauggugcggcucauugauaggguuaacaagcagggccaccugggcaaggaacauccaaacagcaauaaaccaagucagauccuugauaggcagugaggaauacacagacuacaugccauccaugaaaagauucagaagagaagaggaagaggcaggggucuugugguag

SEQ ID NO: 6404 - RNA, 9876 nt, Artificial Sequence
  derived and/or modified CDS sequence (wt) from DENV-2__KF041234__SS-prME
accgcaggcgugaucaucaugcugauuccaacagcgauggcguuccauuuaaccacacgcaacggagaaccacacaugaucgucagcaaacaggagaaagggaaaagucucuuguuuaaaacagaggauggugugaacaugugcacccucauggccauggaccuuggugaacugugugaagacacaaucacuuauaacuguccucuucucaggcagaaugaaccagaagauauagauuguugguguaacgccacguccacauggguaacuuaugggacaugcacugccacaggagaacacagaagggaaaaaagaucaguggcacuugucccacaugugggaaugggauuggagacacgaacugaaacguggaugucaucagaaggggccuggaaacacgcccagaggauugaaaccuggaucuugagacauccagguuuuaccauaauggcagcaaucuuggcauacaccauaggaacgacauauuuccaaagaguccugauauucaucuuacugacagcugucgcuccuucaaugacaaugcguuguauuggaauaucaaauagagacuuuguggaagggguuucaggaggaagcuggguugacauagucuuagaacauggaagcugugugacaacgauggcaaaaaacaaaccaacauuggacuuugaacugauaaaaacagaagccaagcaaccugccacucuaaggaaguacuguauagaggcaaagcugaccaacacaacaacagcaucucgaugcccaacacaaggggaacccagccuaaaugaagaacaggacaaaagguuugucugcaaacauuccaugguagacagaggauggggaaauggauguggauuauuuggaaagggaggcauugugaccugugcuauguucacaugcaaaaaaaacauggaagggaaaauugugcaaccagaaaaccuggaauacaccauugugguaacaccucauucaggggaagagaaugcaguuggaaaugacacaggaaaacauggcaaggaaaucaaagugacaccacagaguuccauuacagaagcagaacugacaggcuacggcacugucacgauggagugcucuccaagaacgggccucgacuucaaugagaugguguugcugcaaauggaaaacaaggcuuggcuggugcacaggcaaugguucuuagaccugccguuaccauggcugcccggagcggacauacaaggaucaaauuggauacagaaggagacguuggucacuuucaaaaacccccaugcgaagaaacaggauguuguuguuuuaggaucccaagaaggggcuaugcauacagcacucacaggggccacggaaauccagaugucaucaggaaaccuacuguucacaggacaucucaagugcaggcugagaauggauaaauuacagcucaaaggaaugucauacucuauguguacaggaaaguuuaaaguuauaaaggaaauagcagaaacacaacauggaacaauaguugucagaguacaauaugaaggggaugguucuccauguaaaaucccuuuugagauaauggauuuggaaaaaagacaugucuuaggucgccugauuacagucaacccaaucgucacagaaaaagacaguccagucaacauagaagcagaacccccauucggagacagcuacaucauuauaggaguagaaccgggacaacugaagcucagcugguuuaagaaaggaagcucaaucggccaaauguucgaaacaacaaugagaggagcgaagagaauggccauuuuaggugacacagccugggauuuuggaucccugggaggaguguucacaucuauaggaaaggcccuccaccaaguuuuuggagcuaucuauggggcugccuucagugggguuucauggacuaugaaaauccucauaggaguugucaucacauggauaggaaugaauucacguagcaccucacugucugugucacuaguauuagugggagucgugacauuguacuugggaguuauggugcaggcugauagugguuguguugugaguuggaaaaacaaagaacugaaauguggcagugggauuuucaucacagacaauguacacacauggacagaacaauacaaauuccaaccagaaucccccucaaagcuggcuucagcuauccagaaagcucaugaagaaggcauuuguggaauccgcucaguaacaagauuggagaaucuaauguggaaacaaauaacaccagaacugaaucacauucuaucagaaaaugagguaaaguugucuaucaugacaggggacaucaaaggaaucaugcaggcaggaaaacgaucccugcggccucagcccacugagcugaaauauucauggaaaacguggggcaaagcgaaaaugcucuccacagagccucauaaccagaccuuucucauugauggccccgaaacagcagaaugucccaacacaaacagagcuuggaacucacuagaaguugaagacuauggcuuugggguauucaccaccaacauauggcugaaguugaaagaaaggcaggauguguuuugugacucaaaacucaugucagcggccauaaaagacaacagagccguccaugccgauauggguuauuggauagaaagcgcacuuaaugacacauggaagauagaaaaagcuucuuuuaucgaaguuaaaaguugccacuggccaaaaucacacacucucuggaguaacggagugcuagaaagugagaugauaauuccaaagaauuuugcuggaccaguaucgcaacauaauuacagaccaggcuaucacacacaaacggcaggaccuuggcaucuaggcaagcuugagauggacuuugauuuuugcgaaggaaccacagugguggugacugaggacugcggaaauagaggacccucucuaagaacaacuacugcuucuggaaaacucauaacagaauggugcugccgauccugcacauuaccaccacuaagauacagaggcgaggauggaugcugguacggaauggaaaucagaccauugaaagagaaagaagagaacuuggucaauucuuuggucacagccggacaugggcagauugacaacuucucacuaggagucuugggaauggcacuguuccuggaagaaaugcucaggacccgaguaggaacaaaacaugcaguauuacugguugcaguuucuuucaugacauugaucacagggaacaugucuuuccgagaccuggggagagugaugguuauggugggggccgcuaugacggaugacauagguaugggcgugacuuaucuugccuuacuagcagccuucaaaguuagaccaacuuuugcagcuggacugcuuuugagaaagcugaccuccaaggaauugaugaugaccaccauaggaaucguacuccucucccagagcaccacaccagagacuauacuugaacugacugaugcguuggcuuugggcaugaugauucucaagauagugagaaacauggaaaaguaucaauuggcagugacuaucauggcuaucuuauguguuccaaaugcagugauauuacaaaaugcauggaaagugagcugcacaauacuggcagcgguguccguauccccacugcucuuaacaucuucgcagcagaaagcggauuggauaccauuggcauugacgaucaaaggucucaauccaacagccauuuuccuaacaacccuuucaagaacuaacaagaaaaggaguuggccacuaaaugaggcuaucauggcagucgggauggugagcauuuuagcuaguucucucuugaagaaugacauucccaugacaggaccauuaguggcuggagggcuucucacuguguguuacgugcucacuggaagaucggccgaccuggaacuagagagagccgccgacguuagaugggaagaucaggcagaaauaucaggaaguaguccaauucugucaauaacaauaucggaagauggcagcaugucgauaaaaaaugaagaggaagaacaaacacugaccauacucauuagaacaggauugcuggugauaucaggacuuuuccccguaucaauaccaaucacggcagcagcaugguaccugugggaagugaagaaacaacgggcuggaguauugugggacguuccuucacccccaccugugggaaaggccgaacuggaagauggagccuacagaaucaagcagaaagggauucuuggauacucccagaucggagcuggaguuuacaaagaaggaacauuccacacaauguggcacgucacacguggcgcuguucuaaugcacaaagggaagaggauugaaccaucaugggcggaugucaggaaagaccuaauaucguauggaggaggcuggaagcuagaaggagaauggaaggaaggagaagaaguccaggucuuggcauuagagccuggaaagaauccaagagccguccaaacaaaacccggucuuuuuaagacuaacacuggaaccauaggcgcugugucccuagacuuuucuccuggaacgucaggaucuccaaucgucgacaaaaaaggaaaagucgugggucucuaugguaauggugucgucacaaggaguggaacauaugugagugccauagcccagacugaaaaaagcauugaagacaauccagagauugaagaugauaucuuucggaaaaaaagauugaccauuauggaccuccacccaggagcgggaaagacgaaaagauaccuuccagcaauaguuagagaggccauaaaacgaggcuuaagaacauuaauccuggcccccacuagaguuguggcagcugaaauggaagaagcucuuagaggacuuccaauaagauaccaaaccccagccaucagagcugagcacacugggcgagaaaucguggauuuaaugugucaugccacauuuaccaugaggcuguuaucaccaguuagagugccaaauuacaacuugaucauuauggaugaagcccauuucacagacccagcaagcauagcagcuagaggauacauuucaacucgaguagagaugggugaagcagcugggauuuucaugacagccacucccccgggaagcagagacccauuuccucaaagcaaugcaccaaucauggaugaagagagggaaaucccugaacguucguggaacucuggacaugaguggguuacagauuucaaagggaagacuguuugguuuguuccgagcauaaaagcagguaaugauauagcagcuugccugagaaaaaauggaaagaaagugauacaacucaguaggaagaccuuugauucugaauacauuaagaccaggaccaaugauugggacuuuguggucacgacugacauaucagaaaugggugcuaacuucaaggcugaaaggguuauagaccccaggcgcugcaugaaaccagucauacuaacggacggugaagagcgggugauccuggcaggacccaugccagugacccacucuagugcagcacaaagaagagggagaauaggaagaaauccaaaaaaugaaaaugaccaguacauauacaugggggaaccucuggaaaaugaugaagacugcgcacacuggaaagaagccaagaugcuuuuagacaacaucaacacgccugaaggaaucauucccagcauguucgaaccagagcgugaaaagguggaugcuauugauggugaauaccgcuuaagaggagaagcgaggaaaaccuuuguggaucuaaugagaagaggagaccuaccagucuggcuggccuacagaguggcagccgaaggcauuaacuaugcagacagaaggugguguuuugauggaaucaagaacaaccaaaucuuagaagaaaauguggaaguggaaaucuggacaaaagaaggggaaaggaagaaacugaaacccagauggcuggaugcucggaucuacucugacccacuggcgcucaaagaauucaaagaguuugcagcuggaagaaaaucccugacccugaauuuaaucacagaaauggguaggcuuccaacuuuuaugacucagaaagcaaggaacgcacuggacaacuuagcaguccugcauacggcugaagcaggcggaagggcguacaaccaugcucucagugaacugccagagacucuggagacauugcuuuugcugacacuuuuggccacagucacgggcggaaucuuuuuauuuuugaugaguggcaaagguauagggaaaaugacccugggaaugugcugcauaaucacggccaguauucuccuaugguacgcacaaauacagccacacuggauagcagcuucaauaauacuggaguuuuuucucauagucuugcucauuccagagccagaaaagcaaagaacaccccaagauaaccaauugacuuacguugucauagccauccucacagugguggccgcaaccauggcaaaugagaugggguuccuggaaaaaacgaagaaagauuucggacugggaagcauugcaacccagcaacccgagagcaacauccuggacauagaucuacguccugcaucagcauggacccuguaugcaguggccacaacauuuaucacaccaauguugagacauagcauugaaaauuccucagugaacgugucucuaacagccauugcuaaucaagccacagugcuaaugggucuugggaaaggauggccauugucgaagauggacauuggaguuccccuucucgccaucgggugcuauucacaagucaaccccauaacccucacagcagcccuucuuuuauugguagcacauuacgcuaucauagggccaggacuccaagcgaaagcaaccagagaagcgcagaaaagagcagcagcaggcaucaugaaaaacccaacuguggauggaauaacagugauugaccuagauccaauacccuaugacccaaaauuugagaagcagcugggacaaguaaugcuccuaguccucugcgugacucaaguacugaugaugaggacuacaugggcuuugugugaggcucuaaccuuagcgaccgggcccaucuccacauugugggaaggaaauccagggagauucuggaauacaaccauugcagugucaauggcuaacauuuuuagaggaaguuaccuagcuggagcuggacuucucuuuuccaucaugaagaacacaaccaacacaagaaggggaacuggcaacacaggagagacgcuuggagagaaauggaaaaaccgauugaauucauuggggaagagugaauuccagauuuacaagagaagcggaauucaggaaguggauagaaccuuggcaaaagaaggcauuaaaagaggagaaacggaccaucaugcugugucgcgaggcucagcaaagcugagaugguucgucgagagaaaccugguuacaccagaggggaaaguaguggaccucgguugcgguagagggggcuggucauacuauugugggggucuaaagaauguaagagaagucaaaggccuaacaaaaggaggaccaggacacgaagaacccauucccaugucaacauauggguggaaucuugugcgucuccaaaguggaguugaugucuucuuuacuccaccagaaaaaugugacacauuguugugugauauaggggagucgucaccaaaucccacgguugaagcuggacgaacacucagaguccuaaacuugguagaaaauuggcugaacaacaacacccaauuuugcauaaagguucuuaacccauacaugcccucagucauagaaaaaauggaaacgcugcaaaggaaauacggaggagcuuuggugaggaauccccucucaagaaauuccacacaugagauguauuggguauccaaugcuuccgggaacauagugucaucagugaacaugauuucaaggauguugaucaauagauuuacaaugagacauaagaaggccacauacgagccagauguugaccucggaagcggaacccgcaacaucggaaucgaaagugagacaccaaaccuagacauaauugggaaaagaauagaaaaaauaaaacaagagcaugagacaucauggcacuaugaccaagaccacccauauaaaacgugggccuaccauggcagcuacgaaacaaaacagacuggaucagcaucauccauggugaauggaguaguuagacugcugacaaaaccuugggacgucaucccuauggugacacagauggcaaugacagacacgaccccauuuggacaacagcguguuuucaaagagaaaguggacacgagaacccaagaaccgaaagaaggcacgaagaaacuaaugaaaaucacggccgaauggcucuggaaagaacuagggaagaaaaagacaccuagaaugugcacuagagaagaauucgcaagaaaggugagaagcaaugcagcccuaggugccauauucacugaugagaacaaguggaagucggcacgugaggcuguugaagacaguagauuuugggaacuaguugacaaggaaagggaucuccaucuugaaggaaagugugagacauguguguacaacaugaugggaaagagagagaagaagauaggggaauucggcaaagcaaaaggcagcagagccauaugguacauguggcuuggagcacgcuucuuagaguuugaagcccuaggauuucugaaugaagaucacugguuuuccagagagaacucucugagcggaguggaaggagaagggcugcacaagcuggguuacauucuaagagaaguaagcaagaaagaaggaggagcaauguacgccgacgacacagcaggaugggauacaagaaucacacuagaggaccuaaaaaaugaagagaugguaacaaaccauauggaaggagaacacaagaaacuugcugaggccaucuucaaauuaacguaccaaaacaagguggugcgugugcaaagacccacaccaagaggcacaguaauggauauuauaucgagaagagaccaaagagguaguggacaaguuggcaccuauggccucaacaccuuuaccaauaugggagcccaacuaaucagacagauggagggagagggagucuuuaaaggcauccagcaucugacagccacagaagaaguugcagugcaagacugguuagcaagaguggggcgugagagguuaucaagaauggccaucaguggagaugauugcguugugaaacccuuagaugacagguuugcaaacgcuuuaacagcucuaaaugacaugggaaagguuaggaaagacauacaacaaugggaaccuucaagaggauggagcgacuggacacaagugccuuucuguucacaccauuuccaugaguuaaucaugaaagacggucgugugcucguaguuccauguagaaaccaagaugaacugauugguagagcucgaauuucccagggagccggguggucuuugcgggagacggccugucuggggaagucuuacgcccaaauguggagccugauguacuuccacagacgugaccucaggcuggcagcaaacgcuauuugcucggcaguuccaucacauuggguuccgacaagucgaacaaccugguccauacacgccagacaugaauggaugacaacagaagacaugcugacagucuggaacaggguguggauucaagaaaacccauggauggaagacaaaacuccaguggaaucaugggaggaaaucccauacuuggggaaaagagaagaccaaugguguggcucauugauaggguuaacaagcagggccaccugggcaaggaacauccaaacagcaauaaaccaaguuagauccuuaauaggcagugaggaauacacagacuacaugccauccaugaaaagauucagaagagaagaggaagaggcaggggucuugugguag

SEQ ID NO: 6405 - RNA, 9876 nt, Artificial Sequence
  derived and/or modified CDS sequence (wt) from DENV-2__KF041235__SS-prME
accgcaggcgugaucaucaugcugauuccaacagcgauggcguuccauuuaaccacacgcaacggagaaccacacaugaucgucagcaaacaagagaaagggaaaagucucuuguuuaaaacagaggauggugugaacaugugcacccucauggccauggaccuuggugaacugugugaagacacaaucacuuauaacuguccucuucucaggcagaaugaaccagaagauauagauuguugguguaacuccacguccacauggguaacuuaugggacaugcacugccacaggagaacacagaagggaaaaaagaucaguggcacucgucccacaugugggaaugggauuggagacacgaacugaaacguggaugucaucagaaggggccuggaaacacgcccagagaauugaaaccuggaucuugagacauccagguuuuaccauaauggcagcaaucuuggcauacaccauaggaacgacauauuuccaaagaguccugaucuucaucuuacugacagcugucgcuccuucaaugacaaugcguuguauuggaauaucaaauagagacuuuguggaagggguuucaggaggaagcuggguugacauagucuuagaacauggaagcugugugacaacgauggcaaaaaacaaaccaacauuggacuuugaacugauaaaaacagaagccaagcaaccugccacucuaaggaaguacuguauagaggcaaagcugaccaacacaacaacagcaucucgaugcccaacacaaggggaacccagccuaaaugaagaacaggacaaaagguuugucugcaaacauuccaugguagacagaggauggggaaauggauguggauuauuuggaaagggaggcauugugaccugugcuauguucacaugcaaaaaaaacauggaagggaaaauugugcaaccagaaaaccuggaauacaccauugugguaacaccucauucaggggaagagaaugcaguuggaaaugacacaggaaaacauggcaaggaaaucaaagugacaccacagaguuccauuacagaagcagaacugacaggcuacggcacugucacgauggagugcucuccaagaacgggccucgacuucaaugagaugguguugcugcaaauggaaaacaaggcuuggcuggugcacaggcaaugguucuuagaccugccguuaccaugguugcccggagcggacauacaaggaucaaauuggauacagaaggagacguuggucacuuucaaaaauccccaugcgaagaaacaggauguuguuguuuuaggaucccaagaaggggcuaugcauacagcacuuacaggggccacggaaauccagaugucaucaggaaaccuacuguucacaggacaucucaagugcaggcugagaauggauaaauuacagcucaaaggaaugucauacucuauguguacaggaaaguuuaaaguuguaaaggaaauagcagaaacacaacauggaacaauaguugucagaguacaauaugaaggggauggcucuccauguaaaaucccuuuugagauaauggauuuggaaaaaagacaugucuuaggucgccugauuacagucaacccaaucgucacagaaaaagacaguccagucaacauagaagcagaacccccauucggagacagcuacaucauuauaggaguagaaccgggacaacugaagcucagcugguuuaagaaaggaagcucaaucggccaaauguucgagacaacaaugagaggagcgaagagaauggccauuuuaggugacacagccugggauuuuggaucccugggaggaguguucacaucuauaggaaaggcccuccaccaaguuuuuggagcaaucuauggggcugccuucagugggguuucauggacuaugaaaauccucauaggaguugucaucacauggauaggaaugaauucacguagcaccucacugucugugucacuaguauuagugggagucgugacauuguacuugggaguuauggugcaggcugauagugguuguguugugaguuggaaaaacaaagaacugaaauguggcagugggauuuucaucacagauaauguacacacauggacagaacaauacaaauuccaaccagaaucccccucaaagcuggcuucagcuauccagaaagcucaugaagaaggcauuuguggaauccgcucaguaacaagacuggagaaucuaauguggaaacaaauaacaccagaacugaaucacauucuaucagaaaaugagguaaaguugucuaucaugacaggggacaucaaaggaaucaugcaggcaggaaaacgaucccugcggccucagcccacugagcugaaauauucauggaaaacguggggcaaagcgaaaaugcucuccacagagccucauaaccagaccuuucucauugauggccccgaaacagcagaaugucccaacacaaacagagcuuggaacucacuagaaguugaagacuauggcuuugggguauucaccaccaacauauggcugaaguugaaagaaaggcaggauguguuuugugacucaaaacucaugucagcggccauaaaagacaacagagccguccaugccgauauggguuauuggauagaaagcgcacuuaaugacacauggaagauagaaaaagcuucuuuuaucgaaguuaaaaguugccacuggccaaaaucacacacucucuggaguaacggagugcuagaaagugagaugauaauuccaaagaauuuugcuggaccaguaucgcaacauaauuacagaccaggcuaucacacacaaacggcaggaccuuggcaucuaggcaagcuugagauggacuuugauuuuugcgaaggaaccacagugguggugacugaggacugcggaaauagaggacccucucuaagaacaacuacugcuucuggaaaacucauaacagaauggugcugccgauccugcacauuaccaccacuaagauacagaggcgaggauggauguugguacggaauggaaaucagaccauugaaagagaaagaagagaacuuggucaauucuuuggucacagccggacauggacagauugacaacuucucacuaggagucuugggaauggcacuguuccuggaagaaaugcucaggacccgaguaggaacaaaacaugcaguauuacugguugcaguuucuuucaugacauugaucacagggaacaugucuuuccgagaccuggggagagugaugguuauggugggggccgcuaugacggaugacauagguaugggcgugacuuaucuugccuuacuagcagccuucaaaguuagaccaacuuuugcagcuggacugcuuuugagaaagcugaccuccaaggaauugaugaugaccaccauaggaaucguacuccucucccagagcaccacaccagagacuauacuugaacugacugaugcguuggcuuugggcaugaugauucuuaagauagugagaaacauggaaaaguaucaauuggcagugacuaucauggcuaucuuauguguuccaaaugcagugauauuacaaaaugcauggaaagugagcugcacaauacuggcagcgguguccguauccccacugcucuuaacaucuucgcagcagaaagcggauuggauaccauuggcauugacgaucaaaggucucaauccaacagccauuuuccuaacaacccuuucaagaacuaacaagaaaaggaguuggccacuaaaugaggcuaucauggcagucgggauggugagcauuuuagcuaguucucucuugaagaaugacauucccaugacaggaccauuaguggcuggagggcuucucacuguguguuacgugcucacuggaagaucggccgaccuggaacuagagagagccgccgacguuagaugggaagaucaggcagaaauaucaggaagcaguccaauucugucaauaacaauaucggaagauggcagcaugucgauaaaaaaugaagaggaagaacaaacacugaccauacucauuagaacaggauugcuggugauaucaggacuuuuccccguaucaauaccaaucacggcagcagcaugguaccugugggaagugaagaaacaacgggccggaguauugugggacguuccuucacccccaccugugggaaaggcugaacuggaagauggagcuuacagaaucaagcagaaagggauucuuggauacucccagaucggagcuggaguuuacaaagaaggaacauuccacacaauguggcacgucacacguggugcuguucuaaugcacaaagggaagaggauugaaccaucaugggcggaugucaggaaagaccuaauaucauauggaggaggcuggaagcuagaaggagaauggaaggaaggagaagaaguccaggucuuggcauuagagccuggaaagaauccaagagccguccaaacaaaacccggucuuuuuaagacuaacaccggaaccauaggcgcugugucccuagacuuuucuccuggaacgucaggaucuccaaucgucgacaaaaaaggaaaagucgugggucucuaugguaauggugucgucacaaggaguggaacauaugugagugccauagcccagacugaaaaaagcauugaagacaauccagagauugaagaugauaucuuucgaaaaaaaagauugaccauuauggaccuccacccaggagcgggaaagacgaaaagauaccuuccagcaauaguuagagaggccauaaaacgaggcuuaagaacauuaauccuggcccccacuagagucguggcagcugaaauggaagaagcucuuagaggacuuccaauaagauaccaaaccccagccaucagagcugagcacacugggcgagaaaucguggauuuaaugugucaugccacauuuaccaugaggcuguuaucaccaguuagagugccaaauuacaacuugaucauuauggaugaagcccauuucacagacccagcaagcauagcagcuagaggauacauuucaacucgaguagagaugggugaagcagcugggauuuucaugacagcaacucccccgggaagcagagacccauuuccucaaagcaaugcaccaaucauggaugaagaaagggaaaucccugaacguucguggaacucuggacaugaguggguuacagauuucaaagggaagacuguuugguuuguuccgaguauaaaagcagguaaugauauagcagcuugccugagaaaaaauggaaagaaagugauacaacucaguaggaagaccuuugauucugaauacauuaagaccaggaccaaugauugggacuuuguggucacgacugacauuucagaaaugggugcuaacuucaaggcugaaaggguuauagaccccaggcgcugcaugaaaccagucauacuaacggacggugaagagcgggugauccuggcaggacccaugccagugacccacucuagugcagcacaaagaagagggagaauaggaagaaauccaaaaaaugaaaaugaccaguacauauacaugggggaaccucuggaaaaugaugaagacugcgcacacuggaaagaagccaagaugcuuuuagacaacaucaacacgccugaaggaaucauucccagcauguucgaaccagagcgugaaaagguggaugcuauugauggugaauaccgcuuaagaggagaagcgaggaaaaccuuuguggaucuaaugagaagaggagaccuaccagucuggcuggccuacagaguggcagccgaaggcauuaacuaugcagacagaaggugguguuuugauggaaucaagaacaaccaaaucuuagaagaaaauguggaaguggaaaucuggacaaaagaaggggaaaggaagaaacugaaacccagauggcuggaugcucggaucuacucugacccacuggcgcucaaagaauucaaagaguuugcagcuggaagaaaaucccugacccugaauuuaaucacagaaauggguaggcuuccaacuuuuaugacucagaaagcaaggaacgcacuggacaacuuagcaguccugcauacggcugaagcaggcggaagggcguacaaucaugcucucagugaacugccagagacucuggagacauugcuuuugcugacacuuuuggccacagucacgggcggaaucuuuuuauuuuugaugaguggcaaagguauagggaaaaugacccugggaaugugcugcauaaucacggccaguauucuccuaugguacgcacaaauacagccacacuggauagcagcuucaauaauacuggaguuuuuucucauagucuugcucauuccagagccagaaaagcaaagaacaccccaagauaaccaauugacuuacguugucauagccauccucacagugguggccgcaaccauggcaaaugagaugggguuccuggaaaaaacgaagaaagauuucggauugggaagcauugcaacccagcaacccgagagcaacauccuggacauagaucuacguccugcaucagcauggacccuguaugcaguggccacaacauuuaucacaccaauguugagacauagcauugaaaauuccucagugaacgugucucuaacagccauugcuaaucaagccacagugcuaaugggucuugggaaaggauggccauugucgaaaauggacauuggaguuccccuucucgccaucgggugcuauucacaagucaaccccauaacccucacagcagcccuucuuuuauugguagcacauuacgcuaucauagggccaggacuccaagcgaaagcaaccagagaagcgcagaaaagagcagcagcaggcaucaugaaaaacccaacuguggauggaauaacagugauugaccuagauccaauacccuaugacccaaaauuugagaagcagcugggacaaguaaugcuccuaguccucugcgugacucaaguacugaugaugaggacuacaugggcuuugugugaggcucuaaccuuagcgaccgggcccaucuccacauugugggaaggaaauccagggagauucuggaauacaaccauugcagugucaauggcuaacauuuuuagaggaaguuaccuagcuggagcuggacuucucuuuuccaucaugaagaacacaaccaacacaagaaggggaacuggcaacacaggagagacgcuuggagagaaauggaaaaaccgauugaauucauuggggaagagugaauuccagauuuacaagagaagcggaauucaggaaguggauagaaccuuggcaaaagaaggcauuaaaagaggagaaacggaccaucaugcugugucgcgaggcucagcaaagcugagaugguucgucgagagaaaccugguuacaccagaggggaaaguaguggaccucgguugcgguagagggggcuggucauacuauugugggggucuaaagaauguaagagaagucaaaggccuaacaaaaggaggaccaggacacgaagaacccauucccaugucaacauauggguggaaucuugugcgucuccaaaguggaguugaugucuucuuuacuccaccagaaaaaugugacacauuguugugugauauaggggagucgucaccaaaucccacgguugaagcuggacgaacacucagaguccuaaacuugguagaaaauuggcugaacaacaacacccaauuuugcauaaagguucuuaacccauacaugcccucagucauagaaaaaauggaaacgcugcaaaggaaauacggaggagcuuuggugaggaauccccucucaagaaauuccacacaugagauguauuggguauccaaugcuuccgggaacauagugucaucagugaacaugauuucaaggauguugaucaauagauuuacaaugagacauaagaaggccacauacgagccagauguugaccucggaagcggaacccgcaacaucggaaucgaaagugagacaccaaaccuagacauaauugggaaaagaauagaaaaaauaaaacaagagcaugagacaucauggcacuaugaccaagaccacccauauaaaacgugggccuaccauggcagcuacgaaacaaaacagacuggaucagcaucauccauggugaauggaguaguuagacugcugacaaaaccuugggacgucaucccuauggugacacagauggcaaugacagacacgaccccauuuggacaacagcguguuuucaaagagaaaguggacacgagaacccaagaaccgaaagaaggcacgaagaaacuaaugaaaaucacggccgaauggcucuggaaagaacuagggaagaaaaagacaccuagaaugugcacuagagaagaauucgcaagaaaggugagaagcaaugcagcccuaggugccauauucacugaugagaacaaguggaagucggcacgugaggcuguugaagacaguagauuuugggaacuaguugacaaggaaaggaaucuccaucuugaaggaaagugugagacauguguguacaacaugaugggaaagagagagaagaagauaggggaauucggcaaagcaaaaggcagcagagccauaugguacauguggcuuggagcacgcuucuuagaguuugaagcccuaggauuucugaaugaagaucacugguuuuccagagagaacucucugagcggaguggaaggagaagggcugcacaagcuggguuacauucuaagagaagugagcaagaaagaaggaggagcaauguacgccgacgacacagcaggaugggauacaagaaucacacuagaggaccuaaaaaaugaagagaugguaacaaaccauauggaaggagaacacaagaaacuugcugaggccaucuucaaauuaacguaccaaaacaagguggugcgugugcaaagacccacaccaagaggcacaguaauggauauuauaucgagaagagaccaaagagguaguggacaaguuggcaccuauggccucaacaccuuuaccaauaugggagcccaacuaaucagacagauggagggagagggagucuuuaaaggcauccagcaucugacagccacagaagaaguugcagugcaagacugguuagcaagaguggggcgugagagguuaucaagaauggccaucaguggagaugauuguguugugaaacccuuagaugacagguuugcaagcgcuuuaacagcucuaaaugacaugggaaagguuaggaaagacauacaacaaugggaaccuucaagaggauggaacgacuggacacaagugccuuucuguucacaccauuuccaugaguuaaucaugaaagacggucgugugcucguaguuccauguagaaaccaagaugaacugauugguagagcucgaauuucccagggagccggguggucuuugcgggagacggccugucuggggaagucuuacgcccaaauguggagccugauguacuuccacagacgugaccucaggcuggcagcaaacgcuauuugcucggcaguuccaucacauuggguuccgacaagucgaacaaccugguccauacacgccagacaugaauggaugacaacagaagacaugcugacagucuggaacaggguguggauucaagaaaacccauggauggaagacaaaacuccaguggaaucgugggaggaaaucccauacuuggggaaaagagaagaccaauggugcggcucauugauaggguuaacaagcagggccaccugggcaaggaacauccaaacagcaauaaaccaaguuagauccuuaauaggcagugaggaauacacagacuacaugccauccaugaaaagauucagaagagaagaggaagaggcaggggucuugugguag

SEQ ID NO: 6406 - RNA, 9876 nt, Artificial Sequence
  derived and/or modified CDS sequence (wt) from DENV-2__KF041237__SS-prME
accgcaggcgugaucaucaugcugauuccaacagcgauggcguuccauuuaaccacacgcaacggagaaccacacaugaucgucagcaaacaagagaaagggaaaagucucuuguuuaaaacagaggauggugugaacaugugcacccucauggccauggaccuuggugaacugugugaagacacaaucacuuauaacuguccucuucucaggcagaaugaaccagaagauauagauuguugguguaacuccacguccacauggguaacuuaugggacaugcacugccacaggagaacacagaagggaaaaaagaucaguggcacucgucccacaugugggaaugggauuggagacacgaacugaaacguggaugucaucagaaggggccuggaaacacgcccagagaauugaaaccuggaucuugagacauccagguuuuaccauaauggcagcaaucuuggcauacaccauaggaacgacauauuuccaaagaguccugaucuucaucuuacugacagcugucgcuccuucaaugacaaugcguuguauuggaauaucaaauagagacuuuguggaaggggucucaggaggaagcuggguugacauagucuuagaacauggaagcugugugacaacgauggcaaaaaacaaaccaacauuggacuuugaacugauaaaaacagaagccaagcaaccugccacucuaaggaaguacuguauagaggcaaagcugaccaacacaacaacagcaucucgaugcccaacacaaggggaacccagccuaaaugaagaacaggacaaaagguuugucugcaaacauuccaugguagacagaggauggggaaauggauguggauuauuuggaaagggaggcauugugaccugugcuauguucacaugcaaaaaaaacauggaagggaaaauugugcaaccagaaaaccuggaauacaccauugugguaacaccucauucaggggaagagaaugcaguuggaaaugacacaggaaaacauggcaaggaaaucaaagugacaccacagaguuccauuacagaagcagaacugacaggcuacggcacugucacgauggagugcucuccaagaacgggccucgacuucaaugagaugguguugcugcaaauggaaaacaaggcuuggcuggugcacaggcaaugguucuuagaccugccguuaccaugguugcccggagcggacauacaaggaucaaauuggauacagaaggagacguuggucacuuucaaaaauccccaugcgaagaaacaggauguuguuguuuuaggaucccaagaaggggcuaugcauacagcacuuacaggggccacggaaauccagaugucaucaggaaaccuacuguucacaggacaucucaagugcaggcugagaauggauaaauuacagcucaaaggaaugucauacucuauguguacaggaaaguuuaaaguuguaaaggaaauagcagaaacacaacauggaacaauaguugucagaguacaauaugaaggggauggcucuccauguaaaaucccuuuugagauaauggauuuggaaaaaagacaugucuuaggucgccugauuacagucaacccaaucgucacagaaaaagacaguccagucaacauagaagcagaacccccauucggagacagcuacaucauuauaggaguagaaccgggacaacugaagcucagcugguuuaagaaaggaagcucaaucggccaaauguucgagacaacaaugagaggagcgaagagaauggccauuuuaggugacacagccugggauuuuggaucccugggaggaguguucacaucuauaggaaaggcccuccaccaaguuuuuggagcaaucuauggggcugccuucagugggguuucauggacuaugaaaauccucauaggaguugucaucacauggauaggaaugaauucacguagcaccucacugucugugucacuaguauuagugggagucgugacauuguacuugggaguuauggugcaggcugauagugguuguguugugaguuggaaaaacaaagaacugaaauguggcagugggauuuucaucacagacaaugugcacacauggacagaacaauacaaauuccaaccagaaucccccucaaagcuggcuucagcuauccagaaagcucaugaagaaggcauuuguggaauccgcucaguaacaagacuggagaaucuaauguggaaacaaauaacaccagaacugaaucacauucuaucagaaaaugagguaaaguugucuaucaugacaggggacaucaaaggaaucaugcaggcaggaaaacgaucccugcggccucagcccacugagcugaaauauucauggaaaacguggggcaaagcgaaaaugcucuccacagagccucauaaccagaccuuucucauugauggccccgaaacagcagaaugucccaacacaaacagagcuuggaacucacuagaaguugaagacuauggcuuugggguauucaccaccaacauauggcugaaguugaaagaaaggcaggauguguuuugugacucaaaacucaugucagcggccauaaaagacaacagagccguccaugccgauauggguuauuggauagaaagcgcacuuaaugacacauggaagauagaaaaagcuucuuuuaucgaaguuaaaaguugccacuggccaaaaucacacacucucuggaguaacggagugcuagaaagugagaugauaauuccaaagaauuuugcuggaccaguaucgcaacauaauuacagaccaggcuaucacacacaaacggcaggaccuuggcaucuaggcaagcuugagauggacuuugauuuuugcgaaggaaccacagugguggugacugaggacugcggaaauagaggacccucucuaagaacaacuacugcuucuggaaaacucauaacagaauggugcugccgauccugcacauuaccaccacuaagauacagaggcgaggauggaugcugguacggaauggaaaucagaccauugaaagagaaagaagagaacuuggucaauucuuuggucacagccggacauggacagauugacaacuucucacuaggagucuugggaauggcacuguuccuggaagagaugcucaggacccgaguaggaacaaaacaugcaguauuacugguugcaguuucuuucaugacauugaucacagggaacaugucuuuccgagaccuagggagagugaugguuauggugggggccgcuaugacggaugacauagguaugggcgugacuuaucuugccuuacuagcagccuucaaaguuagaccaacuuuugcagcuggacugcuuuugagaaagcugaccuccaaggaauugaugaugaccaccauaggaaucguacuccucucccagagcaccacaccagagacuauacuugaacugacugaugcguuggcuuugggcaugaugauucucaagauagugagaaacauggaaaaguaucaauuggcagugacuaucauggcuaucuuauguguuccaaaugcagugauauuacaaaaugcauggaaagugagcugcacaauacuggcagcgguguccguauccccacugcucuuaacaucuucgcagcagaaagcggauuggauaccauuggcauugacgaucaaaggucucaauccaacagccauuuuccuaacaacccuuucaagaacuaacaagaaaaggaguuggccacuaaaugaggcuaucauggcagucgggauggugagcauuuuagcuaguucucucuugaagaaugacauucccaugacaggaccauuaguggcuggagggcuucucacuguguguuacgugcucacuggaagaucggccgaccuggaacuagagagagccgccgacguuagaugggaagaucaggcagaaauaucaggaagcaguccaauucugucaauaacaauaucggaagauggcagcaugucgauaaaaaaugaagaggaagaacaaacacugaccauacucauuagaacaggauugcuggugauaucaggacuuuuccccguaucaauaccaaucacggcagcagcaugguaccugugggaagugaagaaacaacgggcuggaguauugugggacguuccuucacccccaccugugggaaaggccgaacuggaagauggagcuuacagaaucaagcagaaagggauucuuggauacucccagaucggagcuggaguuuacaaagaaggaacauuccacacaauguggcacgucacacguggugcuguucuaaugcacaaagggaagaggauugaaccaucaugggcggaugucaggaaagaccuaauaucguauggaggaggcuggaagcuagaaggagaauggaaggaaggagaagaaguccaggucuuggcauuagagccuggaaagaauccaagagccguccaaacaaaacccggucuuuuuaagacuaacaccggaaccauaggcgcugugucccuagacuuuucuccuggaacgucaggaucuccaaucgucgacaaaaaaggaaaagucgugggucucuaugguaauggugucgucacaaggaguggaacauaugugagugccauagcccagacugaaaaaagcauugaagacaauccagagauugaagaugauaucuuucggaaaaaaagauugaccauuauggaccuccacccaggagcgggaaagacgaaaagauaccuuccagcaauaguuagagaggccauaaaacgaggcuuaagaacauuaauccuggcccccacuagagucguggcagcugaaauggaagaagcucuuagaggacuuccaauaagauaccaaaccccagccaucagagcugagcacacugggcgagaaaucguggauuuaaugugucaugccacauuuaccaugaggcuguuaucaccaguuagagugccaaauuacaacuugaucauuauggaugaagcccauuucacagacccagcaagcauagcagcuagaggauacauuucaacucgaguagagaugggugaagcagcugggauuuucaugacagccacucccccgggaagcagagacccauuuccucaaagcaaugcaccaaucauggaugaagaaagggaaaucccugaacguucguggaacucuggacaugaguggguuacagauuucaaagggaagacuguuugguuuguuccgaguauaaaagcagguaaugauauagcagcuugccugagaaaaaauggaaagaaagugauacaacucaguaggaagaccuuugauucugaauacaucaagaccaggaccaaugauugggacuuuguggucacgacugacauuucagaaaugggugcuaacuucaaggcugaaaggguuauagaccccaggcgcugcaugaaaccagucauacuaacggacggugaagagcgggugauccuggcaggacccaugccagugacccacucuagugcagcacaaagaagagggagaauaggaagaaauccaaaaaaugaaaaugaccaguacauauacaugggggaaccucuggaaaaugaugaagacugcgcacacuggaaagaagccaagaugcuuuuagacaacaucaacacgccugaaggaaucauucccagcauguucgaaccagagcgugaaaagguggaugcuauugauggugaauaccgcuuaagaggagaagcgaggaaaaccuuuguggaucuaaugagaagaggagaccuaccagucuggcuggccuacagaguggcagccgaaggcauuaacuaugcagacagaaggugguguuuugauggaaucaagaacaaccaaaucuuagaagaaaauguggaaguggaaaucuggacaaaagaaggggaaaggaagaaacugaaacccagauggcuggaugcucggaucuacucugacccacuggcgcucaaagaauucaaagaguuugcagcuggaagaaaaucccugacccugaauuuaaucacagaaauggguaggcuuccaacuuuuaugacucagaaagcaaggaacgcacuggacaacuuagcaguccugcauacggcugaagcaggcggaagggcguacaaucaugcucucagugaacugccagagacucuggagacauugcuuuugcugacacuuuuggccacagucacgggcggaaucuuuuuauucuugaugaguggcaaagguauagggaaaaugacccugggaaugugcugcauaaucacggccaguauucuccuaugguacgcacaaauacagccacacuggauagcagcuucaauaauacuggaguuuuuucucauagucuugcucauuccagagccagaaaagcaaagaacaccccaagauaaccaauugacuuacguugucauagccauccucacagugguggccgcaaccauggcaaaugagaugggguuccuggaaaaaacgaagaaagauuucggauugggaagcauugcaacccagcaacccgagagcaacauccuggacauagaucuacguccugcaucagcauggacccuguaugcaguggccacaacauuuaucacaccaauguugagacauagcauugaaaauuccucagugaacgugucucuaacagccauugcuaaucaagccacagugcuaaugggucuugggaaaggauggccauugucgaaaauggacauuggaguuccccuucucgccaucgggugcuauucacaagucaaccccauaacccucacagcagcccuucuuuuauugguagcacauuacgcuaucauagggccaggacuccaagcgaaagcaaccagagaagcgcagaaaagagcagcagcaggcaucaugaaaaacccaacuguggauggaauaacagugauugaccuagauccaauacccuaugacccaaaauuugagaagcagcugggacaaguaaugcuccuaguccucugcgugacucaaguacugaugaugaggacuacaugggcuuugugugaggcucuaaccuuagcgaccgggcccaucuccacauugugggaaggaaauccagggagauucuggaacacaaccauugcagugucaauggcuaacauuuuuagaggaaguuaccuagcuggagcuggacuucucuuuuccaucaugaagaacacaaccaacacaagaaggggaacuggcaacacaggagagacgcuuggagagaaauggaaaaaccgauugaauucauuggggaagagugaauuccagauuuacaagagaagcggaauucaggaaguggauagaaccuuggcaaaagaaggcauuaaaagaggagaaacggaccaucaugcugugucgcgaggcucagcaaagcugagaugguucgucgagagaaaccugguuacaccagaggggaaaguaguggaccucgguugcgguagagggggcuggucauacuauugugggggucuaaagaauguaagagaagucaaaggccuaacaaaaggaggaccaggacacgaagaacccauucccaugucaacauauggguggaaucuugugcgucuccaaaguggaguugaugucuucuuuacuccaccagaaaaaugugacacauuguugugugauauaggggagucgucaccaaaucccacgguugaagcuggacgaacacucagaguccuaaacuugguagaaaauuggcugaacaacaacacccaauuuugcauaaagguucuuaacccauacaugcccucagucauagaaaaaauggaaacgcugcaaaggaaauacggaggagcuuuggugaggaauccccucucaagaaauuccacacaugagauguauuggguauccaaugcuuccgggaacauagugucaucagugaacaugauuucaaggauguugaucaauagauuuacaaugagacauaagaaggccacauacgagccagauguugaccucggaagcggaacccgcaacaucggaaucgaaagugagacaccaaaccuagacauaauugggaaaagaauagaaaaaauaaaacaagagcaugagacaucauggcacuaugaccaagaccacccauauaaaacgugggccuaccauggcagcuacgaaacaaaacagacuggaucagcaucauccauggugaauggaguaguuagacugcugacaaaaccuugggacgucaucccuauggugacacagauggcaaugacagacacgaccccauuuggacaacagcguguuuucaaagagaaaguggacacgagaacccaagaaccgaaagaaggcacgaagaaacuaaugaaaaucacggccgaauggcucuggaaagaacuagggaagaaaaagacaccuagaaugugcacuagagaagaauucgcaagaaaggugagaagcaaugcagcccuaggugccauauucacugaugagaacaaguggaagucggcacgugaggcuguugaagacaguagauuuugggaacuaguugacaaggaaaggaaucuccaucuugaaggaaagugugagacauguguguacaacaugaugggaaagagagagaagaagauaggggaauucggcaaagcaaaaggcagcagagccauaugguacauguggcuuggagcacgcuucuuagaguuugaagcccuaggauuucugaaugaagaucacugguuuuccagagagaacucucugagcggaguggaaggagaagggcugcacaagcuggguuacauucuaagagaagugagcaagaaagaaggaggagcaauguacgccgacgacacagcaggaugggauacaagaaucacacuagaggaccuaaaaaaugaagagaugguaacaaaccauauggaaggagaacacaagaaacuugcugaggccaucuucaaauuaacguaccaaaacaagguggugcgugugcaaagacccacaccaagaggcacaguaauggauauuauaucgagaagagaccaaagagguaguggacaaguuggcaccuauggccucaacaccuuuaccaauaugggagcccaacuaaucagacagauggagggagagggagucuuuaaaggcauccagcaucugacagccacagaagaaguugcagugcaagacugguuagcaagaguggggcgugagagguuaucaagaauggccaucaguggagaugauuguguugugaaacccuuagaugacagguuugcaagcgcuuuaacagcucuaaaugacaugggaaagguuaggaaagacauacaacaaugggaaccuucaagaggauggaacgacuggacacaagugccuuucuguucacaccauuuccaugaguuaaucaugaaagacggucgugugcucguaguuccauguagaaaccaagaugaacugauugguagagcucgaauuucccagggagccggguggucuuugcgggagacggccugucuggggaagucuuacgcccaaauguggagccugauguacuuccacagacgugaccucaggcuggcagcaaacgcuaucugcucggcaguuccaucacauuggguuccgacaagucgaacaaccugguccauacacgccggacaugaauggaugacaacagaagacaugcugacagucuggaacaggguguggauucaagaaaacccauggauggaagacaaaacuccaguggaaucaugggaggaaaucccauacuuggggaaaagagaagaccaauggugcggcucauugauaggguuaacaagcagggccaccugggcaaggaacauccaaacagcaauaaaccaaguuagauccuuaauaggcagugaggaauacacagacuacaugccauccaugaaaagauucagaagagaagaggaagaggcaggggucuugugguag

SEQ ID NO: 6407 - RNA, 9876 nt, Artificial Sequence
  derived and/or modified CDS sequence (wt) from DENV-2__KM217156__SS-prME
accgcaggcgugaucaucaugcugauuccaacagcgauggcguuccauuuaaccacacgcaacggagaaccacacaugaucgucagcaaacaggagaaagggaaaagucucuuguuuaaaacagaggauggugugaacaugugcacccucauggccauggaccuuggugaacugugugaagacacaaucacuuauaacuguccucuucucaggcagaaugaaccagaagauauagauuguugguguaacgccacguccacauggguaacuuaugggacaugcacugccacaggagaacacagaagggaaaaaagaucaguggcacuugucccacaugugggaaugggauuggagacacgaacugaaacguggaugucaucagaaggggccuggaaacacgcccagaggauugaaaccuggaucuugagacauccagguuuuaccauaauggcagcaaucuuggcauacaccauaggaacgacauauuuccaaagaguccugauauucaucuuacugacagcugucgcuccuucaaugacaaugcguuguauuggaauaucaaauagagacuucguggaagggguuucaggaggaagcuggguugacauagucuuagaacauggaagcugugugacaacgauggcaaaaaacaaaccaacauuggacuuugaacugauaaaaacagaagccaagcaaccugccacucuaaggaaguacuguauagaggcaaagcugaccaacacaacaacagcaucucgaugcccaacacaaggggaacccagccuaaaugaagaacaggacaaaagguuugucugcaaacauuccaugguagacagaggauggggaaauggauguggauuauuuggaaagggaggcauugugaccugugcuauguucacaugcaagaaaaacauggaagggaaaauugugcaaccagaaaaccuggaauacaccauugugguaacaccucauucaggggaagagaaugcaguuggaaacgacacaggaaaacaugggaaggaaaucaaagugacaccacagaguuccauuacagaagcagaacugacaggcuacggcacugucacgauggagugcucuccaagaacgggccucgacuucaaugagaugguguugcugcaaauggaaaacaaggcuuggcuggugcacaggcaaugguuccuagaccugccguuaccaugguugcccggagcggacauacaaggaucaaauuggauacagaaggagacguuggucaccuucaaaaauccccaugcgaagaaacaggauguuguuguuuuaggaucccaagaaggggcuaugcauacagcacuuacaggggccacggaaauccagaugucaucaggaaacccacuguucacaggacaucucaagugcaggcugagaauggauaaauuacagcucaaaggaaugucauacucuauguguacaggaaaguuuaaaguuguaaaggaaauagcagaaacacaacauggaacaauaguugucagaauacaauaugaaggggauggcucuccauguaaaaucccuuuugagauaauggauuuggaaaaaagacaugucuuaggucgccugauuacagucaacccaaucgucacagaaaaagacaguccagucaacauagaagcagaacccccauucggagacagcuacaucauuauaggaguagaaccgggacaacugaagcucagcugguuuaagaaaggaagcucaaucggccaaauguucgagacaacaaugagaggagcgaagagaauggccauuuuaggugacacagccugggauuuuggaucccugggaggaguguucacaucuauaggaaaggcccuccaccaaguuuuuggagcaaucuauggggcugccuucagugggguuucauggacuaugaaaauccucauaggaguugucaucacauggauaggaaugaauucacguagcaccucacugucugugucacuaguauuagugggagucgugacauuguacuugggaguuauggugcaggcugauagugguuguguugugaguuggaaaaacaaagaacugaaauguggcagugggauuuucuucacagacaauguacacacauggacagaacaauacaaauuccaaccagaaucccccucaaagcuggcuucagcuauccagaaagcucaugaagaaggcauuuguggaauccgcucaauaacaagacuggauaaucuaauguggaaacaaauaacaccagaacugaaucacauucuaucagaaaaugagguaaaguugucuaucaugacaggggacaucaaaggaaucaugcaggcaggaaaacgaucccugcggccucagcccacugagcugaaauauucauggaaaacguggggcaaagcgaaaaugcucuccacagagccucauaaccagaccuuucucauugauggccccgaaacagcacaaugucccaacacaaacagagcuuggaacucacuagaaguugaagacuauggcuuugggguauucaccaccaacauauggcugaaguugaaagaaaggcaggauguguuuugugacucaaaacucaugucagcggccauaaaagacaacagagccguccaugccgauauggguuauuggauagaaagcgcacuuaaugacacauggaagauagaaaaagcuucuuuuaucgaaguuaaaaguugccacuggccaaaaucacacacucucuggaguaacggagugcuagaaagugagaugauaauuccaaagaauuuugcuggaccaguaucgcaacacaauuacagaccaggcuaucacacacaaacggcaggaccuuggcaucuaggcaagcuugagauggacuuugauuuuugcgaaggaaccacagugguggugacugaggacugcggaaauagaggacccucucuaagaacaacuacugcuucuggaaaacucauaacagaauggugcugccgauccugcacauuaccaccacucagauacagaggcgaggauggaugcugguacggaauggaaaucagaccauugaaagagaaagaagagaacuuggucaauucuuuggucacagccggacauggacagauugacaacuucucacuaggagucuugggaauggcacuguuccuggaagaaaugcucaggacccgaguaggaacaaaacaugcaguauuacugguugcaguuucuuucaugacauugaucacagggaacaugucuuuccgagaccuggggagagugaugguuauggugggggccgcuaugacggaugacauagguaugggcgugacuuaucuugccuuacuagcagccuucaaaguuagaccaacuuuugcagcuggacugcuuuugagaaagcugaccuccaaggaauugaugaugaccaccauaggaaucguacuccucucccagagcaccacaccagagacuauacuugaacugacugaugcguuggcuuugggcaugaugauucucaagauagugagaaacauggaaaaguaucaauuggcagugacuaucauggcuaucuuauguguuccaaaugcagugauauuacaaaaugcauggaaagugagcugcacaauacuggcagcgguguccguauccccacugcucuuaacaucuucgcagcagaaagcggauuggauaccauuggcauugacgaucaaaggucucaauccaacagcuauuuuccuaacaacccuuucaagaacuaacaagaaaaggaguuggccacuaaaugaggcuaucauggcagucgggauggugagcauuuuagcuaguucucucuugaagaaugacauucccaugacaggaccauuaguggcuggagggcuucucacuguguguuacgugcucacuggaagaucggccgaccuggaacuagagagagccgccgacguuagaugggaagaucaggcagaaauaucaggaaguaguccaauucugucaauaacaauaucggaagauggcagcaugucgauaaaaaaugaagaggaagaacaaacacugaccauacucauuagaacaggauugcuggugauaucaggacuuuuccccguaucaauaccaaucacggcagcagcaugguaccugugggaagugaagaaacaacgggcuggaguauugugggauguuccuucacccccaccugugggaaaggccgaacuggaagauggagcuuacagaaucaagcagaaagggauucuuggauacucccagaucggagcuggaguuuacaaagaaggaacauuccacacaauguggcacgucacacguggugcuguucuaaugcacaaagggaagaggauugaaccaucaugggcggaugucaggaaagaccuaauaucguauggaggaggcuggaagcuagaaggagaauggaaggaaggagaagaaguccaggucuuggcauuagagccuggaaagaauccaagagccguccaaacaaaacccggucuuuuuaagacuaacaccggaaccauaggcgcugugucccuagacuuuucuccuggaacgucaggaucuccaaucgucgacaaaaaaggaaaagucgugggucucuaugguaauggugucgucacaaggaguggaacauaugugagugccauagcccagacugaaaaaagcauugaagacaauccagagauugaagacgauaucuuucgaaaaaaaagauugaccauuauggaccuccacccaggagcgggaaagacgaaaagauaccuuccagcaauaguuagagaggccauaaaacgaggcuuaagaacauuaauccuggcccccacuagagucguggcagcugaaauggaggaagcucuuagaggacuuccaauaagauaccaaaccccagccaucagagcugagcacacugggcgagaaaucguggauuuaaugugucaugccacauuuaccaugaggcuguuaucaccaguuagagugccaaauuacaacuugaucauuauggaugaagcccauuucacagacccagcaagcauagcagcuagaggauacauuucaacucgaguagaaaugggugaagcagcugggauuuucaugacagccacucccccgggaagcagagacccauuuccucaaagcaaugcaccaaucauggaugaagagagggaaaucccugaacguucguggaacucuggacaugaguggguuacagauuucaaagggaagacuguuugguuuguuccgagcauaaaagcagguaaugauauagcagcuugccugagaaaaaauggaaagaaagugauacaacucaguaggaagaccuuugauucugaauacauuaagaccaggaccaaugauugggacuuuguggucacgacugacauuucagaaaugggugcuaacuucaaggcugaaaggguuauagaccccaggcgcugcaugaaaccagucauacuaacggacggugaagagcgggugauccuggcaggacccaugccagugacccacucuagugcagcacaaagaagagggagaauaggaagaaauccaaaaaaugaaaaugaccaguacauauacaugggggaaccucuggaaaaugaugaagacugcgcacacuggaaagaagccaagaugcuuuuagacaacaucaacacgccugaaggaaucauucccagcauguucgaaccagagcgugaaaagguggaugcuauugauggugaauaccgcuuaagaggagaagcgaggaaaaccuuuguggaucuaaugagaagaggagaccuaccagucuggcuggccuacagaguggcagccgaaggcauuaacuaugcagacagaaggugguguuuugauggaaucaagaacaaccaaaucuuagaagaaaauguggaaguggaaaucuggacaaaagaaggggaaaggaagaaacugaaacccagauggcuggaugcucggaucuacucugacccacuggcgcucaaagaauucaaagaguuugcagcugcaagaaaaucccugacccugaauuuaaucacagaaauggguaggcucccaacuuuuaugacucagaaagcaaggaacgcacuggacaacuuagcaguccugcauacggcugaagcaggcggaagggcguacaaccaugcucucagugaacugccagagacucuggagacauugcuuuugcugacacuuuuggccacagucacgggcggaaucuuuuuauuuuugaugaguggcaaagguauagggaaaaugacccugggaaugugcugcauaaucacggccaguauucuccuaugguacgcacaaauacagccacacuggauagcagcuucaauaauacuggaguuuuuucucauagucuugcucauuccagagccagaaaagcaaagaacaccccaagauaaccaauugacuuacguugucauagccauccucacagugguggccgcaaccauggcaaaugagaugggguuccuggaaaaaacgaagaaagauuucggacugggaagcauugcaacccagcaacccgagagcaacauccuggacauagaucuacguccugcaucagcauggacccuguaugcaguggccacaacauuuaucacaccaauguugagacauagcauugaaaauuccucagugaacgugucucuaacagccauugcuaaucaagccacagugcuaaugggucuugggaaaggauggccauugucgaagauggacauuggaguuccccuucucgccaucgggugcuauucacaagucaaccccauaacccucacagcagcccuucuuuuauugguagcacauuacgcuaucauagggccaggacuccaagcgaaagcauccagagaagcgcagaaaagagcagcagcaggcaucaugaaaaacccaacuguggauggaauaacagugauugaccuagauccaauacccuaugacccaaaauuugagaagcagcugggacaaguaaugcuccuaauccucugcgugacucaaguacugaugaugaggacuacaugggcuuugugcgaggcucuaaccuuagcgaccgggcccaucuccacauugugggaaggaaauccagggagauucuggaauacaaccauugcagugucaauggcuaacauuuuuagaggaaguuaccuagcuggagcuggacuucucuuuuccaucaugaagaacacaaccaacacaagaaggggaacuggcaacacaggagagacgcuuggagagaaauggaaaaaccgagugucauuguuggggaagagugaauuccagauuuacaagagaagcggaauucaggaaguggauagaaccuuggcaaaagaaggcauuaaaagaggagaaacggaccaucaugcugugucgcgaggcucagcaaagcugagaugguucgucgagagaaaccugguuacaccagaggggaaaguaguggaccucgguugcgguagagggggcuggucauacuauugugggggucuaaagaauguaagagaagucaaaggccuaacaaaaggaggaccaggacacgaagaacccauucccaugucaacauauggguggaaucuugugcgucuccuaacuggagcugauguuuucuuuacuccaccagaaaaaugugacacauuguugugugauauaggggagucgucaccaaaucccacgguugaagcuggacgaacacucagaguccuaaacuugguagaaaauuggcugaacaacaacacccaauuuuguauaaagguucuuaacccauacaugcccucagucauagaaaaaauggaaacgcugcaaaggaaauacggaggagcuuuggugaggaauccccucucaagaaauuccacacaugagauguauuggguauccaaugcuuccgggaacauagugucaucagugaacaugauuucaaggauguugaucaauagauuuacaaugagacauaagaaggccacauacgacccagauguugaccucggaagcggaacccgcaacaucggaaucgaaagugaaacaccaaaccuagacauaauugggaaaagaauagaaaaaauaaaacaagagcaugagacaucacggcacuaugaccaagaccacccauauaaaacuugggccuaccauggcagcuacgaaacaaaacagacuggaucagcaucauccacggugaauggaguaguuagacugcugacaaaaccuugggacgucaucccuauggugacacagauggcaaugacagacacgaccccauuuggacaacagcguguuuucaaagagaaaguggacacgagaacccaagaaccgaaagaaggcacgaagaaacuaaugaaaaucacggccgaauggcucuggaaagaacuagggaagaaaaagacaccuagaaugugcacuagagaagaauucgcaagaaaggugagaagcaaugcagcccuaggugccauauucacugaugagaacaaguggaagucggcacgugaggcuguugaagacaguagauuuugggaacuaguugacaaggaaaggaaucuccaucuugaaggaaagugugagacauguguguacaacaugaugggaaagagagagaagaagauaggggaauucggcaaagcaaaaggcagcagagccauaugguacauguggcuuggagcacgcuucuuagaguuugaagcccuaggauuucugaaugaagaucacugguuuuccagagagaacucucugagcggaguggaaggagaagggcugcacaagcuggguuacauucuaagagaagugagcaagaaagaaggaggagcaauguacgccgacgacacagcaggaugggauacaagaaucacacuagaggaccuaaaaaaugaagagaugguaacaaaccauauggaaggagaacacaagaaacuugcugaggccaucuucaaauuaacguaccaaaacaagguggugcgugugcaaagacccacaccaagaggcacaguaauggauauuauaucgagaagagaccaaagagguaguguacaaguugguaccuaugggcucggcaccuuuaccaauaugggagcccaacuaaucagacagauggagggagagggagucuuuaaaggcauccagcaucugacagccacagaagaaguugcagugcaagacugguuagcaagaguggggcgugagagguuaucaagaauggccaucaguggagaugauuguguugugaaacccuuagaugacagguuugcaagcgcuuuaacagcucuaaaugacaugggaaagguuaggaaagacauacaacaaugggaaccuucaagaggauggaacgacuggacacaagugccuuucuguucacaccauuuccaugaguuaaucaugaaagacggucgugugcucguaguugcauguagaaaccaagaugaacugauugguagagcucgaauuucccagggagccggguggucuuugcgggagacggccugucuggggaagucuuacgcccaaauguggagccugauguacuuccacagacgugaccucaggcuggcagcaaaugcuauuugcucggcaguuccaucacauuggguuccgacaagucgaacaaccugguccauacacgccggacaugaauggaugacaacagaagacaugcugacagucuggaacaggguguggauucaagaaaacccauggauggaagacaaaacuccaguggaaucaugggaggaaaucccauacuuggggaaaagagaagaccaauggugcggcucauugauaggguuaacaagcagggccaccugggcaaggaacauccaaacagcaauaaaccaaguuagauccuuaauaggcagugaggaauacacagacuacaugccauccaugaaaagauucggaagagaagaggaagaggcaggggucuugugguag

SEQ ID NO: 6408 - RNA, 9876 nt, Artificial Sequence
  derived and/or modified CDS sequence (wt) from DENV-2__KX380809__SS-prME
acugcagguauaauuauuaugaugauuccaacagugauggcguuccauuuaaccacacgcaauggagaaccacacaugaucgucaguagacaagaaaaagggaaaagucuucuguuuaaaacagagaacggugugaacauguguacccucauggccauggaccuuggugaacugugugaagacacaaucacuuauaauuguccucuucucaggcagaaugaaccagaagacauagacuguuggugcaacucuacgucuacauggguaacuuaugggacaugcaccgcuacaggagaacacagaagggaaaaaagaucaguggcacucguuccgcacgugggaaugggacuggagacacgaacugaaacauggaugucaucagaaggggccuggaaacaugcgcagagaauugaaacuugggucuugagacauccaggcuucacuguaauggcagcaauccuggcauacaccauaggaacgacauauuuccaaagaguccugauuuucaucuuacugacagcugucgcuccuucaaugacaaugcguuguauaggaauaucaaauagagacuuuguggaagggguuucaggaggaagcuggguugacauagucuuggaacauggaagcugugugacaacgauggcgaaaaauaaaccaacauuggauuuugaacugauaaaaacagaagccaaacaucccgccacucuaaggaaguauuguauagaggcaaagcugacuaacacaacaacagcaucucgcugcccaacacaaggagaaccuagccuaaaugaagaacaggacaaaagauuugucugcaaacacuccaugguagacagaggauggggaaauggaugcggauuauuuggaaagggagguaucgugaccugugcaauguucacaugcaaaaagaacauggaaggaaaaaucgugcaaccagaaaauuuggaauacaccauugugauaacaccucacucaggggaagagaaugcagucggaaaugauacaggaaaacacggcaaggaaauuaaagugacaccacagagcuccaucacagaagcagaacuaaccggcuauggcacugccacgauggaaugcucuccgagaacgggccucgacuucaaugagaugguguugcugcaaauggaaaacaaggcuuggcuagugcacaggcaaugguucuuagaccugccguuaccauggcugcccggagcagacacacaaggaucaaauuggauacagaaggagacauuggucacuuucaaaaauccccaugcaaagaaacaggauguuguuguguuaggaucccaagaaggggcuaugcacacagcacucacaggggccacggaaauccagaugucaucaggaaacuuacuguucacaggacaucuuaaaugcaggcugagaauggacaaacuacagcucaaaggaaugucauauuccauguguacaggaaaguucaaaguugugaaggaaauagcagaaacacaacauggaacaauaguuaucagaguacaauaugaaggggacgguucuccgugcaaaaucccuuuugaaauaauggauuuggaaaaaagacaugucuuaggucgcuugaucacagucaacccaauugucacagaaaaagacagcccagucaacauagaagcagaaccuccauucggagacagcuacaucauuauaggaguagaaccggggcaacugaagcucagcugguuuaagaaaggaaguucuauuggccaaauguuugagacaacaaugagaggagcgaagagaauggccauuuuaggugacacagcuugggauuuuggaucucugggaggaguguuuacaucuauaggaaaggcccuccaccaagucuuuggagcaaucuauggggcugccuucagugggguuucauggacuaugaaaauccucauaggaguugucaucacauggauaggaaugaauucacgcagcaccucacugucugugucacuaguauuagugggaaucgugacacuguauuugggaguuauggugcaggcugauaguggcugcguugugagcuggaaaaacaaagaacugaaauguggcagugggaucuuuaucacagacaacgugcacacauggacagaacaauacaaauuccaaccagaauccccuucaaaacuggcuucagcuauccagaaggcccaugaagagggcauuuguggaauccgcucaguaacaagacuggagaaucugauguggaaacaaauaacaccagaacugaaucacauucuaucagaaaaugagguaaaguugacuaucaugacaggagacauuaaaggaaucaugcaggcaggaaaacgaucccugcgaccucaacccacugagcugaaguacucuuggaaagcauggggcaaagcgaaaaugcucuccacagagcuccacaaccacaccuuucucauugauggccccgaaacagcagaaugucccaacacaaacagagcuuggaacucacuagaaguugaagacuauggcuuuggaguauucacuaccaacauauggcugaaauugaaagaaaggcaggauguauuuugugacucaaaacucaugucagcagccauaaaagacaacagagccguccacgccgauauggguuauuggauagaaagcgcacucaacgacacauggaagauugagaaagccucuuuuauugaaguuaaaagcugccacuggccaaagucacacacucucuggagcaauggagugcuagaaagugagaugauaauuccaaagaauuuugcaggaccagugucacaacacaauuacagaccaggcuaucauacacaaacggcaggacccuggcaucuaggcaggcuugagauggacuuugacuucugcgaaggaaccacagugguggugacugaggacuguggaaauagaggacccucuuuaagaacaacuacugcuucuggaaaacucauaacagaauggugcugccgaucuugcacauuaccaccgcuaagguacagaggugaggauggaugcugguauggaauggaaaucagaccauugaaagagaaagaagagaacuuggucaacucuuuggucacagccggacauggacagauugacaacuucucacuaggagucuugggaauggcauuguuccuggaagagaugcucaggacucgaguaggaacgaaacaugcaauauuauuaguugcagucucuuucgugacauugaucacagggaacauguccuuucgagauuuggggagagugauggucauggugggcgcuacuaugacggaugacauaggcaugggcgugacuuaucuugcccuauuagcagccuucaaagucagaccaacuuuugcagcuggacuacucuuaagaaagcugaccuccaaggaauugaugaugaccaccauaggaauuguacuccucucucagagcaccauaccagagacuauacuugaacugacugacgcguuggcuuuggggaugaugguucucaaaauaguaagaaacauggaaaaguaucaacuagcagugacuaucauggcuauccugugcgucccaaaugcagugauauuacaaaacgcauggaaagugagcugcacgauacuggcagugguguccguuuccccacugcuuuuaacauccucacagcagaaagcggauuggauaccacuggcguugacaaucaaaggccucaauccaacagccauuuucuuaacaacccucucaagaacuagcaagaaaaggagcuggccacuaaaugaggcuauuauggcagucgggauggugagcauuuuagccaguucucucuuaaagaaugauauucccaugacaggaccauuaguggcuggagggcuucucacuguguguuacgugcucacuggaagaucggcugauuuggaacuggaaagagcugcugacguaagaugggaggaacaggcagagauaucagggagcaguccaauucugucgauaacaauaucggaagaugguaguaugucgauaaaaaaugaagaagaagaacaaacacugaccauacuuauuagaacaggacugcuggugauaucaggacuuuuucccgugucaauaccaaucacggcagcugcaugguaccugugggaagugaaaaaacaacgagccggaguauugugggacgucccuucaccuccaccugugggaaaagccgaacuggaagauggagccuauagaaucaagcagaaagggauuuuaggauacucgcagauuggagccggaguuuacaaagaaggaacauuccacacaauguggcaugucacacguggugcuguucuaaugcacaaagggaagaggauugaaccaucaugggcggacgucaagaaagacuuaauaucguauggaggaggcuggaagcuagaaggagaauggaaggaaggagaagaaguccagguccuggcacuagagccuggaaagaauccaagagccguccaaacaaaacccggucuuuuuaaaacuaacacuggaaccauaggcgccguaucucuggacuuuucuccuggaacgucaggaucuccaauugucgacaaaaaaggaaaaguugugggccuuuauggcaacggugucgucacaaggagugggacauaugugagcgccauagcccagacugaaaaaagcaucgaagacaauccagagauugaagaugacaucuuucgaaagaaaagauugaccaucauggaccuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagcuaucagagcugagcacacuggacgggagauuguggaucuaaugugucacgccacauucaccaugaggcuacuaucaccaaucagagugccaaauuacaaccugauuaucauggaugaagcccauuuuacagacccagcaagcauagcagcuagaggauacauuucaacucgaguagagaugggugaagcagcugggauuuucaugacagccaccccuccuggaagcagagacccauuuccucagagcaacgcaccaaucauggaugaagaaagggaaaucccugagcguucguggaacucuggacaugaguggguuacggauuuuaaagggaagacuguuugguuuguuccaaguauaaaagcaggaaaugauauagcagcuugccugagaaagaauggaaagaaagugauacaacucagcaggaagaccuuugauucugaauauaucaagacuaggaccaaugauugggacuuuguggucacgacagacauuucagaaaugggugccaacuucaaggcugagaggguuauagaccccagacgcugcaugaaaccagucauacuaacagacggugaagagcgggugaucuuggcaggacccaugccagugacccacucuagugcagcacaaagaagagggagaguaggaagaaauccaaaaaaugaaaaugaccaguacauauacaugggggaaccucuggaaaaugaugaagacugugcgcacuggaaagaagcuaagaugcuucuagauaacaucaacacgccugaaggaaucauucccagcauguucgaaccagagcgugaaaagguggaugccauugauggugaauaccgcuugagaggagaagcgaggaaaacauuuguggaccuaaugagaagaggagaccuaccagucuggcuagccuacagaguggcagcugaagguaucaacuacgcagacagaagauggugcuuugauggagucaagaacaaccaaauccuggaagaaaauguggaaguggaaauuuggacaaaagaaggagaaaggaagaaauuaaaacccagaugguuagaugccaggaucuacucugacccacuggcgcucaaagaauucaaggaauucgcagcuggaagaaaaucccugaccuugaaucuaaucaccgagauggguaggcucccaaccuucaugacccagaaagcaagaaaugcauuggacaacuuagcaguccugcauacggcugaagcaggcggaagggcguacaaucaugcucuuagugaacugccggagacucuggagacauugcuuuuacugacacucuuggccacagucacggguggaaucuuccuguucuugaugagcggaaaggguauagggaaaaugacccugggaaugugcugcauaaucacggccaguauucuccuaugguaugcucaaauacagccacacuggauagcagcuucaauaauacuggaguuuuuucucauagucuugcucauuccagaaccagagaagcagagaacaccccaagauaaccaauuaacuuauguugucauagccauccuuacagugguggccgcaaccauggcaaacgagauggguuuccuggaaaagacaaagaaagauuucggauugggaagcauuacaacccagcaaccugacagcaacauccuggacauagaucuacguccugcaucagcuuggacucuauaugccguggcaacaacuuucaucacaccaauguugagacacagcauugaaaauuccucagugaaugugucucuaacagccauugcuaaccaggccacaguguuaaugggucuugggaaaggauggccauugucaaaaauggacaucggaguuccccuucucgcuauuggaugcuauucacaagucaaccccauaacucucacagcagcccuucucuuauugguagcacacuaugcuaucauagggccaggacuccaagcgaaagcaacuagagaggcucagaaaagagcagcagcggguaucaugaaaaucccaacuguggauggaauaacagugauugaccuagauccaauacccuaugauccaaaguuugagaagcaguugggacaaguaaugcucuuaguccucugcgugacucaaguauugaugaugaggacuacaugggcuuuaugugaagcucuaaccuuagcgaccgggcccaucucuacacugugggaaggaaauccagggagauuuuggaauacaacuauugcagugucaauggcuaacauuuuuagagggaguuaccuagccggagccggacuucucuuuucuaucaugaagaacacggccaacacaagaaggggaacuggcaacacaggagagacgcuuggagagaaauggaaaaaccgguuaaaugcauuggggaagagugaauuccagaucuauaagaaaaguggaauccaggaaguggauagaaccuuagcaaaagaaggcaucaaaaggggagaaacggaccaucacgcugugucgcgaggcucggcgaaacugagaugguucgucgagagaaaccuggucacaccagaagggaaaguaguggaccuuggcugcggcagggggggcuggucauacuauugugggggacuaaagaauguaaaagaagucaaaggccuaacaaaaggaggaccaggacaugaagagcccauucccaugucaacauaugguuggaaucuggugcgucuucaaaguggaguugaugucuuuuuuacuccgccagagaagugugacacauugcugugugacauaggggagucgucaccaaaccccacgguugaggcaggacgaacacucagaguucuaaacuuaguggaaaacuggcugaacaacaacacccaauuuugcauaaagguucucaacccauauaugccuucaguuauagaaaaaauggaagcgcuacaaaggaaauacggaggagcuuuggugaggaauccacucucacgaaauuccacacacgagauguacuggguauccaaugcuuccgggaacauagugucaucagugaacaugauuucaagaauguugauuaacagauucacaaugaaacauaagaaggccacauacgagccagauguugaucucggaagugggacccgcaacaucggaauugaaagugagacaccaaauuuagacauaauugggaaaagaauagaaaaaauaaaacaagagcaugaaacaucauggcacuaugaccaggaccacccauacaaaacgugggccuaccauggcagcuacgaaacaaaacagacuggaucagcaucauccauggugaacggaguaguuaggcugcuaacaaaaccuugggacgucaucccuauggugacacagauggcaaugacagacacgacuccauuuggacaacagcgcguuuucaaagaaaaaguggacacgagaacccaagaaccgaaagaaggcacgaaaaaacuaaugaaaaucacggcagaauggcucuggaaagaacuaggaaagaaaaagacaccuaggaugugcaccagagaagaauucacaagaaaggugagaagcaaugcagccuuaggugccauauucacugaugagaacaaguggaagucggcacgugaggcuguugaagacaguggauuuugggaauugguugacaaggaaaggaaucuccaucuugaaggaaagugugagacauguguguauaacaugaugggaaagagagagaagaagcuaggggaguucgguaaagcaaaaggcagcagagcuauaugguacauguggcuuggagcacgcuucuuagaguucgaagcccuaggauuuuugaaugaagaccacugguuuuccagagagaacucccugaguggaguggaaggagaagggcugcacaaacuaggcuacauuuuaagagacgugaguaagaaagaaggaggagcaauguacgccgaugacaccgcaggaugggacacaagaaucacacuagaggacuuaaaaaaugaagaaauggugacaaaccacauggaaggagaacacaggaaacuugcugaagcuauuuucagauuaacguaccaaaacaagguggugcgugugcaaagaccgacaccaagaggcacaguaauggacauuauaucgagaagagaccaaagagguaguggacaaguugucacuuacggccucaauacuuucaccaacauggaagcccaacugaucagacagauggagggagaaggagucuucaaaagcauccaacaccugacagucacagaagaaauugcagugaaaaacugguuagaaagaguggggcgugagagguuaucaagaauggccaucaguggagaugauuguguugugaaacccuuagaugacagguuugcaagcgcucuaacagcucuaaaugacaugggaaagguuaggaaagacauacaacaaugggaaccuucaagaggauggaacgauuggacacaagugcccuuuuguucacaccauuuccaugaguuaaucaugaaagacggucguguacuuguaguuccaugcagaaaccaagaugaacugauugguagggcccgaauuucccagggagccgggugguccuugcgggaaacagccuguuuggggaagucuuacgcccaaauguggagccugauguacuuccacaggcgugaccuuaggcuggcggcaaaugccauuugcucggcagucccaucacauuggguuccaacaagucgaacaaccugguccauacacgccacacaugaguggaugacaacagaagacaugcugacagucuggaacaggguguggauucaagaaaauccauggauggaagacaaaacuccaguagaaucaugggaggaaaucccauaucuggggaaaagagaagaccaauggugcggcucauugauugggcuaacaagcagggccaccugggcaaagaacauccaaacagcaauaaaucaaguuagaucccuaauaggcaaugaggaauacacagacuacaugccauccaugaaaagauucagaagagaagaggaagaggcaggagucuugugguaa

SEQ ID NO: 6409 - RNA, 9876 nt, Artificial Sequence
  derived and/or modified CDS sequence (wt) from DENV-2__KX380810__SS-prME
acugcagguauaauuauuaugaugauuccaacagugauggcguuccauuuaaccacacgcaauggagaaccacacaugaucgucaguagacaagaaaaagggaaaagucuucuguuuaaaacagagaacggugugaacauguguacccucauggccauggaccuuggugaacugugugaagacacaaucacuuauaauuguccucuucucaggcagaaugaaccagaagacauagacuguuggugcaacucuacgucuacauggguaacuuaugggacaugcaccgcuacaggagaacacagaagggaaaaaagaucaguggcacucguuccgcacgugggaaugggacuggagacacgaacugaaacauggaugucaucagaaggggccuggaaacaugcgcagagaauugaaacuugggucuugagacauccaggcuucacuguaauggcagcaauccuggcauacaccauaggaacgacauauuuccaaagaguccugauuuucaucuuacugacagcugucgcuccuucaaugacaaugcguuguauaggaauaucaaauagagacuuuguggaagggguuucaggaggaagcuggguugacauagucuuggaacauggaagcugugugacaacgauggcgaaaaauaaaccaacauuggauuuugaacugauaaaaacagaagccaaacaucccgccacucuaaggaaguauuguauagaggcaaagcugaccaacacaacaacagcaucucgcugcccaacacaaggagaaccuagccuaaaugaagaacaggacaaaagauuugucugcaaacacuccaugguagacagaggauggggaaauggaugcggauuauuuggaaagggagguaucgugaccugugcaauguucacaugcaaaaagaacauggaaggaaaaaucgugcaaccagaaaauuuggaauacaccauugugauaacaccucacucaggggaagagaaugcagucggaaaugauacaggaaaacacggcaaggaaauuaaagugacaccacagagcuccaucacagaagcagaacuaaccggcuauggcacugccacgauggaaugcucuccgagaacgggccucgacuucaaugagaugguguugcugcaaauggaaaacaaggcuuggcuagugcacaggcaaugguucuuagaccugccguuaccauggcugcccggagcagacacacaaggaucaaauuggauacagaaggagacauuggucacuuucaaaaauccccaugcaaagaaacaggauguuguuguguuaggaucccaagaaggggcuaugcacacagcacucacaggggccacggaaauccagaugucaucaggaaacuuacuguucacaggacaucuuaaaugcaggcugagaauggacaaacuacagcucaaaggaaugucauauuccauguguacaggaaaguucaaaguugugaaggaaauagcagaaacacaacauggaacaauaguuaucagaguacaauaugaaggggacgguucuccgugcaaaaucccuuuugaaauaauggauuuggaaaaaagacaugucuuaggucgcuugaucacagucaacccaauugucacaggaaaagacagcccagucaacauagaagcagaaccuccauucggagacagcuacaucauuauaggaguagaaccggggcaacugaagcucagcugguuuaagaaaggaaguucuauuggccaaauguuugagacaacaaugagaggagcgaagagaauggccauuuuaggugacacagcuugggauuuuggaucucugggaggaguguuuacaucuauaggaaaggcccuccaccaagucuuuggagcaaucuauggggcugccuucagugggguuucauggacuaugaaaauccucauaggaguugucaucacauggauaggaaugaauucacgcagcaccucacugucugugucacuaguauuagugggaaucgugacacuguauuugggaguuauggugcaggcugauaguggcugcguugugagcuggaaaaacaaagaacugaaauguggcagugggaucuuuaucacagacaacgugcacacauggacagaacaauacaaauuccaaccagaauccccuucaaaacuggcuucagcuauccagaaggcccaugaagagggcauuuguggaauccgcucaguaacaagacuggagaaucugauguggaaacaaauaacaccagaacugaaucacauucuaucagaaaaugagguaaaguugacuaucaugacaggagacauuaaaggaaucaugcaggcaggaaaacgaucccugcgaccucaacccacugagcugaaguacucuuggaaagcauggggcaaagcgaaaaugcucuccacagagcuccacaaccacaccuuucucauugauggccccgaaacagcagaaugucccaacacaaacagagcuuggaacucacuagaaguugaagacuauggcuuuggaguauucacuaccaacauauggcugaaauugaaagaaaggcaggauguauuuugugacucaaaacucaugucagcagccauaaaagacaacagagccguccacgccgauauggguuauuggauagaaagcgcacucaacgacacauggaagauugagaaagccucuuuuauugaaguuaaaagcugccacuggccaaagucacacacucucuggagcaauggagugcuagaaagugagaugauaauuccaaagaauuuugcaggaccagugucacaacacaauuacagaccaggcuaucauacacaaacggcaggacccuggcaucuaggcaggcuugagauggacuuugacuucugcgaaggaaccacagugguggugacugaggacuguggaaauagaggacccucuuuaagaacaacuacugcuucuggaaaacucauaacagaauggugcugccgaucuugcacauuaccaccgcuaagguacagaggugaggauggaugcugguauggaauggaaaucagaccauugaaagagaaagaagagaacuuggucaacucuuuggucacagccggacauggacagauugacaacuucucacuaggagucuugggaauggcauuguuccuggaagagaugcucaggacucgaguaggaacgaaacaugcaauauuauuaguugcagucucuuucgugacauugaucacagggaacauguccuuucgagauuuggggagagugauggucauggugggcgcuacuaugacggaugacauaggcaugggcgugacuuaucuugcccuauuagcagccuucaaagucagaccaacuuuugcagcuggacuacucuuaagaaagcugaccuccaaggaauugaugaugaccaccauaggaauuguacuccucucucagagcaccauaccagagacuauacuugaacugacugacgcguuggcuuuggggaugaugguucucaaaauaguaagaaacauggaaaaguaucaacuagcagugacuaucauggcuauccugugcgucccaaaugcagugauauuacaaaacgcauggaaagugagcugcacgauacuggcagugguguccguuuccccacugcuuuuaacauccucacagcagaaagcggauuggauaccacuggcguugacaaucaaaggccucaauccaacagccauuuucuuaacaacccucucaagaacuagcaagaaaaggagcuggccacuaaaugaggcuauuauggcagucgggauggugagcauuuuagccaguucucucuuaaagaaugauauucccaugacaggaccauuaguggcuggagggcuucucacuguguguuacgugcucacuggaagaucggcugauuuggaacuggaaagagcugcugacguaagaugggaggaacaggcagagauaucagggagcaguccaauucugucgauaacaauaucggaagaugguaguaugucgauaaaaaaugaagaagaagaacaaacacugaccauacuuauuagaacaggacugcuggugauaucaggacuuuuucccgugucaauaccaaucacggcagcugcaugguaccugugggaagugaaaaaacaacgagccggaguauugugggacgucccuucaccuccaccugugggaaaagccgaacuggaagauggagccuauagaaucaagcagaaagggauuuuaggauacucgcagauuggagccggaguuuacaaagaaggaacauuccacacaauguggcaugucacacguggugcuguucuaaugcacaaagggaagaggauugaaccaucaugggcggacgucaagaaagacuuaauaucguauggaggaggcuggaagcuagaaggagaauggaaggaaggagaagaaguccagguccuggcacuagagccuggaaagaauccaagagccguccaaacaaaacccggucuuuuuaaaacuaacacuggaaccauaggcgccguaucucuggacuuuucuccuggaacgucaggaucuccaauugucgacaaaaaaggaaaaguugugggccuuuauggcaacggugucgucacaaggagugggacauaugugagcgccauagcccagacugaaaaaagcaucgaagacaauccagagauugaagaugacaucuuucgaaagaaaagauugaccaucauggaccuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagcuaucagagcugagcacacuggacgggagauuguggaucuaaugugucacgccacauucaccaugaggcuacuaucaccaaucagagugccaaauuacaaccugauuaucauggaugaagcccauuuuacagacccagcaagcauagcagcuagaggauacauuucaacucgaguagagaugggugaagcagcugggauuuucaugacagccaccccuccuggaagcagagacccauuuccucagagcaacgcaccaaucauggaugaagaaagggaaaucccugagcguucguggaacucuggacaugaguggguuacggauuuuaaagggaagacuguuugguuuguuccaaguauaaaagcaggaaaugauauagcagcuugccugagaaagaauggaaagaaagugauacaacucagcaggaagaccuuugauucugaauauaucaagacuaggaccaaugauugggacuuuguggucacgacagacauuucagaaaugggugccaacuucaaggcugagaggguuauagaccccagacgcugcaugaaaccagucauacuaacagacggugaagagcgggugaucuuggcaggacccaugccagugacccacucuagugcagcacaaagaagagggagaguaggaagaaauccaaaaaaugaaaaugaccaguacauauacaugggggaaccucuggaaaaugaugaagacugugcgcacuggaaagaagcuaagaugcuucuagauaacaucaacacgccugaaggaaucauucccagcauguucgaaccagagcgugaaaagguggaugccauugauggugaauaccgcuugagaggagaagcgaggaaaacauuuguggaccuaaugagaagaggagaccuaccagucuggcuagccuacagaguggcagcugaagguaucaacuacgcagacagaagauggugcuuugauggagucaagaacaaccaaauccuggaagaaaauguggaaguggaaauuuggacaaaagaaggagaaaggaagaaauuaaaacccagaugguuagaugccaggaucuacucugacccacuggcgcucaaagaauucaaggaauucgcagcuggaagaaaaucccugaccuugaaucuaaucaccgagauggguaggcucccaaccuucaugacccagaaagcaagaaacgcauuggacaacuuagcaguccugcauacggcugaagcaggcggaagggcguacaaucaugcucuuagugaacugccggagacucuggagacauugcuuuuacugacacucuuggccacagucacggguggaaucuuccuguucuugaugagcggaaaggguauagggaaaaugacccugggaaugugcugcauaaucacggccaguauucuccuaugguaugcucaaauacagccacacuggauagcagcuucaauaauacuggaguuuuuucucauagucuugcucauuccagaaccagagaagcagagaacaccccaagauaaccaauuaacuuauguugucauagccauccuuacagugguggccgcaaccauggcaaacgagauggguuuccuggaaaagacaaagaaagauuucggauugggaagcauuacaacccagcaaccugacagcaacauccuggacauagaucuacguccugcaucagcuuggacucuauaugccguggcaacaacuuucaucacaccaauguugagacacagcauugaaaauuccucagugaaugugucucuaacagccauugcuaaccaggccacaguguuaaugggucuugggaaaggauggccauugucaaaaauggacaucggaguuccccuucucgcuaucggaugcuauucacaagucaaccccauaacucucacagcagcccuucucuuauugguagcacacuaugcuaucauagggccaggacuccaagcgaaagcaacuagagaggcucagaaaagagcagcagcggguaucaugaaaaucccagcugccgacaucggaacagugauugaccuagauccaauacccuaugauccaaaguuugagaagcaguugggacaaguaaugcucuuaguccucuguucuacucaaguauugaugaugaggacuacaugggcuuuaugugaagcucuaaccuuagcgaccgggcccaucucuacacugugggaaggaaauccagggagauuuuggaauacaacuauugcagugucaauggcuaacauuuuuagagggaguuaccuagccggagccggacuucucuuuucuaucaugaagaacacggccaacacaagaaggggaacuggcaacacaggagagacgcuuggagagaaauggaaaaaccgguuaaaugcauuggggaagagugaauuccagaucuauaagaaaaguggaauccaggaaguggauagaaccuuagcaaaagaaggcaucaaaaggggagaaacggaccaucacgcugugucgcgaggcucggcgaaacugagaugguucgucgagagaaaccuggucacaccagaagggaaaguaguggaccuuggcugcggcagggggggcuggucauacuauugugggggacuaaagaauguaaaagaagucaaaggccuaacaaaaggaggaccaggacaugaagagcccauucccaugucaacauaugguuggaaucuggugcgucuucaaaguggaguugaugucuuuuuuacuccgccagagaagugugacacauugcugugugacauaggggagucgucaccaaaccccacgguugaggcaggacgaacacucagaguucuaaacuuaguggaaaacuggcugaacaacaacacccaauuuugcauaaagguucucaacccauauaugccuucaguuauagaaaaaauggaagcgcuacaaaggaaauacggaggagcuuuggugaggaauccacucucacgaaauuccacacacgagauguacuggguauccaaugcuuccgggaacauagugucaucagugaacaugauuucaagaauguugauuaacagauucacaaugaaacauaagaaggccacauacgagccagauguugaucucggaagugggacccgcaacaucggaauugaaagugagacaccaaauuuagacauaauugggaaaagaauagaaaaaauaaaacaagagcaugaaacaucauggcacuaugaccaggaccacccauacaaaacgugggccuaccauggcagcuacgaaacaaaacagacuggaucagcaucauccauggugaacggaguaguuaggcugcuaacaaaaccuugggacgucaucccuauggugacacagauggcaaugacagacacgacuccauuuggacaacagcgcguuuucaaagaaaaaguggacacgagaacccaagaaccgaaagaaggcacgaaaaaacuaaugaaaaucacggcagaauggcucuggaaagaacuaggaaagaaaaagacaccuaggaugugcaccagagaagaauucacaagaaaggugagaagcaaugcagccuuaggugccauauucacugaugagaacaaguggaagucggcacgugaggcuguugaagacaguggauuuugggaauugguugacaaggaaaggaaucuccaucuugaaggaaagugugagacauguguguauaacaugaugggaaagagagagaagaagcuaggggaguucgguaaagcaaaaggcagcagagcuauaugguacauguggcuuggagcacgcuucuuagaguucgaagcccuaggauuuuugaaugaagaccacugguuuuccagagagaacucccugaguggaguggaaggagaagggcugcacaaacuaggcuacauuuuaagagacgugaguaagaaagaaggaggagcaauguacgccgaugacaccgcaggaugggacacaagaaucacacuagaggacuuaaaaaaugaagaaauggugacaaaccacauggaaggagaacacaggaaacuugcugaagcuauuuucagauuaacguaccaaaacaagguggugcgugugcaaagaccgacaccaagaggcacaguaauggacauuauaucgagaagagaccaaagagguaguggacaaguugucacuuacggccucaauacuuucaccaacauggaagcccaacugaucagacagauggagggagaaggagucuucaaaagcauccaacaccugacagucacagaagaaauugcagugaaaaacugguuagaaagaguggggcgugagagguuaucaagaauggccaucaguggagaugauuguguugugaaacccuuagaugacagguuugcaagcgcucuaacagcucuaaaugacaugggaaagguuaggaaagacauacaacaaugggaaccuucaagaggauggaacgauuggacacaagugcccuuuuguucacaccauuuccaugaguuaaucaugaaagacggucguguacuuguaguuccaugcagaaaccaagaugaacugauugguagggcccgaauuucccagggagccgggugguccuugcgggaaacagccuguuuggggaagucuuacgcccaaauguggagccugauguacuuccacaggcgugaccuuaggcuggcggcaaaugccauuugcucggcagucccaucacauuggguuccaauaagucgaacaaccugguccauacacgccacacaugaguggaugacaacagaagacaugcugacagucuggaacaggguguggauucaagaaaauccauggauggaagacaaaacuccaguagaaucaugggaggaaaucccauaucuggggaaaagagaagaccaauggugcggcucauugauugggcuaacaagcagggccaccugggcaaagaacauccaaacagcaauaaaucaaguuagaucccuaauaggcaaugaggaauacacagacuacaugccauccaugaaaagauucagaagagaagaggaagaggcaggagucuugugguaa

SEQ ID NO: 6410 - RNA, 9876 nt, Artificial Sequence
  derived and/or modified CDS sequence (wt) from DENV-2__KX380811__SS-prME
acugcagguauaauuauuaugaugaucccaacagugauggcguuccauuuaaccacacgcaacggagaaccacacaugauuguuaguagacaagagaaagggaaaagucuccuguuuaaaacagagaacggugugaacauguguacccucauggccauggaccuuggugaacugugugaagacacaaucacuuauaauuguccucuucucaggcagaaugaaccagaagacauagacuguuggugcaacuccacgucuacauggguaacuuaugggacaugcaccgccacaggagaacacagaagggaaaaaagaucaguggcacucguuccacaugugggaaugggacuggagacacgaacugaaacauggaugucaucagaaggggccuggaaacaugcccagagaauugaaacuuggaucuugagacauccaggcuucaccauaauggcagcaauccuggcauacaccauaggaacaacauauuuccaaagaguccugauuuucauuuuacugacagcugucacuccuucaauggcaaugcguugcauaggaauaucaaauagagacuuuguggaagggguuucaggaggaagcuggguugauauagucuuggaacauggaagcugugugacgacgauggcgaaaaauaaaccaacguuggauuuugaacugauaaaaacagaagccaaacaucucgccacucuaaggaaguauuguguagaggcaaagcugaccaacacaacaacagcaucucgcugcccaacacaaggagaaccuagccuaaacgaagaacaggacaaaagauucgucugcaaacacuccaugguagacagaggauggggaaauggaugcggauuauuuggaaagggaggcaucgugaccugugcaauguucacaugcaaaaagaacauggaaggaaaagucgugcaaccagaaaacuuggaguacaccaucgugauaacaccucacucaggggaagagaaugcagucggaaaugacacaggaaaacauggcaaggaaauuaaaguaacaccacagaguuccaucacagaagcagaacuaacaggcuacggcacugucacgauggaaugcucuccgagaacgggccucgacuucaaugagaugguguugcugcaaauggaaaacaaggcuuggcuggugcacaggcaaugguucuuagaccugccguuaccauggcugcccggagcagacacacaaggaucaaauuggauacagaaggagacacuggucacuuucaaaaauccccaugcaaagaaacaggauguuguuguuuuagguucccaagaaggggccaugcacacggcacucacaggggccacggaaauccagaugucaucaggaaacuuacuguucacaggacaucuuaagugcaggcugagaauggacaaacuacagcucaaaggaaugucauauuccauguguacaggaaaguucaaaguugugaaggaaauagcagaaacacaacauggaacaauaguuauuagaguacaauaugaaggggacgguuccccgugcaagaucccuuuugaaauaauggacuuggaaaaaaggcaugucuuaggucgcuugauuaccgucaacccaauugucacagaaaaagacagcccagucaacauagaagcagaaccuccauuuggagacaguuacaucauuauaggaguagaaccaggacaacugaagcucagcugguuuaagaaaggaaguucuauuggccaaauguuugagacaacaaugagaggagcgaagagaauggccauucuaggugacacagcuugggauuuuggaucccugggaggaguguucacaucuauaggaaaggcccuccaccaagucuuuggagcuaucuauggggcugccuucagugggguuucauggacuaugaaaauccucauaggagucgucaucacauggauaggaaugaauucacgcagcaccucacugucugugucacuaguauuagugggggucgugacauuguauuugggaguuauggugcaggccgauagugggugcguugucaguuggaaaaacaaagaacugaaaugugguagugggauuuuuaucacagacaacgugcacacauggacagaacaauacaaauuccaaccagaauccccuucaaagcuggcuucagcuauccagaaggcucaugaagaaggcauuuguggaauccgcucaguaacaagacuggagaaucugauguggaaacaaauaacaccagaauugaaucacauucuaacagaaaaugaaguaaaguugacuaucaugacaggagacaucaaaggaaucaugcaggcaggaaaacgaucccugcggccucaacccacugagcugaaguacuccuggaaggcauggggcaaagcgaaaaugcuuuccacagagcuucauaaccacaccuuucucauugauggccccgaaacagcagaaugucccaacacaaacagagcuuggaacucacuagaaguugaagacuauggcuuuggaguauucaccacuaacauauggcugaaauugaaagaaaggcaggauguguuuugugacucaaaccucaugucggcagccauaaaggacaauagagccguccacgccgauauggguuauuggauagaaagcgcacucaaugacacauggaagauugagaaagccucuuuuauugaaguuaaaagcugccacuggccaaagucacacacucucuggaguaauggagugcuggaaagugagaugauaauuccaaagaauuuugcaggaccaguuucacaacacaauuacagaccaggcuaccacacacaaacggcaggacccuggcaucuagguaggcuugagauggacuuugauuucugcgaaggaaccacagugguggugacugaggacuguggaaauagaggacccuccuuaagaacaacuacugcuucuggaaaacucauaacagaguggugcugccgaucuugcacauuaccaccgcuaagguacagaggugaggauggaugcugguaugguauggaaaucaggccauugaaagagaaagaagagaaccuggucaacucuuuggucacagccggacauggacagauugacaacuucucacuaggagucuugggaauggcauuguuccuggaagaaaugcucaggacucgaguaggaacgaaacaugcaauauuacuaguugcagucucuuucgugacauugaucacagggaacauguccuuucgagauuuggggagagugauggucauggugggcgcuacuaugacggaugacauaggcaugggcgugacuuaucuugcccuauuagcagccuuuaaagucagaccaaccuuugcggcuggacuacucuuaagaaagcugaccuccaaggaauugaugaugaccaccauaggaaucguacuccucucucagaguaccauaccagagagcauacuugaacugacugacgcguuggcuuuagggaugaugguucucaaaauagugagaaacauggaaaaguaucagcuagcagugacuaucauggcaaucuugugcgucccaaaugcagugauauugcaaaaugcauggaaagugagcugcacaacacuggcagugguguccguuuccccacugcuuuuaacauccucacagcagaaagcggauuggauaccacuggcguugacgaucaaaggccucaauccaacagccauuuucuuaacaacucucucaagaacuagcaagaaaaggagcuggccacuaaaugaggcuauuauggcagucgggauggugagcauucuagcuaguucucucuuaaagaaugauauucccaugacaggaccauuaguggcuggagggcuucucacuguguguuacgugcucacuggaaggucggcugacuuggaacuggaaagagcugcugacguaagaugggaagaacaggcagagauaucaggaaguaguccaauucugucgauaacaauaucggaagaugguagcaugucgauaaagaaugaagaagaagaacagacacugaccauacucaucagaacaggacuacuggugauaucaggacuuuuuccugugucaauaccaaucacggcagcugcaugguaccuuugggaagugaaaaaacaacgagcaggaguauugugggaugucccuucacccccaccugugggaaaggccgaacuggaagauggagccuauagaaucaagcagaaagggauccuaggauacucacagauuggagccggaguuuacaaagaaggaacauuccacacaauguggcaugucacacguggugcuguccuaaugcauaaagggaagagaauugaaccaucaugggcggacgucaagaaagaccuaauaucguauggaggaggcuggaagcuggaaggagaauggaaggaaggagaagaaguccagguccuggcauuagagccuggaaagaauccaagagccguccaaacaaaacccggucuuuuuaaaaccaacacuggaaccauaggcgccgugucucuggacuuuucuccuggaacgucaggaucuccaaucgucgauaaaaaaggaaaaguugugggccuuuauggcaacggugucgucacaaggaguggaacauaugugagugccauagcccagacugaaaaaagcaucgaagacaauccagagauugaagaugacaucuuuagaaagaaaagauugaccaucauggaccuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagcuaucagagcugagcacacugggcgggagauuguggaucuaaugugucaugccacauuuaccaugaggcuauuaucaccaauuagagugccaaauuacaaccugaucaucauggaugaagcccauuucacagacccagcaagcauagcagcuagaggauacauuucaacucgaguagagaugggugaagcagcugggauuuucaugacagccaccccuccuggaagcagagacccauuuccccagagcaacgcaccaaucauggaugaagaaagagaaaucccugagcguucguggaacucuggacaugaguggguuacggauuuuaaagggaagacuguuugguuuguuccaaguauaaaagcagggaaugauauagcagcuugccugagaaagaauggaaagaaagugauacaacucagcaggaaaacuuuugauucugaauauaucaagacuaggaccaaugauugggacuuuguggucacgacagacauuucagaaaugggugcuaacuucaaggcugagaggguuauagaccccagacgcugcaugaaaccagucauauuaacagacggugaagagcgggugaucuuggcaggacccaugccagugacccauucuagugcagcacaaagaagagggagaguaggaagaaauccaaaaaaugaaaaugaccaguacauauacaugggggaaccucuggaaaaugaugaagacugugcacacuggaaagaagcuaagaugcucuuggauaacaucaacacgccugaaggaaucauucccagcauguucgaaccagagcgugaaaagguggaugccauugauggugaauaccgcuugagaggagaagcgaggaaaacuuuuguggaccuaaugagaagaggagauuuaccagucuggcuagccuacagaguggcggcugaaggcaucaacuacgcagacagaagauggugcuuugauggagucaagaacaaccaaaucuuggaagaaaauguggaaguagaaauuuggacaaaagaaggagaaaggaagaaauuaaaacccagaugguuggaugcuaggaucuacucugacccauuggcgcucaaagaauucaaggaauucgcagcuggaagaaagucccugacccugaaucuaaucacagagauggguagacucccaaccuuuaugacccagaaagcaaagaaugcacucgacaacuuagcaguccugcauacggcugaagcaggcggaagggcguacaaucaugcucuuagugaacugccggagacucuggagacauugcuuuuacugacacuuuuggccacagucacgggcggaaucuuccuguucuugaugagcggaaaggguauagggaagaugacccugggaaugugcugcauaaucacggcuaguauccucuuaugguaugcacaaauacagccacacuggauagcagcuucaauaauacuggaguuuuuucucauagucuugcucauuccagaaccagaaaaacagagaacaccccaagauaaccaguuaacuuauguugucauagccauccuuacaguaguggccgcaaccauggcaaacgagauggguuuccuggaaaaaacaaagaaagauuucggauugggaagcauuacaacccagcaaccugagaguaacauccuggacauagaucuacguccugcaucagcuuggacucuauaugccguggcaacaacuuucaucacaccaauguugaggcauagcauugaaaacuccucagugaaugugucccuaacagccauugccaaccaagccacaguguuaaugggucuugggaaaggauggccauugucaaaaauggacaucggaguuccccuucucgcuaucgggugcuauucacaagucaaccccauaacucucacugcagcccuucucuuauugguagcccauuaugccaucauagggccaggacuccaagcgaaagcaacuagagaggcucagaaaagagcagcagcgggcaucaugaaaaucccaacuguggauggaaugacagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcaaccgggcccaucucuacacugugggaaggaaauccagggagauuuuggaauacaacuauugcagugucaauggcuaacauuuuuagagggagcuaccuggccggggccggacuucucuuuucuaucaugaaaaacacggccaacacaagaaggggaacuggcaacacaggagagacgcuuggggagaaauggaaaaaccgguugaaugcauuagggaagagugaauuccagaucuacaagaaaaguggaauccaggaaguggacagaaccuuagcaaaagaaggcaucaaaagaggagaaacggaccaucacgcugugucgcgaggcucagcgaaacugagaugguucgucgagagaaaccuggucacaccagaagggaaaguaguggaccuuggcugcggcagggggggcuggucauacuauugugggggacuaaagaauguaaaagaagucaaaggccuaacaaaaggaggaccaggacacgaagaacccauucccaugucaacauaugguuggaaucuggugcgccuucaaaguggaguugauguuuuuuucacuccgccagaaaagugugacacacugcugugugacauaggggagucgucaccaaaccccacgguugaggcaggacgaacacucagaguucuaaacuuaguggaaaauuggcugaacaacaacacccaauuuugcauaaagguucuuaacccauacaugcccucaguuauagaaaaaauggaagcacuacaaaggaaauacggaggagcuuuggugaggaauccacucucacgaaauuccacacacgagauguacuggguauccaaugcuuccgggaauauagugucaucagugaacaugauuucaagaauguugauuaacagauucacaaugagacacaagaaagccacauacgagccagauguugaccucggaaguggaacccgcaacaucggaauugaaagugagacaccaaauuuagacauaauugggaaaagaauagaaaaaauaaaacaagagcaugaaacaucauggcacuaugaccaagaccacccauacaaaacgugggccuaccauggcagcuacgaaacaaaacagacuggaucagcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccgaaagaaggcacgaaaaaacuaaugaaaauuacugcagaauggcucuggaaagaacuaggaaagaaaaagacaccuaggaugugcaccagagaagaauucacaagaaaggugagaagcaaugcagcuuuaggugccauauucacugaugagaacaaguggaagucggcacgugaggcuguugaagacaguggauuuugggaauugguugacaaggaaaggaaucuccaucuugaaggaaagugugaaacauguguguauaacaugaugggaaagagagagaagaagcuaggggaguucggcaaagcaaaaggcagcagagccauaugguacauguggcuuggagcacgcuucuuagaguuugaagcucuaggauucuugaaugaagaucacugguuuuccagagagaacucccugaguggaguggaaggagaagggcuacacaagcuaggcuacauuuuaagagacgugaguaagaaagaaggaggagcaauguaugcugaugacaccgcaggaugggacacaagaaucacacuagaggacuuaaaaaaugaagaaauggugacaaaccacauggaaggagaacacaagaaacuugcugaagccauuuucaaauuaacguaccaaaacaagguggugcgugugcaaagaccaacaccaagaggcacaguaauggacauuauaucgagaagagaccaaagagguaguggacaaguugucaccuacggccucaauacuuucaccaauauggaagcccaacugaucagacagauggagggagaaggaguuuucaaaagcauccagcaacugacaguaaaagaagaaauugcagugaaaaacugguuaauaagaguggggcgugagagguuaucaagaauggccaucaguggagaugauuguguugugaaacccuuagaugacagguuugcaagugcucuaacagcucuaaaugacaugggaaagguuaggaaagacauacaacaaugggaaccuucaagaggauggaacgauuggacacaagugcccuuuuguucacaccauuuccaugaguuaaucaugaaggacggucgugugcucguaguuccaugcagaaaccaagaugaacugauuggcagggcccgaauuucccagggagccgggugguccuugcgggaaacagccugucuggggaaguccuacgcccaaauguggagccugauguacuuccacagacgugaccuuaggcuggcggcaaaugccauuugcucggcagucccaucacauuggauuccaacaagucgaacaaccugguccauacacgccacacaugaguggaugacaacagaagacauguugacagucuggaacaggguguggauucaagaaaacccauggauggaagacaaaacuccaguagaaucaugggaggaaaucccguauuuggggaaaagagaagaccaauggugcggcucauugauugggcuaacaagcagggccaccugggcaaagaacauucaaacagcaauaaaucaaguuagaucccuaauaggcaaugaggaauacacagacuacaugccaucuaugaaaagauucagaagagaagaggaagaggcaggagucuugugguag

SEQ ID NO: 6411 - RNA, 9876 nt, Artificial Sequence
  derived and/or modified CDS sequence (wt) from DENV-2__KX380813__SS-prME
acugcagguauaauuauuaugaugaucccaacagugauggcguuccauuuaaccacacgcaacggagaaccacacaugaucguuaguagacaagagaaagggaaaagucuccuguuuaaaacagagaacggugugaacauguguacccucauggccauggaccuuggugaacugugugaagacacaaucacuuauaauuguccucuucucaggcagaaugaaccagaagacauagacuguuggugcaacuccacgucuacauggguaacuuaugggacaugcaccgccacaggagaacacagaagggaaaaaagaucaguggcacucguuccacaugugggaaugggacuggagacacgaacugaaacauggaugucaucagaaggggccuggaaacaugcccagagaauugaaacuuggaucuugagacauccaggcuucaccauaauggcagcuauccuggcauacaccauaggaacaacauauuuccaaagaguccugauuuucauuuuacugacagcugucacuccuucaauggcaaugcguuguauaggaauaucaaauagagacuuuguggaagggguuucaggaggaagcuggguugauauagucuuggaacauggaagcugugugacgacgauggcgaaaaauaaaccaacgcuggauuuugaacugauaaaaacagaagccaaacaucucgccacucuaaggaaguauuguguagaggcaaagcugaccaacacaacaacagcaucucgcugcccaacacaaggagaaccuagccuaaaugaagaacaggacaaaagauucgucugcaaacacuccaugguagacagaggauggggaaauggaugcggauuauuuggaaagggaggcaucgugaccugugcaauguucacaugcaaaaagaacauggaaggaaaagucgugcaaccagaaaacuuggaguacaccaucgugauaacaccucacucaggggaagagaaugcagucggaaaugacacaggaaaacauggcaaggaaauuaaaguaacaccacagaguuccaucacagaagcagaacuaacaggcuacggcacugucacgauggaaugcucuccgagaacgggccucgacuucaaugagaugguguugcugcaaauggaaaacaaggcuuggcuggugcacaggcaaugguucuuagaccugccguuaccauggcugcccggagcagacacacaaggaucaaauuggauacagaaggagacacuggucacuuucaaaaauccccaugcaaagaaacaggauguaguuguuuuagguucccaagaaggggccaugcacacggcacucacaggggccacggaaauccagaugucaucaggaaacuuacuguucacaggacaucuuaagugcaggcugagaauggacaaacuacagcucaaaggaaugucauauuccauguguacaggaaaguucaaaguugugaaggaaucugcagaaacacaacauggaacaauaguuauuagaguacaauaugaaggggacgguuccccgugcaagaucccuuuugaaauaauggacuuggaaaaaaggcaugucuuaggacgcuugauuaccgucaacccaauugucacagaaaaagacagcccagucaacauagaagcagaaccuccauuuggagacaguuacaucauuauaggaguagaaccaggacaacugaagcucagcugguucaagaaaggaaguucuauuggccaaauguuugagacaacaaugagaggagcgaagagaauggccauuuuaggugacacagcuugggauuuuggaucccugggaggaguguucacaucuauaggaaaggcccuccaccaagucuuuggagcuaucuauggggcugccuucagugggguuucauggacuaugaaaauccucauaggagucgucaucacauggauaggaaugaauucacgcagcaccucacugucugugucacuaguauuagugggggucgugacauuguauuugggaguuauggugcaggccgauagugggugcguugugaguuggaaaaacaaagaacugaaaugugguagugggauuuuuaucacagacaacgugcacacauggacagaacaauacaaauuccaaccagaauccccuucaaagcuggcuucagcuauccagaaggcucaugaagaaggcauuuguggaauccgcucaguaacaagacuggagaaucugauguggaaacaaauaacaccagaauugaaucacauucuaacagaaaaugaaguaaaguugacuaucaugacaggagacaucaaaggaaucaugcaggcaggaaaacgaacccugcggccucaacccacugagcugaaguacuccuggaaggcauggggcaaagcgaaaaugcuuuccacagagcuucauaaccacaccuuucucauugauggccccgaaacagcagaaugucccaacacaaacagagcuuggaacucacuagaaguugaagacuauggcuuuggaguauucaccacuaacauauggcugaaauugaaagaaaggcaggauguguuuugugacucaaaacucaugucagcagccauaaaggacaauagagccguccacgccgauauggguuauuggauagaaagcgcacucaaugacacauggaagauugagaaagccucuuuuauugaaguuaaaagcugccacuggccaaagucacacacucucuggaguaauggagugcuggaaagugagaugauaauuccaaagaauuuugcaggaccaguuucacaacacaauuacagaccaggcuaccacacacaaacggcaggacccuggcaucuagguaggcuugagauggacuuugauuucugcgaaggaaccacagugguggugacugaggacuguggaaauagaggacccuccuuaagaacaacuacugcuucuggaaaacucauaacagaguggugcugccgaucuugcacauuaccaccgcuaagguacagaggugaggauggaugcugguaugguauggaaaucaggccauugaaagagaaagaagagaaccuggucaacucuuuggucacagccggacauggacagauugacaacuucucacuaggagucuugggaauggcauuguuccuggaagagaugcucaggacucgaguaggaacgaaacaugcaauauuacuaguugcagucucuuucgugacauugaucacagggaacauguccuuucgagauuuggggagagugauggucauggugggcgcuacuaugacggaugacauaggcaugggcgugacuuaucuugcccuauuagcagccuuuaaaaucagaccaaccuuugcggcuggacuacucuuaagaaagcugaccuccaaggaauugaugaugaccaccauaggaaucguacuccucucucagaguaccauaccagagagcauacuugaacugacugacgcguuggcuuuggggaugaugguucuuaaaauagugagaaacauggaaaaguaucagcuagcagugacuaucauggcaaucuugugcgucccaaaugcagugauauugcaaaaugcauggaaagugagcugcacaacacuggcagugguguccguuuccccacugcuuuuaacauccucacagcagaaagcggauuggauaccacuggcguugacgaucaaaggccucaauccaacagccauuuucuuaacaacucucucaagaacuagcaagaaaaggagcuggccacuaaaugaggcuauuauggcagucgggauggugagcauucuagcuaguucucucuuaaagaaugauauucccaugacaggaccauuaguggcuggagggcuucucacuguguguuacgugcucaccggaaggucggcugacuuggaacuggaaagagcugcugacguaagaugggaagaacaggcagagauaucaggaaguaguccaauucugucgauaacaauaucggaagaugguagcaugucgauaaagaaugaagaagaagaacagacacugaccauacucaucagaacaggacuacuggugauaucaggacuuuuuccugugucaauaccaaucacggcagcugcaugguaccuuugggaagugaaaaaacaacgagcaggaguauugugggaugucccuucacccccaccugugggaaaggccgaacuggaagauggagccuauagaaucaagcagaaagggauccuaggauacucacagauuggagccggaguuuacaaagaaggaacauuccacacaauguggcaugucacacguggugcuguccuaaugcauaaagggaagagaauugaaccaucaugggcggacgucaagaaagaccuaauaucguauggaggaggcuggaagcuggaaggagaauggaaggaaggagaagaaguccagguccuggcauuagagcccggaaagaauccaagagccguccaaacaaaacccggucuuuuuaaaaccaacacuggaaccauaggcgccgugucucuggacuuuucuccuggaacgucaggaucuccaaucgucgauaaaaaaggaaaaguugugggccuuuauggcaacggugucgucacaaggaguggaacauaugugagugccauagcccagacugaaaaaagcaucgaagacaauccagagauugaagaugacaucuuuagaaagaaaagauugaccaucauggaccuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagcuauuagagcugagcacacugggcgggagauuguggaucuaaugugucaugccacauuuaccaugaggcuauuaucaccaauuagagugccaaauuacaaccugaucaucauggaugaagcccauuucacagacccagcaagcauagcagcuagaggauacauuucaacucgaguagagaugggugaagcagcugggauuuucaugacagccaccccuccuggaagcagagacccauuuccccagagcaacgcaccaaucauggaugaagaaaaagaaaucccugagcguucguggaacucuggacaugaguggguuacggauuuuaaagggaagacuguuugguuuguuccaaguauaaaagcagggaaugauauagcagcuugccugagaaagaauggaaagaaagugauacaacucagcaggaaaacuuuugauucugaauauaucaagacuaggaccaaugauugggacuuuguggucacgacagacauuucagaaaugggugcuaacuucaaggcugagaggguuauagaccccagacgcugcaugaaaccagucauauuaacagacggugaagagcgggugaucuuggcaggacccaugccagugacccauucuagugcagcacaaagaagagggagaguaggaagaaauccaaaaaaugaaaaugaccaguacauauacaugggggaaccucuggaaaaugaugaagacugugcacacuggaaagaagcuaagaugcucuuggauaacaucaacacgccugaagggaucauucccagcauguucgaaccagagcgugaaaagguggaugccauugauggugaauaccgcuugagaggagaagcgaggaaaacuuuuguggaccuaaugagaagaggagauuuaccagucuggcuagccuacagaguggcggcugaaggcaucaacuacgcagacagaagauggugcuuugauggagucaagaacaaccaaaucuuggaagaaaauguggaaguagaaauuuggacaaaagaaggagaaaggaagaaauuaaaacccagaugguuggaugcuaggaucuacucugacccauuggcgcucaaagaauucaaggaauucgcagcuggaagaaagucccugacccugaaucuaaucacagagauggguagacucccaaccuucaugacccagaaagcaaagaaugcacucgacaacuuagcaguccugcauacggcugaagcaggcggaagggcguacaaucaugcucuuagugaacugccggagacucuggagacauugcuuuuacugacacuuuuggccacagucacgggcggaaucuuccuguucuugaugagcggaaaggguauagggaagaugacccugggaaugugcugcauaaucacggcuaguauccucuuaugguaugcacaaauacagccacacuggauagcagcuucaauaauacuggaguuuuuucucauagucuugcucauuccagaaccagaaaaacagagaacaccccaagauaaccaguuaacuuauguugucauagccauccuuacaguaguggccgcaaccauggcaaacgagauggguuuccuggaaaaaacaaagaaagauuucggauugggaagcauuacaacccagcaaccugagaguaacauccuggacauagaucuacguccugcaucagcuuggacucuauaugccguggcaacaacuuucaucacaccaauguugaggcauagcauugaaaacuccucagugaaugugucccuaacagccauugccaaccaagccacaguguuaaugggucuugggaaaggauggccauugucaaaaauggacaucggaguuccccuucucgcuaucgggugcuauucacaagucaaccccauaacucucacugcagcccuucucuuauugguagcccauuaugccaucauagggccaggacuccaagcgaaagcaacuagagaggcucagaaaagagcagcagcgggcaucaugaaaaacccaacuguggauggaaugacagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcaaccgggcccaucucuacacugugggaaggaaauccagggagauuuuggaauacaacuauugcagugucaauggcuaacauuuuuagagggaguuaccuggccggagccggacuucucuuuucuaucaugaaaaacacggccaacacaagaaggggaacuggcaacacaggagagacgcuuggggagaaauggaaaaaccgguugaaugcauuagggaagagugaauuccagaucuacaagaaaaguggaauccaggaaguggacagaaccuuagcaaaagaaggcaucaaaagaggagaaacggaccaucacgcugugucgcgaggcucagcgaaacugagaugguucgucgagagaaaccuggucacaccagaagggaaaguaguggaccuuggcugcggcagggggggcuggucauacuauugugggggacuaaagaauguaaaagaagucaaaggccuaacaaaaggaggaccaggacacgaagaacccauucccaugucaacauaugguuggaaucuggugcgccuucaaaguggaguugauguuuucuucacuucgccagaaaagugugacacacugcugugugacauaggggagucgucaccaaaccccacgguugaggcaggacgaacacucagaguucuaaacuuaguggaaaauuggcugaacaacaacacccaauuuugcauaaagguucuuaacccauacaugcccucaguuauagaaaaaauggaagcacuacaaaggaaauacggaggagcuuuggugaggaauccacucucacgaaauuccacacacgagauguacuggguauccaaugcuuccgggaauauagugucaucagugaacaugauuucaagaauguugauuaacagauucacaaugagacacaagaaagccacauacgagccagauguugaccucggaaguggaacccgcaacaucggaauugaaagugagacaccaaauuuagacauaauugggaaaagaauagaaaaaauaaaacaagagcaugaaacaucauggcacuaugaccaagaccacccauacaaaacgugggccuaccauggcagcuacgaaacaaaacagacuggaucagcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccgaaagaaggcacgaaaaaacuaaugaaaauuacugcagaauggcucuggaaagaacuaggaaagaaaaagacaccuaggaugugcaccagagaagaauucacaagaaaggugagaagcaaugcagccuuaggugccauauucacugaugagaacaaguggaagucggcacgugaggcuguugaagacaguggauuuugggaauugguugacaaggaaaggaaucuccaucuugaaggaaagugugaaacaugcguguauaacaugaugggaaagagagagaagaagcuaggggaguucggcaaagcaaaaggcagcagagccauaugguacauguggcuuggagcacgcuucuuagaguuugaagcucuaggauucuugaacgaagaucacugguuuuccagagagaacucccugaguggaguggaaggagaagggcuacacaagcuaggcuacauuuuaagagacgugaguaagaaagaaggaggagcaauguaugcugaugacaccgcaggaugggacacaagaaucacacuagaggacuugaaaaaugaagaaauggugacaaaccacauggaaggagaacacaagaaacuugcugaagccauuuucaaauuaacguaccaaaacaagguggugcgugugcaaagaccaacaccaagaggcacaguaauggacauuauaucgagaagagaccaaagagguaguggacaaguugucaccuacggccucaauacuuucaccaauauggaagcccaacugaucagacagauggagggagaaggaguuuucaaaagcauccagcaacugacaguaaaagaagaaauugcagugaaaaacugguuaauaagaguggggcgugagagguuaucaagaauggccaucaguggagaugauuguguugugaaacccuuagaugacagguuugcaagugcucuaacagcucuaaaugacaugggaaagguuaggaaagacauacaacaaugggaaccuucaagaggauggaacgauuggacacaagugcccuuuuguucacaccauuuccaugaguuaaucaugaaggacggucgcgugcucguaguuccaugcagaaaccaagaugaacugauuggcagggcccgaauuucccagggagccgggugguccuugcgggaaacagccugucuggggaaguccuacgcccaaauguggagccugauguacuuccacagacgugaccuuaggcuggcggcaaaugccauuugcucggcagucccaucacauuggauuccaacaagucgaacaaccugguccauacacgccacacaugaguggaugacaacagaagacauguugacagucuggaacaggguguggauucaagaaaacccauggauggaagacaaaacuccaguagaaucaugggaagaaaucccguauuuggggaaaagagaagaccaauggugcggcucauugauugggcuaacaagcagggccaccugggcaaagaacauccaaacagcaauaaaucaaguuagaucccuaauaggcaaugaggaauacacagacuacaugccaucuaugaaaagauucagaagagaagaggaagaggcaggagucuugugguag

SEQ ID NO: 6412 - RNA, 9876 nt, Artificial Sequence
  derived and/or modified CDS sequence (wt) from DENV-2__KX380814__SS-prME
acugcagguauaauuauuaugaugaucccaacagugauggcguuccauuuaaccacacgcaacggagaaccacacaugaucguuaguagacaagagaaagggaaaagucuccuguuuaaaacagagaacggugugaacauguguacccucauggccauggaccuuggugaacugugugaagacacaaucacuuauaauuguccucuucucaggcagaaugaaccagaagacauagacuguuggugcaacuccacgucuacauggguaacuuaugggacaugcaccgccacaggagaacacagaagggaaaaaagaucaguggcacucguuccacaugugggaaugggacuggagacacgaacugaaacauggaugucaucagaaggggccuggaaacaugcccagagaauugaaacuuggaucuugagacauccaggcuucaccauaauggcagcuauccuggcauacaccauaggaacaacauauuuccaaagaguccugauuuucauuuuacugacagcugucacuccuucaauggcaaugcguuguauaggaauaucaaauagagacuuuguggaagggguuucaggaggaagcuggguugauauagucuuggaacauggaagcugugugacgacgauggcgaaaaauaaaccaacgcuggauuuugaacugauaaaaacagaagccaaacaucucgccacucuaaggaaguauuguguagaggcaaagcugaccaacacaacaacagcaucucgcugcccaacacaaggagaaccuagccuaaaugaagaacaggacaaaagauucgucugcaaacacuccaugguagacagaggauggggaaauggaugcggauuauuuggaaagggaggcaucgugaccugugcaauguucacaugcaaaaagaacauggaaggaaaagucgugcaaccagaaaacuuggaguacaccaucgugauaacaccucacucaggggaagagaaugcagucggaaaugacacaggaaaacauggcaaggaaauuaaaguaacaccacagaguuccaucacagaagcagaacuaacaggcuacggcacugucacgauggaaugcucuccgagaacgggccucgacuucaaugagaugguguugcugcaaauggaaaacaaggcuuggcuggugcacaggcaaugguucuuagaccugccguuaccauggcugcccggagcagacacacaaggaucaaauuggauacagaaggagacacuggucacuuucaaaaauccccaugcaaagaaacaggauguaguuguuuuagguucccaagaaggggccaugcacacggcacucacaggggccacggaaauccagaugucaucaggaaacuuacuguucacaggacaucuuaagugcaggcugagaauggacaaacuacagcucaaaggaaugucauauuccauguguacaggaaaguucaaaguugugaaggaaauagcagaaacacaacauggaacaauaguuauuagaguacaauaugaaggggacgguuccccgugcaagaucccuuuugaaauaauggacuuggaaaaaaggcaugucuuaggacgcuugauuaccgucaacccaauugucacagaaaaagacagcccagucaacauagaagcagaaccuccauuuggagacaguuacaucauuauaggaguagaaccaggacaacugaagcucagcugguucaagaaaggaaguucuauuggccaaauguuugagacaacaaugagaggagcgaagagaauggccauuuuaggugacacagcuugggauuuuggaucccugggaggaguguucacaucuauaggaaaggcccuccaccaagucuuuggagcuaucuauggggcugccuucagugggguuucauggacuaugaaaauccucauaggagucgucaucacauggauaggaaugaauucacgcagcaccucacugucugugucacuaguauuagugggggucgugacauuguauuugggaguuauggugcaggccgauagugggugcguugugaguuggaaaaacaaagaacugaaaugugguagugggauuuuuaucacagacaacgugcacacauggacagaacaauacaaauuccaaccagaauccccuucaaagcuggcuucagcuauccagaaggcucaugaagaaggcauuuguggaauccgcucaguaacaagacuggagaaucugauguggaaacaaauaacaccagaauugaaucacauucuaacagaaaaugaaguaaaguugacuaucaugacaggagacaucaaaggaaucaugcaggcaggaaaacgaacccugcggccucaacccacugagcugaaguacuccuggaaggcauggggcaaagcgaaaaugcuuuccacagagcuucauaaccacaccuuucucauugauggccccgaaacagcagaaugucccaacacaaacagagcuuggaacucacuagaaguugaagacuauggcuuuggaguauucaccacuaacauauggcugaaauugaaagaaaggcaggauguguuuugugacucaaaacucaugucagcagccauaaaggacaauagagccguccacgccgauauggguuauuggauagaaagcgcacucaaugacacauggaagauugagaaagccucuuuuauugaaguuaaaagcugccacuggccaaagucacacacucucuggaguaauggagugcuggaaagugagaugauaauuccaaagaauuuugcaggaccaguuucacaacacaauuacagaccaggcuaccacacacaaacggcaggacccuggcaucuagguaggcuugagauggacuuugauuucugcgaaggaaccacagugguggugacugaggacuguggaaauagaggacccuccuuaagaacaacuacugcuucuggaaaacucauaacagaguggugcugccgaucuugcacauuaccaccgcuaagguacagaggugaggauggaugcugguaugguauggaaaucaggccauugaaagagaaagaagagaaccuggucaacucuuuggucacagccggacauggacagauugacaacuucucacuaggagucuugggaauggcauuguuccuggaagagaugcucaggacucgaguaggaacgaaacaugcaauauuacuaguugcagucucuuucgugacauugaucacagggaacauguccuuucgagauuuggggagagugauggucauggugggcgcuacuaugacggaugacauaggcaugggcgugacuuaucuugcccuauuagcagccuuuaaaaucagaccaaccuuugcggcuggacuacucuuaagaaagcugaccuccaaggaauugaugaugaccaccauaggaaucguacuccucucucagaguaccauaccagagagcauacuugaacugacugacgcguuggcuuuggggaugaugguucuuaaaauagugagaaacauggaaaaguaucagcuagcagugacuaucauggcaaucuugugcgucccaaaugcagugauauugcaaaaugcauggaaagugagcugcacaacacuggcagugguguccguuuccccacugcuuuuaacauccucacagcagaaagcggauuggauaccacuggcguugacgaucaaaggccucaauccaacagccauuuucuuaacaacucucucaagaacuagcaagaaaaggagcuggccacuaaaugaggcuauuauggcagucgggauggugagcauucuagcuaguucucucuuaaagaaugauauucccaugacaggaccauuaguggcuggagggcuucucacuguguguuacgugcucaccggaaggucggcugacuuggaacuggaaagagcugcugacguaagaugggaagaacaggcagagauaucaggaaguaguccaauucugucgauaacaauaucggaagaugguagcaugucgauaaagaaugaagaagaagaacagacacugaccauacucaucagaacaggacuacuggugauaucaggacuuuuuccugugucaauaccaaucacggcagcugcaugguaccuuugggaagugaaaaaacaacgagcaggaguauugugggaugucccuucacccccaccugugggaaaggccgaacuggaagauggagccuauagaaucaagcagaaagggauccuaggauacucacagauuggagccggaguuuacaaagaaggaacauuccacacaauguggcaugucacacguggugcuguccuaaugcauaaagggaagagaauugaaccaucaugggcggacgucaagaaagaccuaauaucguauggaggaggcuggaagcuggaaggagaauggaaggaaggagaagaaguccagguccuggcauuagagcccggaaagaauccaagagccguccaaacaaaacccggucuuuuuaaaaccaacacuggaaccauaggcgccgugucucuggacuuuucuccuggaacgucaggaucuccaaucgucgauaaaaaaggaaaaguugugggccuuuauggcaacggugucgucacaaggaguggaacauaugugagugccauagcccagacugaaaaaagcaucgaagacaauccagagauugaagaugacaucuuuagaaagaaaagauugaccaucauggaccuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagcuauuagagcugagcacacugggcgggagauuguggaucuaaugugucaugccacauuuaccaugaggcuauuaucaccaauuagagugccaaauuacaaccugaucaucauggaugaagcccauuucacagacccagcaagcauagcagcuagaggauacauuucaacucgaguagagaugggugaagcagcugggauuuucaugacagccaccccuccuggaagcagagacccauuuccccagagcaacgcaccaaucauggaugaagaaaaagaaaucccugagcguucguggaacucuggacaugaguggguuacggauuuuaaagggaagacuguuugguuuguuccaaguauaaaagcagggaaugauauagcagcuugccugagaaagaauggaaagaaagugauacaacucagcaggaaaacuuuugauucugaauauaucaagacuaggaccaaugauugggacuuuguggucacgacagacauuucagaaaugggugcuaacuucaaggcugagaggguuauagaccccagacgcugcaugaaaccagucauauuaacagacggugaagagcgggugaucuuggcaggacccaugccagugacccauucuagugcagcacaaagaagagggagaguaggaagaaauccaaaaaaugaaaaugaccaguacauauacaugggggaaccucuggaaaaugaugaagacugugcacacuggaaagaagcuaagaugcucuuggauaacaucaacacgccugaagggaucauucccagcauguucgaaccagagcgugaaaagguggaugccauugauggugaauaccgcuugagaggagaagcgaggaaaacuuuuguggaccuaaugagaagaggagauuuaccagucuggcuagccuacagaguggcggcugaaggcaucaacuacgcagacagaagauggugcuuugauggagucaagaacaaccaaaucuuggaagaaaauguggaaguagaaauuuggacaaaagaaggagaaaggaagaaauuaaaacccagaugguuggaugcuaggaucuacucugacccauuggcgcucaaagaauucaaggaauucgcagcuggaagaaagucccugacccugaaucuaaucacagagauggguagacucccaaccuucaugacccagaaagcaaagaaugcacucgacaacuuagcaguccugcauacggcugaagcaggcggaagggcguacaaucaugcucuuagugaacugccggagacucuggagacauugcuuuuacugacacuuuuggccacagucacgggcggaaucuuccuguucuugaugagcggaaaggguauagggaagaugacccugggaaugugcugcauaaucacggcuaguauccucuuaugguaugcacaaauacagccacacuggauagcagcuucaauaauacuggaguuuuuucucauagucuugcucauuccagaaccagaaaaacagagaacaccccaagauaaccaguuaacuuauguugucauagccauccuuacaguaguggccgcaaccauggcaaacgagauggguuuccuggaaaaaacaaagaaagauuucggauugggaagcauuacaacccagcaaccugagaguaacauccuggacauagaucuacguccugcaucagcuuggacucuauaugccguggcaacaacuuucaucacaccaauguugaggcauagcauugaaaacuccucagugaaugugucccuaacagccauugccaaccaagccacaguguuaaugggucuugggaaaggauggccauugucaaaaauggacaucggaguuccccuucucgcuaucgggugcuauucacaagucaaccccauaacucucacugcagcccuucucuuauugguagcccauuaugccaucauagggccaggacuccaagcgaaagcaacuagagaggcucagaaaagagcagcagcgggcaucaugaaaaacccaacuguggauggaaugacagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcaaccgggcccaucucuacacugugggaaggaaauccagggagauuuuggaauacaacuauugcagugucaauggcuaacauuuuuagagggaguuaccuggccggagccggacuucucuuuucuaucaugaaaaacacggccaacacaagaaggggaacuggcaacacaggagagacgcuuggggagaaauggaaaaaccgguugaaugcauuagggaagagugaauuccagaucuacaagaaaaguggaauccaggaaguggacagaaccuuagcaaaagaaggcaucaaaagaggagaaacggaccaucacgcugugucgcgaggcucagcgaaacugagaugguucgucgagagaaaccuggucacaccagaagggaaaguaguggaccuuggcugcggcagggggggcuggucauacuauugugggggacuaaagaauguaaaagaagucaaaggccuaacaaaaggaggaccaggacacgaagaacccauucccaugucaacauaugguuggaaucuggugcgccuucaaaguggaguugauguuuucuucacuucgccagaaaagugugacacacugcugugugacauaggggagucgucaccaaaccccacgguugaggcaggacgaacacucagaguucuaaacuuaguggaaaauuggcugaacaacaacacccaauuuugcauaaagguucuuaacccauacaugcccucaguuauagaaaaaauggaagcacuacaaaggaaauacggaggagcuuuggugaggaauccacucucacgaaauuccacacacgagauguacuggguauccaaugcuuccgggaauauagugucaucagugaacaugauuucaagaauguugauuaacagauucacaaugagacacaagaaagccacauacgagccagauguugaccucggaaguggaacccgcaacaucggaauugaaagugagacaccaaauuuagacauaauugggaaaagaauagaaaaaauaaaacaagagcaugaaacaucauggcacuaugaccaagaccacccauacaaaacgugggccuaccauggcagcuacgaaacaaaacagacuggaucagcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccgaaagaaggcacgaaaaaacuaaugaaaauuacugcagaauggcucuggaaagaacuaggaaagaaaaagacaccuaggaugugcaccagagaagaauucacaagaaaggugagaagcaaugcagccuuaggugccauauucacugaugagaacaaguggaagucggcacgugaggcuguugaagacaguggauuuugggaauugguugacaaggaaaggaaucuccaucuugaaggaaagugugaaacaugcguguauaacaugaugggaaagagagagaagaagcuaggggaguucggcaaagcaaaaggcagcagagccauaugguacauguggcuuggagcacgcuucuuagaguuugaagcucuaggauucuugaacgaagaucacugguuuuccagagagaacucccugaguggaguggaaggagaagggcuacacaagcuaggcuacauuuuaagagacgugaguaagaaagaaggaggagcaauguaugcugaugacaccgcaggaugggacacaagaaucacacuagaggacuugaaaaaugaagaaauggugacaaaccacauggaaggagaacacaagaaacuugcugaagccauuuucaaauuaacguaccaaaacaagguggugcgugugcaaagaccaacaccaagaggcacaguaauggacauuauaucgagaagagaccaaagagguaguggacaaguugucaccuacggccucaauacuuucaccaauauggaagcccaacugaucagacagauggagggagaaggaguuuucaaaagcauccagcaacugacaguaaaagaagaaauugcagugaaaaacugguuaauaagaguggggcgugagagguuaucaagaauggccaucaguggagaugauuguguugugaaacccuuagaugacagguuugcaagugcucuaacagcucuaaaugacaugggaaagguuaggaaagacauacaacaaugggaaccuucaagaggauggaacgauuggacacaagugcccuuuuguucacaccauuuccaugaguuaaucaugaaggacggucgcgugcucguaguuccaugcagaaaccaagaugaacugauuggcagggcccgaauuucccagggagccgggugguccuugcgggaaacagccugucuggggaaguccuacgcccaaauguggagccugauguacuuccacagacgugaccuuaggcuggcggcaaaugccauuugcucggcagucccaucacauuggauuccaacaagucgaacaaccugguccauacacgccacacaugaguggaugacaacagaagacauguugacagucuggaacaggguguggauucaagaaaacccauggauggaagacaaaacuccaguagaaucaugggaagaaaucccguauuuggggaaaagagaagaccaauggugcggcucauugauugggcuaacaagcagggccaccugggcaaagaacauccaaacagcaauaaaucaaguuagaucccuaauaggcaaugaggaauacacagacuacaugccaucuaugaaaagauucagaagagaagaggaagaggcaggagucuugugguag

SEQ ID NO: 6413 - RNA, 9876 nt, Artificial Sequence
  derived and/or modified CDS sequence (wt) from DENV-2__KX380807__SS-prME
acugcaggcauaauuaucaugaugauuccaacagugauggcguuccauuuaaccacacgcaacggagaaccacacaugaucgucaguagacaagagaaagggaaaagucuucuguuuaaaacagagaauggugugaacauguguacccucauggccauggaccuuggugaacuaugugaagacacaaucacuuauaauuguccucuucucaggcagaaugaaccagaagacauagacuguuggugcaacucuacgucuacauggguaacuuacgggacaugcaccgccacaggagaacacagaagggaaaaaagaucaguggcacucgcuccacaugugggaaugggacuggagacacgaacugaaacauggaugucaucagaaggggccuggaaacaugcccagagaauugaaauuugggucuugagacauccaggcuucaccauaauggcagcaauccuggcuuacaccauaggaacgacauauuuccaaagaguccugaucuuuaucuuacugacagcugucgcucccucaaugacaaugcgcugcauaggaauaucaaauagggacuuuguggaagggguaucaggaggaagcuggguugacauagucuuggaacauggaagcugugugacgacgauggcgaaaaauaaaccaacauuggauuuugaacugaucaaaacagaagccaaacaccccgccacucuaaggaaguauuguauagaggcaaagcugaccaacacaacaacagcaucucgcugcccaacacaaggagaaccuagccuaaaugaagaacaggacaaaagauuugucugcaaacacuccaugguagacagaggauggggaaauggaugcggauuauuuggaaaaggagguaucgugaccugugcaauguucacaugcaaaaagaacauggaagggaaaaucgugcaaccagagaaccuggaguacaccauugugauaacaccccacucaggggaagagaaugcagucggaaaugacacagggaaacacggcaaggaaauuaaaguaacaccacagaguuccaucacagaagcagaacuaacaggcuauggcacuguuacgauggaaugcucuccgagaacgggccucgacuucaaugagaugguguugcugcaaauggaaaacaaggcuuggcuggugcacaggcaaugguucuuagacuugccguuaccauggcugcccggagcagacacacaaggaucaaacuggauacagaaggagacauuggucacuuucaaaaauccccaugcaaagaaacaggauguugucguuuuaggaucccaagaaggggccaugcacacagcacucacaggggccacggaaauccagaugucaucaggaaacuuacuguucacaggacaucuuaagugcaggcugagaauggauaaacuacagcucaaaggaaugucauauuccauguguacaggaaaguuuaaaguugugaaggaaauagcagaaacacaacauggaacaauaguuaucagaguacaauaugaaggggacgguucuccgugcaagaucccuuuugaaauaauggauuuggaaaaaagacaugucuuaggucgcuugauuacagucaacccaauugucacagaaaaagacagcccagucaacauagaagcagaaccuccauucggggacagcuacaucauuauaggaguagaaccaggacaacugaagcucagcugguuuaagaaaggaaguucuauuggccaaauguuugagacaacaaugagaggagcgaagagaauggccauuuuaggugacacagcuugggauuuuggauccuugggagggguguucacauccauaggaaaggcccuccaccaagucuuuggagcaaucuauggggcugccuucagugggguuucauggacuaugaaaauccucauaggagucgucaucacauggauaggaaugaauucacgcagcaccucacugucugugucacuaguacuagugggggucgugacacuguauuugggaguuauggugcaggccgauagugguugcguugugaguuggaaaaacaaagaacugaaauguggcagugggauuuuuaucacagacaacguacacacauggacagaacaauacaaauuccaaccagaauccccuucaaagcuggcuucagcuauccagaaggcucaugaagaaggcauuuguggaauccgcucaguaacaagacuggagaaucugauguggaaacaaauaacaccagaacugaaucacauuuuaucagaaaaugagguaaaguugacuaucaugacaggagacauuaaaggaaucaugcaggcaggaaaacgaucccugcggccucaacccacugagcugaaguacucuuggaaagcauggggcaaagcgaaaaugcucuccacagagcuucauaaccacaccuuucucauugauggccccgaaacagcagaaugucccaacacaaacagagcuuggaacucacuagaaguugaagacuauggcuuuggaguauuuaccaccaacauauggcugaaauugaaagaaaggcaggauguauuuugugacucaaaacucaugucagcagccauaaaagacaacagagccguccacgccgauauggguuauuggauagaaagcgcacucaaugacacauggaagauugagaaagccucuuuuauugaaguuaaaagcugccacuggccaaagucacacacucucuggaguaauggagugcuagaaagugagaugauaauuccaaagaauuuugcaggaccagugucacaacacaauuacagaccaggcuaucauacacaaacggcaggacccuggcaucuaggcaggcuugagauggacuucgauuucugcgaaggaaccacagugguggugacugaggacuguggaaauagaggacccucuuuaagaacaaccaccgcuucuggaaaacucauaacagaguggugcugccgauccugcacauuaccaccgcuaagguacagaggugaggauggaugcugguauggaauggaaauuagaccauugaaagagaaggaagagaacuuggucaacucuuuggucacagccggacauggacagauugacaacuucucacuaggagucuugggaauggcacuguuccuggaagagaugcucaggacccgagugggaacaaaacacgcaauauuacuaguugcaguuucuuucgugacauugaucacagggaacauguccuuucgagauuuggggagagugauggucauggugggcgcuacuaugacggauaacauaggcaugggcgugacuuaucuugcccuauuagcagccuucaaagucagaccaacuuuugcagcuggacuacucuuaagaaagcugaccuccaaggaauugaugaugaccaccauaggaaucgugcuccucucccagagcaccauaccagagacuauacuugaacugacugacgcguuggcuuuggggaugaugguucucaaaauagugagaaacauggaaaaguaucaacuagcagugacuaucauggccaucuugugcgucccaaaugcagugauauuacaaaacgcauggaaagugagcugcacaauacuggcagugguguccguuuccccacugcuuuuaacauccucacagcagaaagcggauuggauaccacuggcguugacgauaaaaggccucaauccaacagccauuuucuuaacaacccucucgagaacuagcaagaaaaggagcuggccacuaaaugaggcuauuauggcagucgggauggugagcauuuuagccaguucucucuuaaagaaugauauucccaugacagggccauuaguggcuggagggcuucucacuguguguuacgugcucacuggaagaucggccgauuuggaacuggagagagcugcugacguaagaugggaagaacaggcagagauaucaggaagcaguccaauucugucaauaacaauaucagaagaugguagcaugucgauaaaaaaugaagaagaagaacaaacgcugaccauacucaucagaacaggacuguuggugauaucaggacuuuuucccgugucaauaccaaucacggcagcugcaugguaccugugggaagugaaaaaacaacgagcaggaguauugugggaugucccuucacccccaccugugggaaaggccgaacuggaagauggagccuauagaaucaagcagaaagggauucuaggauacucgcagaucggagccggaguuuacaaagaaggaacauuccacacaauguggcaugucacacguggugcuguccuaaugcauaaagggaagagaauugaaccaucaugggcggacgucaagaaagaucuaauaucauacggaggagguuggaagcuagaaggagaauggaaggaaggagaagaaguccagguccuggcauuagagccuggaaagaauccaagagccguccaaacaaaaccaggucuuuuuaaaacuaacacuggaaccauaggcgccgugucucuggacuuuucuccuggaacgucaggaucuccaaucgucgacaaaaaagggaaaguugugggccucuacggcaacggugucguuacaaggaguggaacauaugugagugccauagcccagacugaaaaaagcaucgaggacaauccagagauugaagaugacaucuuucgaaagaaaagauugaccaucauggaccuccacccaggagcaggaaaaacaaagagauaccuuccagcaauagucagagaagccauaaaacgaggcuugagaacacuaauccuggcccccaccagaguuguggcggcugaaauggaagaagcucucagaggacuuccaauaagauaccaaacuccagcuaucagagcugagcacacugggcgggagauuguggaucuaaugugucacgccacauuuaccaugaggcuacuaucaccaauuagagugccaaauuacaaucugauuaucauggaugaagcccauuucacagacccagcaagcauagcagcuagaggauacauuucaacucgaguagagaugggugaagcugcugggauuuucaugacagcuaccccuccuggaagcagagacccauuuccucagagcaaugcaccaaucauggaugaagaaagggaaaucccugagcguucguggaacucuggacaugaguggguuacggacuuuaaagggaagacuguuugguuuguuccaaguauaaaagcagggaaugauauagcagcuugcuugagaaagaauggaaagaaagugauacaacucagcaggaagacuuuugauucugaauauauuaagacuaggaccaaugauugggacuuuguggucacgacagacauuucagaaaugggugcaaacuucaaggcugagaggguuauagaccccagacgcugcaugaaaccagucauacuaacagacggugaagagcgggugaucuuggcaggacccaugccagugacccacucuagcgcagcacaaagaagagggagaguaggaagaaauccaaaaaacgaaaaugaccaguacauauacaugggggaaccucuggaaaaugaugaagacugugcgcacuggaaagaagccaaaaugcuucuagacaacaucaacaccccugaaggaaucauucccagcauguucgaaccagagcgugaaaagguggaugcuguugauggugaauaccgcuugagaggagaagcaaggaaaacuuucguggaccuaaugagaagaggagaccuaccagucugguuagccuacaaaguggcagcugaaggcaucaauuacgcagacagaagauggugcuuugauggagucaaaaauaaccaaaucuuagaggaaaauguggaaguggaaauuuggacaaaagaaggagaaaggaagaaauuaaaacccagaugguuggaugcuaggaucuacucugacccacuggcgcucaaagaauucaaggaauucgcagcuggaagaaagucccugacccugaaucuaaucacagagauggguaggcucccaaccuucaugacccagaaagcaaggaaugcacuggacaacuuagcagucuugcauacagcugaagcaggcggaagggcguacaaucaugcucucagugaacugccggagacucuggagacauugcuuuuacugacacucuuggccacagucacgggcggaaucuuccuguucuugaugaguggaaaagguauagggaagaugacccugggaaugugcugcauaaucacugccaguauucuccuaugguaugcacaaauacagccacauuggauagcagcuucaauaauacuggaguuuuuucucauagucuugcucauuccagaaccagaaaagcagagaacaccccaagauaaccaauuaaccuauguugucauagccauccuuacagugguggccgcaaccauggcaaacgagauggguuuccuggaaaaaacaaagaaagauuucggauugggaagcaucacaacccagcaaccugagagcaauauccuggacauagaucuacguccugcaucagcuuggacucuauaugccguggcaacaacuuucaucacaccaauguugagacauagcauugaaaacuccucagugaaugugucucuaacagccauugccaaccaggccacaguguuaaugggucuugggaaaggauggccguugucaaaaauggacaucggaguuccccuucucgcuaucgggugcuauucacaagucaaccccauaacucucacagcagcccuucucuuauugguagcacauuaugcuaucauagggccaggacuccaagcgaaagcaacuagagaggcucagaaaagaacagcagcgggcaucaugaaaaucccagcugccuugauaguaacagugauugaccuagauccaauacccuaugauccaaaguuugaaaagcaguugggacaaguaaugcucuuaguccucuguucuacucaaguauugaugaugaggacuacaugggcuuuaugugaagcucuaaccuuagcaacugggcccaucucuacacugugggaaggaaauccaggaagauucuggaauacaacuauugcagugucaauggcuaacauuuucagagggaguuaccuggccggagccggacuucucuuuucuaucaugaagaacacggccaacacaagaaggggaacuggcaacacaggagagacgcuuggagagaaauggaaaaaccgguugaaugcauuggggaagagugaauuccagaucuauaagaaaaguggaauccaggaaguggauagaaccuuagcaaaagaaggcaucaaaagaggagaaacagaccaucacgcugugucgcgaggcucggcgaaacugagaugguucgucgagagaaaccuggucacaccagaagggaaaguaguggaccuugguugcggcagggggggcuggucauacuauugugggggacuaaagaauguaaaagaagucaaaggccuaacaaaaggaggaccaggacacgaagaacccauucccaugucaacauaugguuggaaucuggugcgucuucaaaguggaguugauguuuucuuuacuccgccagaaaagugugacacauugcugugugacauaggggagucgucaccaaaccccacgguugaagcaggacggacacucagaguucuaaccuuaguggaaaauuggcugaauaacaacacccaauuuugcauaaagguucucaacccauauaugcccucaguuauagaaaaaauggaagcgcuacaaaggaaauacggaggagcuuuggugaggaauccacucucaagaaauuccacacacgagauguacuggguauccaaugcuuccgggaacauagugucaucagugaauaugauuucaagaauguugauuaauagauucacaaugagacacaagaaggccacauacgagccagauguugaccucggaaguggaacccgcaacaucggaauugaaagugagacaccaaauuuagacauaauugggaaaagaauagaaaaaauaaaacaagagcaugaaacaucauggcacuacgaccaagaccacccauacaaaacgugggccuaccauggcagcuacgaaacaaaacagacuggaucagcaucauccauggugaacggagugguuaggcugcuaacaaaaccuugggacguuaucccuauggugacacagauggcaaugacagacacgacuccauuuggacaacagcgcguuuucaaagagaaaguggauacgagaacccaagaaccgaaagaaggcacgaaaaagcuaaugaaaaucacggcagaauggcucuggaaagaacuaggaaagaaaaagacaccuaggaugugcaccagagaagaauucacgagaaaggugagaagcaaugcagccuuaggcgccauauucacugaugagaacaaguggaagucggcacgugaggcuguugaagacaguggauuuugggaauugguugacaaggaaaggaaucuccaucuugaaggaaagugugagacauguguauauaacaugaugggaaagagagagaagaagcuaggggaguucggcaaagcgaaaggcagcagagccauaugguacauguggcuuggagcacgcuucuuagaguuugaagcccuaggauucuugaaugaagaucacugguuuuccagagagaacucccugaguggaguggaaggagaagggcugcacaaacuaggcuacauuuuaagagacgugaguaagaaagaaggaggagcaauguacgccgaugacaccgcaggaugggacacaagaaucacacuagaggacuuaaaaaaugaagaaauggugacaaaccacauggaaggagaacacaagaaacuugcugaagccaucuucaaauuaacguaccaaaacaaaguggugcgugugcaaagaccaacaccaagaggcacaguaauggacauuauaucgagaagagaccaaagagguaguggacaaguuguuaccuacggccucaauacuuucaccaacauggaagcccaacugaucagacagauggagggagaaggagucuucaaaagcauccagcaacuaacagccacggaagaaauugcagugaaaaacuggcuaguaagaguggggcgugagagguuaucaagaauggccaucaguggagaugauuguguugugaaacccuuagaugacagguuugcaagcgcucuaacagcucuaaaugacaugggaaaaguuaggaaagacauacaacaaugggaaccuucaagaggauggaacgauuggacacaagugccuuuuuguucacaccauuuccaugaguuaaucaugaaggacggucgcguacucguaguuccaugcagaaaucaagaugaacugauugguagggcccgaauuucccagggagccgggugguccuugcgggaaacagccuguuuggggaagucuuacgcccaaauguggagccugauguacuuccacagacgugaccuuaggcuggcggcaaaugccauuugcucggcagucccaucacauuggguuccaacaagucgaacaaccugguccauacacgccacacaugaguggaugacaacagaagacaugcugacagucuggaacaggguguggauucaagaaaacccauggauggaagacaaaacuccaguagaaucaugggaggaaaucccauauuuggggaaaagagaagaccaauggugcggcucauugauugggcuaacaagcagggccaccugggcaaagaacauccaaacagcaauaaaucaaguuagaucccuaauaggcaaugaggaauacacagacuacaugccauccaugaaaagauuuagaagagaagaggaagaggcaggagucuugugguag

SEQ ID NO: 6414 - RNA, 9876 nt, Artificial Sequence
  derived and/or modified CDS sequence (wt) from DENV-2__KX380815__SS-prME
acugcagguauaauuauuaugaugaucccaacagugauggcguuccauuuaaccacacgcaauggagaaccacacaugaucgucaguagacaagagaaagggaaaagucuucuguuuaaaacagagaacggugugaacaugugcacccucauggccauggaucuuggugaacugugugaagacacaaucacuuacaauuguccucuucucaggcagaaugaaccagaagacauagacuguuggugcaacucuacgucuacauggguaacuuaugggacaugcaccgcuacaggagaacacagaagggaaaaaagaucaguggcacucguuccacaugugggaaugggacuggagacacgaacugaaacauggaugucaucagaaggggccuggaaacaugcacagagaauugaaacuugggucuugagacauccaggcuucaccauaauggcagcaauccuggcauacaccauaggaacgacauauuuccaaagaguccugauuuucaucuuacugacagcuguugcucccucaaugacaaugcguuguauaggaauaucaaauagagacuuuguggaagggguuucaggaggaagcuggguugacauagucuuggaacauggaagcugugugacgacgauggcaaaaaauaaaccaacauuggauuuugaacugauaaagacagaagcaaaacaucccgccacucuaaggaaguauugcauagaggcaaagcugaccaacacaacaacagcaucucgcugcccaacacaaggagaacccagccuaaaugaagaacaggacaaaagauuugucugcaaacacuccaugguagacagaggauggggaaauggaugcggauuauuuggaaagggagguaucgugaccugugcaauguucacaugcaaaaagaacauggaagggaaaaucgugcaaccagaaaacuuggaguacaccauugugauaacaccucacucaggggaagagaaugcagucggaaaugacacaggaaaacacggcaaggaaauuaaaguaacaccacagaguuccaucacagaagcagaacuaacaggcuauggcacugucacgauggaaugcucuccgagaacgggacucgacuucaaugagaugguguugcugcaaauggaaaacaaggcuuggcuggugcacaggcaaugguucuuagaccugccauuaccauggcugcccggagcagacacacaaggaucaaauuggauacagaaggagacauuggucacuuucaaaaauccccaugcaaagaaacaggauguuguuguucuaggaucccaagaaggggcuaugcacacagcacuuacaggggccacggaaauccagaugucaucaggaaacuuacuguucacaggacaucuuaaauguaggcugagaauggauaaacuacagcucaaaggaaugucauauuccauguguacaggaaaguucaaaguugugaaggaaauagcagaaacacaacauggaacaauaguuaucagaguacaauaugaaggggacgguucuccgugcaagaucccuuuugaaauaauggauuuggaaaaaagacaugucuuaggucgcuugaucacagucaacccaauugucacagaaaaagacagcccagucaacauagaagcagaaccuccauucggagacagcuacaucauuauaggaguagaaccgggacaacugaagcucagcugguuuaagaaaggaagcucuauuggccaaauguuugagacaacaaugagaggagcgaagagaauggccauuuuaggugacacagcuugggauuuuggaucccugggaggaguguucacaucuauaggaaaggcccuccaccaagucuuuggagcaaucuauggggcugccuucagugggguuucauggacuaugaaaauccucauaggagucgucaucacauggauaggaaugaauucacgcagcacuucacugucugugucacuaguauuagugggagucgugacauuguauuugggaguuauggugcaggccgauagugguugcguugugagcuggaaaaacaaagaacugaaauguggcagugggauuuuuaucacagacaacgugcauacauggacagaacaauacaaauuccaaccagaauccccuucaaagcuggcuucagcuauccagaaggcucaugaagaaggcauuuguggaauccgcucaguaacaagacuggagaaucugauguggaaacaaauaacaccagaacugaaucacauucuaacagaaaaugagguaaaguugacuaucaugacaggagacauuaaaggaaucaugcaggcaggaaaacgaucccugcggccucaacccacugagcugaaguacucuuggaaagcauggggcaaagcgaaaaugcucuccacagagcuucauaaccacaccuuucucauugauggccccgagacagcagaaugucccaacacaaauagagcuuggaacucacuagagguugaagacuauggcuuuggaguauucaccacuaacauauggcugaaauugaaagaaaggcaggauguaucuugugacucaaaacucaugucggcagccauaaaagacaacagagccguccacgccgacauggguuauuggauagaaagcgcacucaaugacacauggaagauugagaaagccuccuuuauugaaguuaaaagcugccacuggccaaagucacacacucucuggaguaauggagugcuagaaagugagaugauaauuccaaagaauuuugcaggaccagugucacaacacaauuacagaccaggcuaucauacacaaacggcaggacccuggcaucuaggcaggcuugagauggacuuugauuucugcgaaggaacuacagugguggugacugaggacuguggaaauagaggacccuccuuaagaacaacuacugcuucuggaaaacucauaacagaauggugcugccgaucuugcacauuaccaccgcuaagguacagaggugaggauggaugcugguauggaauggaaaucagaccauugaaagagaaagaagagaacuuggucaacucuuuggucacagccggacauggacagauugacaacuucucacuaggagucuugggaauggcauuguuccuggaagagaugcuuagaacccgaguagggacgaaacaugcaauauuacuaguugcagucucuuucgugacauugaucacagggaacauguccuuucgagacuuggggagagugauggucauggugggcgcuacuaugacggaugacauaggcaugggcgugaccuaucuugcccuauuagcagccuucaaggucagaccaacuuuugcagcuggacuacucuuaagaaaacugaccuccaaggaauugaugaugaccaccauaggaaucguacuccucucucagagcaccauaccagagaccauacuugaacugacugacgcguuggcuuuggggaugaugguucucaaaauaguaagaaacauggaaaaguaucaacuagcagugacuaucauggcuaucuugugcgucccaaaugcagugauauuacaaaacgcauggaaagugagcugcacaacacuggcagugguguccguuuccccacugcuuuuaacauccucacagcagaaaacggauuggauaccacuggcguugacgaucaaaggccuuaauccaacagccauuuucuuaacaacccucucaagaacuagcaagaaaaggagcuggccacuaaaugaggcuauuauggcagucgggauggugagcauuuuagccaguucuuucuuaaagaaugauauucccaugacaggaccacuaguggcuggagggcuucucacuguguguuacgugcucacuggaagaucggcugauuuggaacuggagagagcugcugacauaagaugggaagaacaggcagagauaucaggaagcaguccaauuuugucgauaacaauaucggaagauggcagcaugucgauaaaaaaugaagaagaagaacaaacacugaccauacugauuagaacaggacugcuggugauaucaggacuuuuucccgugucaauaccaaucacggcagcugcaugguaccugugggaagugaaaaaacaacgagccggaguguugugggaugucccuucaccuccaccugugggaaaggccgaacuggaagauggagccuauagaaucaagcagaaagggauuuugggauacucgcagauaggagccggagucuacaaagaaggaacuuuccacacaauguggcaugucacacguggugcuguucuaaugcauaaagggaagagaauugaaccaucaugggcggacgucaagaaggaccuaauaucguauggaggagguuggaagcuagaaggagaauggaaggaaggagaagaaguccagguccuggcauuagagccuggaaagaauccaagagccguccaaacaaaacccggucuuuuuaaaacuaacacuggaaccauaggcgccguaucucuggacuuuucuccuggaacgucaggaucuccaauugucgacaaaaaaggaaaaguugugggccuuuauggcaacggugucgucacaaggaguggaacauaugugagugccauagcccagacugaaaaaaacauugaagacaacccagagauugaagaugacaucuuucgaaagaaaagacugaccaucauggaccuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaucaaaccccagcuaucagagcugagcauacuggacgggagaucguggaucuaaugugucacgccacauuuaccaugaggcuacuaucaccaauuagagugccaaauuacaaccugauuaucauggaugaagcccauuucacagacccagcaagcauagcggcuagaggauacaucucaacucgaguagagaugggugaagcagcugggauuuucaugacagcuaccccuccuggaagcagagacccauuuccucagagcaacgcaccaaucauggaugaagaaagggaaauuccugagcguucguggaacucuggacaugaguggguuacggauuuuaaagggaagacuguuugguuuguuccaaguauaaaagcaggaaaugauauagcagcuugccugagaaagaaugggaagaaagugauacaacucagcaggaagaccuuugauucugaauaugucaagacuaggaccaaugauugggacuuuguggucacgacagacaucucagaaaugggugcuaacuucaaggcugagaggguuauagaccccagacgcugcaugaaaccagucauacuaacagacggugaagagcggguuauccuggcaggacccaugccagugacccacucuagugcagcacaaagaagagggagaguaggaagaaauccaaaaaaugaaaaugaccaguauauauacaugggggaaccucuggaaaaugaugaagacugcgcacacuggaaagaagcuaagaugcuucuagauaacaucaacacgccugaaggaaucauucccagcauguuugaaccagagcgugagaaggucgacgccauugauggugaauaccgcuugagaggagaagcgaggaaaacauuuguggaccuaaugagaagaggagaccuaccaguuuggcuagccuacagaguggcagcugaagguaucaacuacgcagacagaagauggugcuuugauggagucaagaacaaccaaaucuuggaagaaaauguggaaguggaaauuuggacaaaagaaggagaaaggaagaaauuaaaacccagaugguuagaugcuaggaucuacucugacccacuggcacuuaaagaauucaaggaauucgcagcuggaagaaaaucccugacccugaaucuaaucaccgagauggguaggcucccaaccuucaugacccagaaagcaaggaaugcauuggacaacuuagcaguccuacacacggcugaagcaggcggaagggcguacaaucaugcucuuagugaacugccggagacucuggagacauugcuuuuacugacacuuuuggccacagucacaggcggaaucuuccuguucuugaugagcggaaaggguauagggaagaugacccugggaaugugcugcauagucacagccaguauucuucuaugguaugcacaaauacagccacauuggauagcagcuucaauaauacuagaguuuuuucucauagucuugcucauuccagaaccagaaaagcagagaacaccccaagauaaccaauuaacuuauguugucauagccauccuuacagugguggccgcaaccauggcaaacgagauggguuuccuggaaaaaacaaagaaagauuucggauugggaaguaucacaacccagcaaccugagagcaacauccuagacauagaucuacguccugcaucagcuuggacucuauaugccguggcaacaacuuucaucacaccaauguugagacauagcauugaaaauuccucagugaaugugucucuaacagccauugccaaccaagccacaguguuaaugggucuugggaaaggauggccauugucgaaaauggacaucggaguuccccuucucgcuaucggaugcuauucacaagucaaucccauaacucucacagcagcccuucucuuauugguagcacauuaugcuaucauagggccaggacuccaagcgaaagcaaccagagaggcucagaaaagagcagcagcgggcaucaugaaaaucccagcugccuugaucaugacagugauugaccuagauccaauaccauaugauccaaaguuugaaaagcaguugggacaaguaaugcucuuaguccucuguucuacucaaguauugaugaugaggacuacaugggcuuuaugugaagcucuaaccuuagcgaccgggcccaucucuacacugugggaaggaaauccagggagauuuuggaauacaacuauugcagugucaauggcuaacauuuuuagagggaguuaccuggccggagccggacuucucuuuucuaucaugaagaacacggccaacacaagaaggggaacuggcaacacaggagagacgcuuggagagaaauggaaaaaccaguugaaugcauuggggaagagugaauuccagaucuauaagaaaaguggaauccaggaaguggauagaacguuagcaaaagaaggcaucaagagaggagaaacggaccaucacgcugugucgcgaggcucagcgaaacugagaugguucgucgagagaaaccuugucacaccagaagggaaaguaguggaccuuggcugcggcagggggggcuggucauacuauugugggggacuaaagaauguaaaggaagucaaaggccuaacaaaaggaggaccaggacacgaagaacccauucccaugucaacauaugguuggaaucuggugcgucugcaaaguggagucgaugucuuuuuuacuccgccagaaaagugugacacauugcugugugacauaggggagucgucaccaaaccccacgguugaggcaggacgaacacucagaguucuaaacuuaguggaaaacuggcugaacaauaauacccaauuuugcauaaagguucuuaacccauauaugccuucaguuauagaaaaaauggaagcgcuacaaaggaaauacggaggagcuuuggugaggaauccacucucacgaaauuccacacacgagauguacuggguauccaaugcuuccgggaacauagugucaucagugaacaugauuucaagaauguugauuaacagauucacaaugagacacaagaaggccacauacgagccggauguugaucucggaaguggaacccgcaacaucggaauugaaagugaaguaccaaaucuagacauaauugggaaaagaauagaaaaaauaaaacaagagcaugaaacaucauggcacuaugaucaagaccacccauacaaaacgugggccuaccauggcagcuacgaaacaaaacagacuggaucagcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccaaaagaagguacgaaaaaacuaaugaaaaucacggcagaauggcucuggaaagaacuaggaaagaaaaagacaccuaggaugugcaccagagaagaauucacaagaaaggugagaagcaaugcagccuuaggugccauauucacugaugagaacaaguggaagucggcacgugaagcuguugaagacaguggauuuugggaauugguugacaaggaaaggaaucuccaucuugaaggaaagugugagacauguguguauaacaugaugggaaagagagagaagaagcuaggggaguucggcaaagcaaaaggcagcagagccauaugguacauguggcuuggagcacgcuucuuagaguuugaagcccugggauucuugaaugaagaucacugguuuuccagagagaacucccugaguggaguagaaggagaagggcugcacaaacuaggcuacauucuaagagacgugaguaagaaagaaggaggagcaauguacgccgaugacaccgcaggaugggacacaagaaucacacuagaggacuugaaaaaugaagaaauggugacaaaccacauggaaggagaacacaagaaacuugcugaagccauuuucagauuaacguaccaaaacaaaguggugcgugugcaaagaccgacaccaagaggcacaguaauggacauuauaucgagaagagaccaaagagguaguggacagguugucaccuacggccucaacacuuucaccaacauggaagcccaacugaucagacagauggagggagaaggagucuucaaaagcauccagcaccugacagccacagaagaaauugcagugaaaaacugguuaguaagaguggggcgugagagguuaucaagaauggccaucagcggagaugauuguguugugaaacccuuagaugacagguuugcaaacgcucuaacagcuuuaaaugacaugggaaaggucaggaaagacauacaacaaugggaaccuucaagaggauggaacgauuggacacaagugcccuuuuguucacaccauuuccaugaguuaaucaugaaggacggucguguacuugugguuccauguagaaaccaagaugaacugauugguagggcccgaauuucccagggagccgggugguccuugcgggaaacagcuuguuuggggaagucuuacgcccaaauguggagccuaauguacuuccacagacgugaccuuaggcuggcggcaaaugccauuugcucggcagucccuucacauuggguuccaacaagucgaacaaccugguccauacacgccacacaugaguggaugacaacagaagacaugcugacagucuggaacaggguguggauucaagaaaacccauggauggaagacaaaacuccaguagaaucaugggaggaaaucccauauuuggggaagagagaagaccaguggugcggcucauugauugggcuaacaagcagggccaccugggcaaagaacauccaaacagcaauaaaucaaguuagaucccuaauaggcaaugaggaauacacagacuacaugccaucuaugaaaagauucagaagagaagaggaagaggcaggagucuugugguag

SEQ ID NO: 6415 - RNA, 9876 nt, Artificial Sequence
  derived and/or modified CDS sequence (wt) from DENV-2__KX380816__SS-prME
acugcagguauaauuauuaugaugaucccaacagugauggcguuccauuuaaccacacgcaacggagaaccacacaugaucguuaguagacaagagaaagggaaaagucuccuguuuaaaacagagaacggugugaacauguguacccucauggccauggaccuuggugaacugugugaagacacaaucacuuauaauuguccucuucucaggcagaaugaaccagaagacauagacuguuggugcaacuccacgucuacauggguaacuuaugggacaugcaccgccacaggagaacacagaagggaaaaaagaucaguggcacucguuccacaugugggaaugggacuggagacacgaacugaaacauggaugucaucagaaggggccuggaaacaugcccagagaauugaaacuuggaucuugagacauccaggcuucaccauaauggcagcuauccuggcauacaccauaggaacaacauauuuccaaagaguccugauuuucauuuuacugacagcugucacuccuucaauggcaaugcguuguauaggaauaucaaauagagacuuuguggaagggguuucaggaggaagcuggguugauauagucuuggaacauggaagcugugugacgacgauggcgaaaaauaaaccaacgcuggauuuugaacugauaaaaacagaagccaaacaucucgccacucuaaggaaguauuguguagaggcaaagcugaccaacacaacaacagcaucucgcugcccaacacaaggagaaccuagccuaaaugaagaacaggacaaaagauucgucugcaaacacuccaugguagacagaggauggggaaauggaugcggauuauuuggaaagggaggcaucgugaccugugcaauguucacaugcaaaaagaacauggaaggaaaagucgugcaaccagaaaacuuggaguacaccaucgugauaacaccucacucaggggaagagaaugcagucggaaaugacacaggaaaacauggcaaggaaauuaaaguaacaccacagaguuccaucacagaagcagaacuaacaggcuacggcacugucacgauggaaugcucuccgagaacgggccucgacuucaaugagaugguguugcugcaaauggaaaacaaggcuuggcuggugcacaggcaaugguucuuagaccugccguuaccauggcugcccggagcagacacacaaggaucaaauuggauacagaaggagacacuggucacuuucaaaaauccccaugcaaagaaacaggauguaguuguuuuagguucccaagaaggggccaugcacacggcacucacaggggccacggaaauccagaugucaucaggaaacuuacuguucacaggacaucuuaagugcaggcugagaauggacaaacuacagcucaaaggaaugucauauuccauguguacaggaaaguucaaaguugugaaggaaauagcagaaacacaacauggaacaauaguuauuagaguacaauaugaaggggacgguuccccgugcaagaucccuuuugaaauaauggacuuggaaaaaaggcaugucuuaggacgcuugauuaccgucaacccaauugucacagaaaaagacagcccagucaacauagaagcagaaccuccauuuggagacaguuacaucauuauaggaguagaaccaggacaacugaagcucagcugguucaagaaaggaaguucuauuggccaaauguuugagacaacaaugagaggagcgaagagaauggccauucuaggugacacagcuugggauuuuggaucccugggaggaguguucacaucuauaggaaaggcccuccaccaagucuuuggagcuaucuauggggcugccuucagugggguuucauggacuaugaaaauccucauaggagucgucaucacauggauaggaaugaauucacgcagcaccucacugucugugucacuaguauuagugggggucgugacauuguauuugggaguuauggugcaggccgauagugggugcguugugaguuggaaaaacaaagaacugaaaugugguagugggauuuuuaucacagacaacgugcacacauggacagaacaauacaaauuccaaccagaauccccuucaaagcuggcuucagcuauccagaaggcucaugaagaaggcauuuguggaauccgcucaguaacaagacuggagaaucugauguggaaacaaauaacaccagaauugaaucacauucuaacagaaaaugaaguaaaguugacuaucaugacaggagacaucaaaggaaucaugcaggcaggaaaacgaacccugcggccucaacccacugagcugaaguacuccuggaaggcauggggcaaagcgaaaaugcuuuccacagagcuucauaaccacaccuuucucauugauggccccgaaacagcagaaugucccaacacaaacagagcuuggaacucacuagaaguugaagacuauggcuuuggaguauucaccacuaacauauggcugaaauugaaagaaaggcaggauguguuuugugacucaaaacucaugucagcagccauaaaggacaauagagccguccacgccgauauggguuauuggauagaaagcgcacucaaugacacauggaagauugagaaagccucuuuuauugaaguuaaaagcugccacuggccaaagucacacacucucuggaguaauggagugcuggaaagugagaugauaauuccaaagaauuuugcaggaccaguuucacaacacaauuacagaccaggcuaccacacacaaacggcaggacccuggcaucuagguaggcuugagauggacuuugauuucugcgaaggaaccacagugguggugacugaggacuguggaaauagaggacccuccuuaagaacaacuacugcuucuggaaaacucauaacagaguggugcugccgaucuugcacauuaccaccgcuaagguacagaggugaggauggaugcugguaugguauggaaaucaggccauugaaagagaaagaagagaaccuggucaacucuuuggucacagccggacauggacagauugacaacuucucacuaggagucuugggaauggcauuguuccuggaagagaugcucaggacucgaguaggaacgaaacaugcaauauuacuaguugcagucucuuucgugacauugaucacagggaacauguccuuucgagauuuggggagagugauggucauggugggcgcuacuaugacggaugacauaggcaugggcgugacuuaucuugcccuauuagcagccuuuaaaaucagaccaaccuuugcggcuggacuacucuuaagaaagcugaccuccaaggaauugaugaugaccaccauaggaaucguacuccucucucagaguaccauaccagagagcauacuugaacugacugacgcguuggcuuuggggaugaugguucuuaaaauagugagaaacauggaaaaguaucagcuagcagugacuaucauggcaaucuugugcgucccaaaugcagugauauugcaaaaugcauggaaagugagcugcacaacacuggcagugguguccguuuccccacugcuuuuaacauccucacagcagaaagcggauuggauaccacuggcguugacgaucaaaggccucaauccaacagccauuuucuuaacaacucucucaagaacuagcaagaaaaggagcuggccacuaaaugaggcuauuauggcagucgggauggugagcauucuagcuaguucucucuuaaagaaugauauucccaugacaggaccauuaguggcuggagggcuucucacuguguguuacgugcucaccggaaggucggcugacuuggaacuggaaagagcugcugacguaagaugggaagaacaggcagagauaucaggaaguaguccaauucugucgauaacaauaucggaagaugguagcaugucgauaaagaaugaagaagaagaacagacacugaccauacucaucagaacaggacuacuggugauaucaggacuuuuuccugugucaauaccaaucacggcagcugcaugguaccuuugggaagugaaaaaacaacgagcaggaguauugugggaugucccuucacccccaccugugggaaaggccgaacuggaagauggagccuauagaaucaagcagaaagggauccuaggauacucacagauuggagccggaguuuacaaagaaggaacauuccacacaauguggcaugucacacguggugcuguccuaaugcauaaagggaagagaauugaaccaucaugggcggacgucaagaaagaccuaauaucguauggaggaggcuggaagcuggaaggagaauggaaggaaggagaagaaguccagguccuggcauuagagcccggaaagaauccaagagccguccaaacaaaacccggucuuuuuaaaaccaacacuggaaccauaggcgccgugucucuggacuuuucuccuggaacgucaggaucuccaaucgucgauaaaaaaggaaaaguugugggccuuuauggcaacggugucgucacaaggaguggaacauaugugagugccauagcccagacugaaaaaagcaucgaagacaauccagagauugaagaugacaucuuuagaaagaaaagauugaccaucauggaccuccacccaggagcaggaaaaacaaagagauaucuuccagcaauagucagagaagccauaaaacgaggcuugagaacacuaauccuggcccccacuagaguuguggcggcugaaauggaagaagcucucagaggacuuccaauaagauaccaaaccccagcuauuagagcugagcacacugggcgggagauuguggaucuaaugugucaugccacauuuaccaugaggcuauuaucaccaauuagagugccaaauuacaaccugaucaucauggaugaagcccauuucacagacccagcaagcauagcagcuagaggauacauuucaacucgaguagagaugggugaggcagcugggauuuucaugacagccaccccuccuggaagcagagacccauuuccccagagcaacgcaccaaucauggaugaagaaaaagaaaucccugagcguucguggaacucuggacaugaguggguuacggauuuuaaagggaagacuguuugguuuguuccaaguauaaaagcagggaaugauauagcagcuugccugagaaagaauggaaagaaagugauacaacucagcaggaaaacuuuugauucugaauauaucaagacuaggaccaaugauugggacuuuguggucacgacagacauuucagaaaugggugcuaacuucaaggcugagaggguuauagaccccagacgcugcaugaaaccagucauauuaacagacggugaagagcgggugaucuuggcaggacccaugccagugacccauucuagugcagcacaaagaagagggagaguaggaagaaauccaaaaaaugaaaaugaccaguacauauacaugggggaaccucuggaaaaugaugaagacugugcacacuggaaagaagcuaagaugcucuuggauaacaucaacacgccugaagggaucauucccagcauguucgaaccagagcgugaaaagguggaugccauugauggugaauaccgcuugagaggagaagcgaggaaaacuuuuguggaccuaaugagaagaggagauuuaccagucuggcuagccuacagaguggcggcugaaggcaucaacuacgcagacagaagauggugcuuugauggagucaagaacaaccaaaucuuggaagaaaauguggaaguagaaauuuggacaaaagaaggagaaaggaagaaauuaaaacccagaugguuggaugcuaggaucuacucugacccauuggcgcucaaagaauucaaggaauucgcagcuggaagaaagucccugacccugaaucuaaucacagagauggguagacucccaaccuucaugacccagaaagcaaagaaugcacucgacaacuuagcaguccugcauacggcugaagcaggcggaagggcguacaaucaugcucuuagugaacugccggagacucuggagacauugcuuuuacugacacuuuuggccacagucacgggcggaaucuuccuguucuugaugagcggaaaggguauagggaagaugacccugggaaugugcugcauaaucacggcuaguauccucuuauggcaugcacaaauacagccacacuggauagcagcuucaauaauacuggaguuuuuucucauagucuugcucauuccagaaccagaaaaacagagaacaccccaagauaaccaguuaacuuauguugucauagccauccuuacaguaguggccgcaaccauggcaaacgagauggguuuccuggaaaaaacaaagaaagauuucggauugggaagcauuacaacccagcaaccugagaguaacauccuggacauagaucuacguccugcaucagcuuggacucuauaugccguggcaacaacuuucaucacaccaauguugaggcauagcauugaaaacuccucagugaaugugucccuaacagccauugccaaccaagccacaguguuaaugggucuugggaaaggauggccauugucaaaaauggacaucggaguuccccuucucgcuaucgggugcuauucacaagucaaccccauaacucucacugcagcccuucucuuauugguagcccauuaugccaucauagggccaggacuccaagcgaaagcaacuagagaggcucagaaaagagcagcagcgggcaucaugaaaaacccaacuguggauggaaugacagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcaaccgggcccaucucuacacugugggaaggaaauccagggagauuuuggaauacaacuauugcagugucaauggcuaacauuuuuagagggaguuaccuggccggagccggacuucucuuuucuaucaugaaaaacacggccaacacaagaaggggaacuggcaacacaggagagacgcuuggggagaaauggaaaaaccgguugaaugcauuagggaagagugaauuccagaucuacaagaaaaguggaauccaggaaguggacagaaccuuagcaaaagaaggcaucaaaagaggagaaacggaccaucacgcugugucgcgaggcucagcgaaacugagaugguucgucgagagaaaccuggucacaccagaagggaaaguaguggaccuuggcugcggcagggggggcuggucauacuauugugggggacuaaagaauguaaaagaagucaaaggccuaacaaaaggaggaccaggacacgaagaacccauucccaugucaacauaugguuggaaucuggugcgccuucaaaguggaguugauguuuucuucacuucgccagaaaagugugacacacugcugugugacauaggggagucgucaccaaaccccacgguugaggcaggacgaacacucagaguucuaaacuuaguggaaaauuggcugaacaacaacacccaauuuugcauaaagguucuuaacccauacaugcccucaguuauagaaaaaauggaagcacuacaaaggaaauacggaggagcuuuggugaggaauccacucucacgaaauuccacacacgagauguacuggguauccaaugcuuccgggaauauagugucaucagugaacaugauuucaagaauguugauuaacagauucacaaugagacacaagaaagccacauacgagccagauguugaccucggaaguggaacccgcaacaucggaauugaaagugagacaccaaauuuagacauaauugggaaaagaauagaaaaaauaaaacaagagcaugaaacaucauggcacuaugaccaagaccacccauacaaaacgugggccuaccauggcagcuacgaaacaaaacagacuggaucagcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccgaaagaaggcacgaaaaaacuaaugaaaauuacugcagaauggcucuggaaagaacuaggaaagaaaaagacaccuaggaugugcaccagagaagaauucacaagaaaggugagaagcaaugcagccuuaggugccauauucacugaugagaacaaguggaagucggcacgugaggcuguugaagacaguggauuuugggaauugguugacaaggaaaggaaucuccaucuugaaggaaagugugaaacaugcguguauaacaugaugggaaagagagagaagaagcuaggggaguucggcaaagcaaaaggcagcagagccauaugguacauguggcuuggagcacgcuucuuagaguuugaagcucuaggauucuugaacgaagaucacugguuuuccagagagaacucccugaguggaguggaaggagaagggcuacacaagcuaggcuacauuuuaagagacgugaguaagaaagaaggaggagcaauguaugcugaugacaccgcaggaugggacacaagaaucacacuagaggacuugaaaaaugaagaaauggugacaaaccacauggaaggagaacacaagaaacuugcugaagccauuuucaaauuaacguaccaaaacaagguggugcgugugcaaagaccaacaccaagaggcacaguaauggacauuauaucgagaagagaccaaagagguaguggacaaguugucaccuacggccucaauacuuucaccaauauggaagcccaacugaucagacagauggagggagaaggaguuuucaaaagcauccagcaacugacaguaaaagaggaaauugcagugaaaaacugguuaauaagaguggggcgugagagguuaucaagaauggccaucaguggagaugauuguguugugaaacccuuagaugacagguuugcaagugcucuaacagcucuaaaugacaugggaaagguuaggaaagacauacaacaaugggaaccuucaagaggauggaacgauuggacacaagugcccuuuuguucacaccauuuccaugaguuaaucaugaaggacggucgugugcucguaguuccaugcagaaaccaagaugaacugauuggcagggcccgaauuucccagggagccgggugguccuugcgggaaacagccugucuggggaaguccuacgcccaaauguggagccugauguacuuccacagacgugaccuuaggcuggcggcaaaugccauuugcucggcagucccaucacauuggauuccaacaagucgaacaaccugguccauacacgccacacaugaguggaugacaacagaagacauguugacagucuggaacaggguguggauucaagaaaacccauggauggaagacaaaacuccaguagaaucaugggaagaaaucccguauuuggggaaaagagaagaccaauggugcggcucauugauugggcuaacaagcagggccaccugggcaaagaacauccaaacagcaauaaaucaaguuagaucccuaauaggcaaugaggaauacacagacuacaugccaucuaugaaaagauucagaagagaagaggaagaggcaggagucuugugguag

SEQ ID NO: 6416 - RNA, 9876 nt, Artificial Sequence
  derived and/or modified CDS sequence (wt) from DENV-2__KX380817__SS-prME
acugcagguauaauuauuaugaugaucccaacagugauggcguuccauuuaaccacacgcaacggagaaccacacaugauuguuaguagacaagagaaagggaaaagucuccuguuuaaaacagagaacggugugaacauguguacccucauggccauggaccuuggugaacugugugaagacacaaucacuuauaauuguccucuucucaggcagaaugaaccagaagacauagacuguuggugcaacuccacgucuacauggguaacuuaugggacaugcaccgccacaggagaacacagaagggaaaaaagaucaguggcacucguuccacaugugggaaugggacuggagacacgaacugaaacauggaugucaucagaaggggccuggaaacaugcccagagaauugaaacuuggaucuugagacauccaggcuucaccauaauggcagcaauccuggcauacaccauaggaacaacauauuuccaaagaguccugauuuucauuuuacugacagcugucacuccuucaauggcaaugcguugcauaggaauaucaaauagagacuuuguggaagggguuucaggaggaagcuggguugauauagucuuggaacauggaagcugugugacgacgauggcgaaaaauaaaccaacguuggauuuugaacugauaaaaacagaagccaaacaucucgccacucuaaggaaguauuguguagaagcaaagcugaccaacacaacaacagcaucucgcugcccaacacaaggagaaccuagccuaaacgaagaacaggacaaaagauucgucugcaaacacuccaugguagacagaggauggggaaauggaugcggauuauuuggaaagggaggcaucgugaccugugcaauguucacaugcaaaaagaacauggaaggaaaagucgugcaaccagaaaacuuggaguacaccaucgugauaacaccucacucaggggaagagaaugcagucggaaaugacacaggaaaacauggcaaggaaauuaaaauaacaccacagaguuccaucacagaagcagaacuaacaggcuacggcacugucacgauggaaugcucuccgagaacgggccucgacuucaaugagaugguguugcugcaaauggaaaacaaggcuuggcuggugcacaggcaaugguucuuagaccugccguuaccauggcugcccggagcagacacacaaggaucaaauuggauacagaaggagacacuggucacuuucaaaaauccccaugcaaagaaacaggauguuguuguuuuagguucccaagaaggggccaugcacacggcacucacaggggccacggaaauccagaugucaucaggaaacuuacuguucacaggacaucuuaagugcaggcugagaauggacaaacuacagcucaaaggaaugucauauuccauguguacaggaaaguucaaaguugugaaggaaauagcagaaacacaacauggaacaauaguuauuagaguacaauaugaaggggacgguuccccgugcaagaucccuuuugaaauaauggacuuggaaaaaaggcaugucuuaggucgcuugauuaccgucaacccaauugucacagaaaaagacagcccagucaacauagaagcagaaccuccauuuggagacaguuacaucauuauaggaguagaaccaggacaacugaagcucagcugguuuaagaaaggaaguucuauuggccaaauguuugagacaacaaugagaggagcgaagagaauggccauucuaggugacacagcuugggauuuuggaucccugggaggaguguucacaucuauaggaaaggcccuccaccaagucuuuggagcuaucuauggggcugccuucagugggguuucauggacuaugaaaauccucauaggagucgucaucacauggauaggaaugaauucacgcagcaccucacugucugugucacuaguauuagugggggucgugacauuguauuugggaguuauggugcaggccgauagugggugcguugucaguuggaaaaacaaagaacugaaaugugguagugggauuuuuaucacagacaacgugcacacauggacagaacaauacaaauuccaaccagaauccccuucaaagcuggcuucagcuauccagaaggcucaugaagaaggcauuuguggaauccgcucaguaacaagacuggagaaucugauguggaaacaaauaacaccagaauugaaucacauucuaacagaaaaugaaguaaaguugacuaucaugacaggagacaucaaaggaaucaugcaggcaggaaaacgaucccugcggccucaacccacugagcugaaguacuccuggaaggcauggggcaaagcgaaaaugcuuuccacagagcuucauaaccacaccuuucucauugauggccccgaaacagcagaaugucccaacacaaacagagcuuggaacucacuagaaguugaagacuauggcuuuggaguauucaccacuaacauauggcugaaauugaaagaaaggcaggauguguuuugugacucaaaacucaugucggcagccauaaaggacaauagagccguccacgccgauauggguuauuggauagaaagcgcacucaaugacacauggaagauugagaaagccucuuuuauugaaguuaaaagcugccacuggccaaagucacacacucucuggaguaauggagugcuggaaagugagaugauaauuccaaagaauuuugcaggaccaguuucacaacacaauuacagaccaggcuaccacacacaaacggcaggacccuggcaucuagguaggcuugagauggacuuugauuucugcgaaggaaccacagugguggugacugaggacuguggaaauagaggacccuccuuaagaacaacuacugcuucuggaaaacucauaacagaguggugcugccgaucuugcacauuaccaccgcuaagguacagaggugaggauggaugcugguaugguauggaaaucaggccauugaaagagaaagaagagaaccuggucaacucuuuggucacagccggacauggacagauugacaacuucucacuaggagucuugggaauggcauuguuccuggaagaaaugcucaggacucgaguaggaacgaaacaugcaauauuacuaguugcagucucuuucgugacauugaucacagggaacauguccuuucgagauuuggggagagugauggucauggugggcgcuacuaugacggaugacauaggcaugggcgugacuuaucuugcccuauuagcagccuuuaaagucagaccaaccuuugcggcuggacuacucuuaagaaagcugaccuccaaggaauugaugaugaccaccauaggaaucguacuccucucucagaguaccauaccagagagcauacuugaacugacugacgcguuggcuuuggggaugaugguucucaaaauagugagaaacauggaaaaguaucagcuagcagugacuaucauggcaaucucgugcguuccaaaugcagugauauugcaaaaugcauggaaagugagcugcacaacacuggcagugguguccguuuccccacugcuuuuaacauccucacagcagaaagcggauuggauaccacuggcguugacgaucaaaggccucaauccaacagccauuuucuuaacaacucucucaagaacuagcaagaaaaggagcuggccacuaaaugaggcuauuauggcagucgggauggugagcauucuagcuaguucucucuuaaagaaugauauucccaugacaggaccauuaguggcuggagggcuucucacuguguguuacgugcucacuggaaggucggcugacuuggaacuggaaagagcugcugacguaagaugggaagaacaggcagagauaucaggaagcaguccaauucugucgauaacaauaucggaagaugguagcaugucgauaaagaaugaagaagaagaacagacacugaccauacucaucagaacaggacuacuagugauaucaggacuuuuuccugugucaauaccaaucacggcagcugcaugguaccuuugggaagugaaaaaacaacgagcaggaguauugugggaugucccuucacccccaccugugggaaaggccgaacuggaagauggagccuauagaaucaagcagaaagggauccuaggauacucacagauuggagccggaguuuacaaagaaggaacauuccacacaauguggcaugucacacguggugcuguccuaaugcauaaagggaagagaauugaaccaucaugggcggacgucaagaaagaccuaauaucguauggaggaggcuggaagcuggaaggagaauggaaggaaggagaagaaguccagguccuggcauuagagccuggaaagaauccaagagccguccaaacaaaacccggucuuuuuaaaaccaacacuggaaccauaggcgccgugucucuggacuuuucuccuggaacgucaggaucuccaaucgucgauaaaaaaggaaaaguugugggccuuuauggcaacggugucgucacaaggaguggaacauaugugagugccauagcccagacugaaaaaagcaucgaagacaauccagagauugaagaugacaucuuuagaaagaaaagauugaccaucauggaccuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagcuaucagagcugagcacacugggcgggagauuguggaucuaaugugucaugccacauuuaccaugaggcuauuaucaccaauuagagugccaaauuacaaccugaucaucauggaugaagcccauuucacagacccagcaagcauagcagcuagaggauacauuucaacucgaguagagaugggugaagcagcugggauuuucaugacagccaccccuccuggaagcagagacccauuuccccagagcaacgcaccaaucauggaugaagaaagagaaaucccugagcguucguggaacucuggacaugaguggguuacggauuuuaaagggaagacuguuugguuuguuccaaguauaaaagcagggaaugauauagcagcuugccugagaaagaauggaaagaaagugauacaacucagcaggaaaacuuuugauucugaauauaucaagacuaggaccaaugauugggacuuuguggucacgacagacauuucagaaaugggugcuaacuucaaggcugagaggguuauagaccccagacgcugcaugaaaccagucauauuaacagacggugaagagcgggugaucuuggcaggacccaugccagugacccauucuagugcagcacaaagaagagggagaguaggaagaaauccaaaaaaugaaaaugaccaguacauauacaugggggaaccucuggaaaaugaugaagacugugcacacuggaaagaagcuaagaugcucuuggauaacaucaacacgccugaaggaaucauucccagcauguucgaaccagagcgugaaaagguggaugccauugauggugaauaccgcuugagaggagaagcgaggaaaacuuuuguggaccuaaugagaagaggagauuuaccagucuggcuagccuacagaguggcggcugaaggcaucaacuacgcagacagaagauggugcuuugauggagucaagaacaaccaaaucuuggaagaaaauguggaaguagaaauuuggacaaaagaaggagaaaggaagaaauuaaaacccagaugguuggaugcuaggaucuacucugacccauuggcgcucaaagaauucaaggaauucgcagcuggaagaaagucccugacccugaaucuaaucacagagauggguagacucccaaccuucaugacccagaaagcaaagaaugcacucgacaacuuagcaguccugcauacggcugaagcaggcggaagggcguacaaucaugcucuuagugaacugccggagacucuggagacauugcuuuuacugacacuuuuggccacagucacgggcggaaucuuccuguucuugaugagcggaaaggguauagggaagaugacccugggaaugugcugcauaaucacggcuaguauccucuuaugguaugcacaaauacagccacacuggauagcagcuucaauaauacuggaguuuuuucucauagucuugcucauuccagaaccagaaaaacagagaacaccccaagauaaccaguuaacuuauguugucauagccauccuuacaguaguggccgcaaccauggcaaacgagauggguuuccuggaaaaaacaaagaaagauuucggauugggaagcauuacaacccagcaaccugagaguaacauccuggacauagaucuacguccugcaucagcuuggacucuauaugccguggcaacaacuuucaucacaccaauguugaggcauagcauugaaaacuccucagugaaugugucccuaacagccauugccaaccaagccacaguguuaaugggucuugggaaaggauggccauugucaaaaauggacaucggaguuccccuucucgcuaucgggugcuauucacaagucaaccccauaacucucacugcagcccuucucuuauugguagcccauuaugccaucauagggccaggacuccaagcgaaagcaacuagagaggcucagaaaagagcagcagcgggcaucaugaaaaacccaacuguggauggaaugacagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcaaccgggcccaucucuacacugugggaaggaaauccagggagauuuuggaauacaacuauugcagugucaauggcuaacauuuuuagagggaguuaccuggccggagccggacuucucuuuucuaucaugaaaaacacggccaacacaagaaggggaacuggcaacacaggagagacgcuuggggagaaauggaaaaaccgguugaaugcauuagggaagagugaauuccagaucuacaagaaaaguggaauccaggaaguggacagaaccuuagcaaaagaaggcaucaaaagaggagaaacggaccaucacgcugugucgcgaggcucagcgaaacugagaugguucgucgagagaaaccuggucacaccagaagggaaaguaguggaccuuggcugcggcagggggggcuggucauacuauugugggggacuaaagaauguaaaagaagucaaaggccuaacaaaaggaggaccaggacacgaagaacccauucccaugucaacauaugguuggaaucuggugcgccuucaaaguggaguugauguuuuuuucacuccgccagaaaagugugacacacugcugugugacauaggggagucgucaccaaaccccacgguugaggcaggacgaacacucagaguucuaaacuuaguggaaaauuggcugaacaacaacacccaauuuugcauaaagguucuuaacccauacaugcccucaguuauagaaaaaauggaagcacuacaaaggaaauacggaggagcuuuggugaggaauccacucucacgaaauuccacacacgagauguacuggguauccaaugcuuccgggaauauagugucaucagugaacaugauuucaagaauguugauuaacagauucacaaugagacacaagaaagccacauacgagccagauguugaccucggaaguggaacccgcaacaucggaauugaaagugagacaccaaauuuagacauaauugggaaaagaauagaaaaaauaaaacaagagcaugaaacaucauggcacuaugaccaagaccacccauacaaaacgugggccuaccauggcagcuacgaaacaaaacagacuggaucagcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccgaaagaaggcacgaaaaaacuaaugaaaauuacugcagaauggcucuggaaagaacuaggaaagaaaaagacaccuaggaugugcaccagagaagaauucacaagaaaggugagaagcaaugcagcuuuaggugccauauucacugaugagaacaaguggaagucggcacgugaggcuguugaagacaguggauuuugggaauugguugacagggaaaggaaucuccaucuugaaggaaagugugaaacauguguguauaacaugaugggaaagagagagaagaagcuaggggaguucggcaaagcaaaaggcagcagagccauaugguacauguggcuuggagcacgcuucuuagaguuugaagcucuaggauucuugaacgaagaucacugguuuuccagagagaacucccugaguggaguggaaggagaagggcuacacaagcuaggcuacauuuuaagagacgugaguaagaaagaaggaggagcaauguaugccgaugacaccgcaggaugggacacaagaaucacacuagaggacuuaaaaaaugaagaaauggugacaaaccacauggaaggagaacacaagaaacuugcugaagccauuuucaaauuaacguaccaaaacaagguggugcgugugcaaagaccaacaccaagaggcacaguaauggacauuauaucgagaagagaccaaagagguaguggacaaguugucaccuacggccucaauacuuucaccaauauggaagcccaacugaucagacagauggagggagaaggaguuuucaaaagcauccagcaacugacaguaaaagaagaaauugcagugaaaaacugguuaauaagaguggggcgugagagguuaucaagaauggccaucaguggagaugauuguguugugaaaccuuuagaugacagguuugcaagugcucuaacagcucuaaaugacaugggaaagguuaggaaagacauacaacaaugggaaccuucaagaggauggaacgauuggacacaagugcccuuuuguucacaccauuuccaugaguuaaucaugaaggacggucgugugcucguaguuccaugcagaaaccaagaugaacugauuggcagggcccgaauuucccagggagccgggugguccuugcgggaaacagccugucuggggaaguccuacgcccaaauguggagccugauguacuuccacagacgugaccuuaggcuggcggcaaaugccauuugcucggcagucccaucacauuggauuccaacaagucgaacaaccugguccauacacgccacacaugaguggaugacaacagaagacauguugacagucuggaacaggguguggauucaagaaaacccauggauggaagacaaaacuccaguagaaucaugggaggaaaucccguauuuggggaaaagagaagaccaauggugcggcucauugauugggcuaacaagcagggccaccugggcaaagaacauucaaacagcaauaaaucaaguuagaucccuaauaggcaaugaggaauacacagacuacaugccaucuaugaaaagauucagaagagaagaggaagaggcaggagucuugugguag

SEQ ID NO: 6417 - RNA, 9876 nt, Artificial Sequence
  derived and/or modified CDS sequence (wt) from DENV-2__KX380818__SS-prME
acugcagguauaauuauuaugaugaucccaacagugauggcguuccauuuaaccacacgcaauggagaaccacacaugaucgucaguagacaagagaaagggaaaagucuucuguuuaaaacagagaacggugugaacaugugcacccucauggccauggaucuuggugaacugugugaagacacaaucacuuacaauuguccucuucucaggcagaaugaaccagaagacauagacuguuggugcaacucuacgucuacauggguaacuuaugggacaugcaccgcuacaggagaacacagaagggaaaaaagaucaguggcacucguuccacaugugggaaugggacuggagacacgaacugaaacauggaugucaucagaaggggccuggaaacaugcacagagaauugaaacuugggucuugagacauccaggcuucaccauaauggcagcaauccuggcauacaccauaggaacgacauauuuccaaagaguccugauuuucaucuuacugacagcuguugcucccucaaugacaaugcguuguauaggaauaucaaauagagacuuuguggaagggguuucaggaggaagcuggguugacauagucuuggaacauggaagcugugugacgacgauggcaaaaaauaaaccaacauuggauuuugaacugauaaagacagaagcaaaacaucccgccacucuaaggaaguauugcauagaggcaaagcugaccaacacaacaacagcaucucgcugcccaacacaaggagaacccagccuaaaugaagaacaggacaaaagauuugucugcaaacacuccaugguagacagaggauggggaaauggaugcggauuauuuggaaagggagguaucgugaccugugcaauguucacaugcaaaaagaacauggaagggaaaaucgugcaaccagaaaacuuggaguacaccauugugauaacaccucacucaggggaagagaaugcagucggaaaugacacaggaaaacacggcaaggaaauuaaaguaacaccacagaguuccaucacagaagcagaacuaacaggcuauggcacugucacgauggaaugcucuccgagaacgggacucgacuucaaugagaugguguugcugcaaauggaaaacaaggcuuggcuggugcacaggcaaugguucuuagaccugccauuaccauggcugcccggagcagacacacaaggaucaaauuggauacagaaggagacauuggucacuuucaaaaauccccaugcaaagaaacaggauguuguuguucuaggaucccaagaaggggcuaugcacacagcacuuacaggggccacggaaauccagaugucaucaggaaacuuacuguucacaggacaucuuaaauguaggcugagaauggauaaacuacagcucaaaggaaugucauauuccauguguacaggaaaguucaaaguugugaaggaaauagcagaaacacaacauggaacaauaguuaucagaguacaauaugaaggggacgguucuccgugcaagaucccuuuugaaauaauggauuuggaaaaaagacaugucuuaggucgcuugaucacagucaacccaauugucacagaaaaagacagcccagucaacauagaagcagaaccuccauucggagacagcuacaucauuauaggaguagaaccgggacaacugaagcucagcugguuuaagaaaggaagcucuauuggccaaauguuugagacaacaaugagaggagcgaagagaauggccauuuuaggugacacagcuugggauuuuggaucccugggaggaguguucacaucuauaggaaaggcccuccaccaagucuuuggagcaaucuauggggcugccuucagugggguuucauggacuaugaaaauccucauaggagucgucaucacauggauaggaaugaauucacgcagcacuucacugucugugucacuaguauuagugggagucgugacauuguauuugggaguuauggugcaggccgauagugguugcguugugagcuggaaaaacaaagaacugaaauguggcagugggauuuuuaucacagacaacgugcauacauggacagaacaauacaaauuccaaccagaauccccuucaaagcuggcuucagcuauccagaaggcucaugaagaaggcauuuguggaauccgcucaguaacaagacuggagaaucugauguggaaacaaauaacaccagaacugaaucacauucuaacagaaaaugagguaaaguugacuaucaugacaggagacauuaaaggaaucaugcaggcaggaaaacgaucccugcggccucaacccacugagcugaaguacucuuggaaagcauggggcaaagcgaaaaugcucuccacagagcuucauaaccacaccuuucucauugauggccccgagacagcagaaugucccaacacaaauagagcuuggaacucacuagagguugaagacuauggcuuuggaguauucaccacuaacauauggcugaaauugaaagaaaggcaggauguaucuugugacucaaaacucaugucggcagccauaaaagacaacagagccguccacgccgacauggguuauuggauagaaagcgcacucaaugacacauggaagauugagaaagccuccuuuauugaaguuaaaagcugccacuggccaaagucacacacucucuggaguaauggagugcuagaaagugagaugauaauuccaaagaauuuugcaggaccagugucacaacacaauuacagaccaggcuaucauacacaaacggcaggacccuggcaucuaggcaggcuugagauggacuuugauuucugcgaaggaacuacagugguggugacugaggacuguggaaauagaggacccuccuuaagaacaacuacugcuucuggaaaacucauaacagaauggugcugccgaucuugcacauuaccaccgcuaagguacagaggugaggauggaugcugguauggaauggaaaucagaccauugaaagagaaagaagagaacuuggucaacucuuuggucacagccggacauggacagauugacaacuucucacuaggagucuugggaauggcauuguuccuggaagagaugcuuagaacccgaguagggacgaaacaugcaauauuacuaguugcagucucuuucgugacauugaucacagggaacauguccuuucgagacuuggggagagugauggucauggugggcgcuacuaugacggaugacauaggcaugggcgugaccuaucuugcccuauuagcagccuucaaggucagaccaacuuuugcagcuggacuacucuuaagaaaacugaccuccaaggaauugaugaugaccaccauaggaaucguacuccucucucagagcaccauaccagagaccauacuugaacugacugacgcguuggcuuuggggaugaugguucucaaaauaguaagaaacauggaaaaguaucaacuagcagugacuaucauggcuaucuugugcgucccaaaugcagugauauuacaaaacgcauggaaagugagcugcacaacacuggcagugguguccguuuccccacugcuuuuaacauccucacagcagaaaacggauuggauaccacuggcguugacgaucaaaggccuuaauccaacagccauuuucuuaacaacccucucaagaacuagcaagaaaaggagcuggccacuaaaugaggcuauuauggcagucgggauggugagcauuuuagccaguucuuucuuaaagaaugauauucccaugacaggaccacuaguggcuggagggcuucucacuguguguuacgugcucacuggaagaucggcugauuuggaacuggagagagcugcugacauaagaugggaagaacaggcagagauaucaggaagcaguccaauuuugucgauaacaauaucggaagauggcagcaugucgauaaaaaaugaagaagaagaacaaacacugaccauacugauuagaacaggacugcuggugauaucaggacuuuuucccgugucaauaccaaucacggcagcugcaugguaccugugggaagugaaaaaacaacgagccggaguguugugggauguuccuucaccuccaccugugggaaaggccgaacuggaagauggagccuauagaaucaagcagaaagggauuuugggauacucgcagauaggagccggagucuacaaagaaggaacuuuccacacaauguggcaugucacacguggugcuguucuaaugcauaaagggaagagaauugaaccaucaugggcggacgucaagaaggaccuaauaucguauggaggagguuggaagcuagaaggagaauggaaggaaggagaagaaguccagguccuggcauuagagccuggaaagaauccaagagccguccaaacaaaacccggucuuuuuaaaacuaacacuggaaccauaggcgccguaucucuggacuuuucuccuggaacgucaggaucuccaauugucgacaaaaaaggaaaaguugugggccuuuauggcaacggugucgucacaaggaguggaacauaugugagugccauagcccagacugaaaaaaacauugaagacaacccagagauugaagaugacaucuuucgaaagaaaagacugaccaucauggaccuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaucaaaccccagcuaucagagcugagcauacuggacgggagaucguggaucuaaugugucacgccacauuuaccaugaggcuacuaucaccaauuagagugccaaauuacaaccugauuaucauggaugaagcccauuucacagacccagcaagcauagcggcuagaggauacaucucaacucgaguagagaugggugaagcagcugggauuuucaugacagcuaccccuccuggaagcagagacccauuuccucagagcaacgcaccaaucauggaugaagaaagggaaauuccugagcguucguggaacucuggacaugaguggguuacggauuuuaaagggaagacuguuugguuuguuccaaguauaaaagcaggaaaugauauagcagcuugccugagaaagaaugggaagaaagugauacaacucagcaggaagaccuuugauucugaauaugucaagacuaggaccaaugauugggacuuuguggucacgacagacaucucagaaaugggugcuaacuucaaggcugagaggguuauagaccccagacgcugcaugaaaccagucauacuaacagacggugaagagcggguuauccuggcaggacccaugccagugacccacucuagugcagcacaaagaagagggagaguaggaagaaauccaaaaaaugaaaaugaccaguauauauacaugggggaaccucuggaaaaugaugaagacugcgcacacuggaaagaagcuaagaugcuucuagauaacaucaacacgccugaaggaaucauucccagcauguuugaaccagagcgugagaaggucgacgccauugauggugaauaccgcuugagaggagaagcgaggaaaacauuuguggaccuaaugagaagaggagaccuaccaguuuggcuagccuacagaguggcagcugaagguaucaacuacgcagacagaagauggugcuuugauggagucaagaacaaccaaaucuuggaagaaaauguggaaguggaaauuuggacaaaagaaggagaaaggaagaaauuaaaacccagaugguuagaugcuaggaucuacucugacccacuggcacuuaaagaauucaaggaauucgcagcuggaagaaaaucccugacccugaaucuaaucaccgagauggguaggcucccaaccuucaugacccagaaagcaaggaaugcauuggacaacuuagcaguccuacacacggcugaagcaggcggaagggcguacaaucaugcucuuagugaacugccggagacucuggagacauugcuuuuacugacacuuuuggccacagucacaggcggaaucuuccuguucuugaugagcggaaaggguauagggaagaugacccugggaaugugcugcauagucacagccaguauucuucuaugguaugcacaaauacagccacauuggauagcagcuucaauaauacuagaguuuuuucucauagucuugcucauuccagaaccagaaaagcagagaacaccccaagauaaccaauuaacuuauguugucauagccauccuuacagugguggccgcaaccauggcaaacgagauggguuuccuggaaaaaacaaagaaagauuucggauugggaaguaucacaacccagcaaccugagagcaacauccuagacauagaucuacguccugcaucagcuuggacucuauaugccguggcaacaacuuucaucacaccaauguugagacauagcauugaaaauuccucagugaaugugucucuaacagccauugccaaccaagccacaguguuaaugggucuugggaaaggauggccauugucgaaaauggacaucggaguuccccuucucgcuaucggaugcuauucacaagucaaucccauaacucucacagcagcccuucucuuauugguagcacauuaugcuaucauagggccaggacuccaagcgaaagcaaccagagaggcucagaaaagagcagcagcgggcaucaugaaaaucccagcugccgauaucggaagagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcgaccgggcccaucucuacacugugggaaggaaauccagggagauuuuggaauacaacuauugcagugucaauggcuaacauuuuuagagggaguuaccuggccggagccggacuucucuuuucuaucaugaagaacacggccaacacaagaaggggaacuggcaacacaggagagacgcuuggagagaaauggaaaaaccaguugaaugcauuggggaagagugaauuccagaucuauaagaaaaguggaauccaggaaguggauagaacguuagcaaaagaaggcaucaagagaggagaaacggaccaucacgcugugucgcgaggcucagcgaaacugagaugguucgucgagagaaaccuugucacaccagaagggaaaguaguggaccuuggcugcggcagggggggcuggucauacuauugugggggacuaaagaauguaaaggaagucaaaggccuaacaaaaggaggaccaggacacgaagaacccauucccaugucaacauaugguuggaaucuggugcgucugcaaaguggagucgaugucuuuuuuacuccgccagaaaagugugacacauugcugugugacauaggggagucgucaccaaaccccacgguugaggcaggacgaacacucagaguucuaaacuuaguggaaaacuggcugaacaauaauacccaauuuugcauaaagguucuuaacccauauaugccuucaguuauagaaaaaauggaagcgcuacaaaggaaauacggaggagcuuuggugaggaauccacucucacgaaauuccacacacgagauguacuggguauccaaugcuuccgggaacauagugucaucagugaacaugauuucaagaauguugauuaacagauucacaaugagacacaagaaggccacauacgagccggauguugaucucggaaguggaacccgcaacaucggaauugaaagugaaguaccaaaucuagacauaauugggaaaagaauagaaaaaauaaaacaagagcaugaaacaucauggcacuaugaucaagaccacccauacaaaacgugggccuaccauggcagcuacgaaacaaaacagacuggaucagcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccaaaagaagguacgaaaaaacuaaugaaaaucacggcagaauggcucuggaaagaacuaggaaagaaaaagacaccuaggaugugcaccagagaagaauucacaagaaaggugagaagcaaugcagccuuaggugccauauucacugaugagaacaaguggaagucggcacgugaagcuguugaagacaguggauuuugggaauugguugacaaggaaaggaaucuccaucuugaaggaaagugugagacauguguguauaacaugaugggaaagagagagaagaagcuaggggaguucggcaaagcaaaaggcagcagagccauaugguacauguggcuuggagcacgcuucuuagaguuugaagcccugggauucuugaaugaagaucacugguuuuccagagagaacucccugaguggaguagaaggagaagggcugcacaaacuaggcuacauucuaagagacgugaguaagaaagaaggaggagcaauguacgccgaugacaccgcaggaugggacacaagaaucacacuagaggacuugaaaaaugaagaaauggugacaaaccacauggaaggagaacacaagaaacuugcugaagccauuuucagauuaacguaccaaaacaaaguggugcgugugcaaagaccgacaccaagaggcacaguaauggacauuauaucgagaagagaccaaagagguaguggacagguugucaccuacggccucaacacuuucaccaacauggaagcccaacugaucagacagauggagggagaaggagucuucaaaagcauccagcaccugacagccacagaagaaauugcagugaaaaacugguuaguaagaguggggcgugagagguuaucaagaauggccaucagcggagaugauuguguugugaaacccuuagaugacagguuugcaaacgcucuaacagcuuuaaaugacaugggaaaggucaggaaagacauacaacaaugggaaccuucaagaggauggaacgauuggacacaagugcccuuuuguucacaccauuuccaugaguuaaucaugaaggacggucguguacuugugguuccauguagaaaccaagaugaacugauugguagggcccgaauuucccagggagccgggugguccuugcgggaaacagcuuguuuggggaagucuuacgcccaaauguggagccuaauguacuuccacagacgugaccuuaggcuggcggcaaaugccauuugcucggcagucccuucacauuggguuccaacaagucgaacaaccugguccauacacgccacacaugaguggaugacaacagaagacaugcugacagucuggaacaggguguggauucaagaaaacccauggauggaagacaaaacuccaguagaaucaugggaggaaaucccauauuuggggaagagagaagaccaguggugcggcucauugauugggcuaacaagcagggccaccugggcaaagaacauccaaacagcaauaaaucaaguuagaucccuaauaggcaaugaggaauacacagacuacaugccaucuaugaaaagauucagaagagaagaggaagaggcaggagucuugugguag

SEQ ID NO: 6418 - RNA, 9876 nt, Artificial Sequence
  derived and/or modified CDS sequence (wt) from DENV-2__KX380819__SS-prME
acugcagguauaauuauuaugaugauuccaacagugauggcguuccauuuaaccacacgcaauggagaaccacacaugaucgucaguagacaagaaaaagggaaaagucuucuguuuaaaacagagaacggugugaacauguguacccucauggccauggaccuuggugaacugugugaagacacaaucacuuauaauuguccucuucucaggcagaaugaaccagaagacauagacuguuggugcaacucuacgucuacauggguaacuuaugggacaugcaccgcuacaggagaacacagaagggaaaaaagaucaguggcacucguuccgcacgugggaaugggacuggagacacgaacugaaacauggaugucaucagaaggggccuggaaacaugcgcagagaauugaaacuugggucuugagacauccaggcuucacuguaauggcagcaauccuggcauacaccauaggaacgacauauuuccaaagaguccugauuuucaucuuacugacagcugucgcuccuucaaugacaaugcguuguauaggaauaucaaauagagacuuuguggaagggauuucaggaggaagcuggguugacauagucuuggaacauggaagcugugugacaacgauggcgaaaaauaaaccaacauuggauuuugaacugauaaaaacagaagccaaacaucccgccacucuaaggaaguauuguauagaggcaaagcugaccaacacaacaacagcaucucgcugcccaacacaaggagaaccuagccuaaaugaagaacaggacaaaagauuugucugcaaacacuccaugguagacagaggauggggaaauggaugcggauuauuuggaaagggagguaucgugaccugugcaauguucacaugcaaaaagaacauggaaggaaaaaucgugcaaccagaaaauuuggaauacaccauugugauaacaccucacucaggggaagagaaugcagucggaaaugauacaggaaaacacggcaaggaaauuaaagugacaccacagagcuccaucacagaagcagaacuaaccggcuauggcacugccacgauggaaugcucuccgagaacgggccucgacuucaaugagaugguguugcugcaaauggaaaacaaggcuuggcuagugcacaggcaaugguucuuagaccugccguuaccauggcugcccggagcagacacacaaggaucaaauuggauacagaaggagacauuggucacuuucaaaaauccccaugcaaagaaacaggauguuguuguguuaggaucccaagaaggggcuaugcacacagcacucacaggggccacggaaauccagaugucaucaggaaacuuacuguucacaggacaucuuaaaugcaggcugagaauggacaaacuacagcucaaaggaaugucauauuccauguguacaggaaaguucaaaguugugaaggaaauagcagaaacacaacauggaacaauaguuaucagaguacaauaugaaggggacgguucuccgugcaaaaucccuuuugaaauaauggauuuggaaaaaagacaugucuuaggucgcuugaucacagucaacccaauugucacagaaaaagacagcccagucaacauagaagcagaaccuccauucggagacagcuacaucauuauaggaguagaaccggggcaacugaagcucagcugguuuaagaaaggaaguucuauuggccaaauguuugagacaacaaugagaggagcgaagagaauggccauuuuaggugacacagcuugggauuuuggaucucugggaggaguguuuacaucuauaggaaaggcccuccaccaagucuuuggagcaaucuauggggcugccuucagugggguuucauggacuaugaaaauccucauaggaguugucaucacauggauaggaaugaauucacgcagcaccucacugucugugucacuaguauuagugggaaucgugacacuguauuugggaguuauggugcaggcugauaguggcugcguugugagcuggaaaaacaaagaacugaaauguggcagugggaucuuuaucacagacaacgugcacacauggacagaacaauacaaauuccaaccagaauccccuucaaaacuggcuucagcuauccagaaggcccaugaagagggcauuuguggaauccgcucaguaacaagacuggagaaucugauguggaaacaaauaacaccagaacugaaucacauucuaucagaaaaugagguaaaguugacuaucaugacaggagacauuaaaggaaucaugcaggcaggaaaacgaucccugcgaccucaacccacugagcugaaguacucuuggaaagcauggggcaaagcgaaaaugcucuccacagagcuccacaaccacaccuuucucauugauggccccgaaacagcagaaugucccaacacaaacagagcuuggaacucacuagaaguugaagacuauggcuuuggaguauucacuaccaacauauggcugaaauugaaagaaaggcaggauguauuuugugacucaaaacucaugucagcagccauaaaagacaacagagccguccacgccgauauggguuauuggauagaaagcgcacucaacgacacauggaagauugagaaagccucuuuuauugaaguuaaaagcugccacuggccaaagucacacacucucuggagcaauggagugcuagaaagugagaugauaauuccaaagaauuuugcaggaccagugucacaacacaauuacagaccaggcuaucauacacaaacggcaggacccuggcaucuaggcaggcuugagauggacuuugacuucugcgaaggaaccacagugguggugacugaggacuguggaaauagaggacccucuuuaagaacaacuacugcuucuggaaaacucauaacagaauggugcugccgaucuugcacauuaccaccgcuaagguacagaggugaggauggaugcugguauggaauggaaaucagaccauugaaagagaaagaagagaacuuggucaacucuuuggucacagccggacauggacagauugacaacuucucacuaggagucuugggaauggcauuguuccuggaagagaugcucaggacucgaguaggaacgaaacaugcaauauuauuaguugcagucucuuucgugacauugaucacagggaacauguccuuucgagauuuggggagagugauggucauggugggcgcuacuaugacggaugacauaggcaugggcgugacuuaucuugcccuauuagcagccuucaaagucagaccaacuuuugcagcuggacuacucuuaagaaagcugaccuccaaggaauugaugaugaccaccauaggaauuguacuccucucucagagcaccauaccagagacuauacuugaacugacugacgcguuggcuuuggggaugaugguucucaaaauaguaagaaacauggaaaaguaucaacuagcagugacuaucauggcuauccugugcgucccaaaugcagugauauuacaaaacgcauggaaagugagcugcacgauacuggcagugguguccguuuccccacugcuuuuaacauccucacagcagaaagcggauuggauaccacuggcguugacaaucaaaggccucaauccaacagccauuuucuuaacaacccucucaagaacuagcaagaaaaggagcuggccacuaaaugaggcuauuauggcagucgggauggugagcauuuuagccaguucucucuuaaagaaugauauucccaugacaggaccauuaguggcuggagggcuucucacuguguguuacgugcucacuggaagaucggcugauuuggaacuggaaagagcugcugacguaagaugggaggaacaggcagagauaucagggagcaguccaauucugucgauaacaauaucggaagaugguaguaugucgauaaaaaaugaagaagaagaacaaacacugaccauacuuauuagaacaggacugcuggugauaucaggacuuuuucccgugucaauaccaaucacggcagcugcaugguaccugugggaagugaaaaaacaacgagccggaguauugugggacgucccuucaccuccaccugugggaaaagccgaacuggaagauggagccuauagaaucaagcagaaagggauuuuaggauacucgcagauuggagccggaguuuacaaagaaggaacauuccacacaauguggcaugucacacguggugcuguucuaaugcacaaagggaagaggauugaaccaucaugggcggacgucaagaaagacuuaauaucguauggaggaggcuggaagcuagaaggagaauggaaggaaggagaagaaguccagguccuggcacuagagccuggaaagaauccaagagccguccaaacaaaacccggucuuuuuaaaacuaacacuggaaccauaggcgccguaucucuggacuuuucuccuggaacgucaggaucuccaauugucgacaaaaaaggaaaaguugugggccuuuauggcaacggugucgucacaaggagugggacauaugugagcgccauagcccagacugaaaaaagcaucgaagacaauccagagauugaagaugacaucuuucgaaagaaaagauugaccaucauggaccuccacccaggagcaggaaaaacaaagagauaccucccagcaauagucagagaagccauaaaacgaggcuugagaacacuaauccuggcccccacuagaguuguggcggcugaaauggaagaagcucucagaggacuuccaauaagauaccaaaccccagcuaucagagcugagcacacuggacgggagauuguggaucuaaugugucacgccacauucaccaugaggcuacuaucaccaaucagagugccaaauuacaaccugauuaucauggaugaagcccauuuuacagacccagcaagcauagcagcuagaggauacauuucaacucgaguagagaugggugaagcagcugggauuuucaugacagccaccccuccuggaagcagagacccauuuccucagagcaacgcaccaaucauggaugaagaaagggaaaucccugagcguucguggaacucuggacaugaguggguuacggauuuuaaagggaagacuguuugguuuguuccaaguauaaaagcaggaaaugauauagcagcuugccugagaaagaauggaaagaaagugauacaacucagcaggaagaccuuugauucugaauauaucaagacuaggaccaaugauugggacuuuguggucacgacagacauuucagaaaugggugccaacuucaaggcugagaggguuauagaccccagacgcugcaugaaaccagucauacuaacagacggugaagagcgggugaucuuggcaggacccaugccagugacccacucuagugcagcacaaagaagagggagaguaggaagaaauccaaaaaaugaaaaugaccaguacauauacaugggggaaccucuggaaaaugaugaagacugugcgcacuggaaagaagcuaagaugcuucuagauaacaucaacacgccugaaggaaucauucccagcauguucgaaccagagcgugaaaagguggaugccauugauggugaauaccgcuugagaggagaagcgaggaaaacauuuguggaccuaaugagaagaggagaccuaccagucuggcuagccuacagaguggcagcugaagguaucaacuacgcagacagaagauggugcuuugauggagucaagaacaaccaaauccuggaagaaaauguggaaguggaaauuuggacaaaagaaggagaaaggaagaaauuaaaacccagaugguuagaugccaggaucuacucugacccacuggcgcucaaagaauucaaggaauucgcagcuggaagaaaaucccugaccuugaaucuaaucaccgagauggguaggcucccaaccuucaugacccagaaagcaagaaaugcauuggacaacuuagcaguccugcauacggcugaagcaggcggaagggcguacaaucaugcucuuagugaacugccggagacucuggagacauugcuuuuacugacacucuuggccacagucacggguggaaucuuccuguucuugaugagcggaaaggguauagggaaaaugacccugggaaugugcugcauaaucacggccaguauucuccuaugguaugcucaaauacagccacacuggauagcagcuucaauaauacuggaguuuuuucucauagucuugcucauuccagaaccagagaagcagagaacaccccaagauaaccaauuaacuuauguugucauagccauccuuacagugguggccgcaaccauggcaaacgagauggguuuccuggaaaagacaaagaaagauuucggauugggaagcauuacaacccagcaaccugacagcaacauccuggacauagaucuacguccugcaucagcuuggacucuauaugccguggcaacaacuuucaucacaccaauguugagacacagcauugaaaauuccucagugaaugugucucuaacagccauugcuaaccaggccacaguguuaaugggucuugggaaaggauggccauugucaaaaauggacaucggaguuccccuucucgcuaucggaugcuauucacaagucaaccccauaacucucacagcagcccuucucuuauugguagcacacuaugcuaucauagggccaggacuccaagcgaaagcaacuagagaggcucagaaaagagcagcagcggguaucaugaaaaucccagcugccuugaucggaagagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcgaccgggcccaucucuacacugugggaaggaaauccagggagauuuuggaauacaacuauugcagugucaauggcuaacauuuuuagagggaguuaccuagccggagccggacuucucuuuucuaucaugaagaacacggccaacacaagaaggggaacuggcaacacaggagagacgcuuggagagaaauggaaaaaccgguuaaaugcauuggggaagagugaauuccagaucuauaagaaaaguggaauccaggaaguggauagaaccuuagcaaaagaaggcaucaaaaggggagaaacggaccaucacgcugugucgcgaggcucggcgaaacugagaugguucgucgagagaaaccuggucacaccagaagggaaaguaguggaccuuggcugcggcagggggggcuggucauacuauugugggggacuaaagaauguaaaagaagucaaaggccuaacaaaaggaggaccaggacaugaagagcccauucccaugucaacauaugguuggaaucuggugcgucuucaaaguggaguugaugucuuuuuuacuccgccagagaagugugacacauugcugugugacauaggggagucgucaccaaaccccacgguugaggcaggacgaacacucagaguucuaaacuuaguggaaaacuggcugaacaacaacacccaauuuugcauaaagguucucaacccauauaugccuucaguuauagaaaaaauggaagcgcuacaaaggaaauacggaggagcuuuggugaggaauccacucucacgaaauuccacacacgagauguacuggguauccaaugcuuccgggaacauagugucaucagugaacaugauuucaagaauguugauuaacagauucacaaugaaacauaagaaggccacauacgagccagauguugaucucggaagugggacccgcaacaucggaauugaaagugagacaccaaauuuagacauaauugggaaaagaauagaaaaaauaaaacaagagcaugaaacaucauggcacuaugaccaggaccacccauacaaaacgugggccuaccauggcagcuacgaaacaaaacagacuggaucagcaucauccauggugaacggaguaguuaggcugcuaacaaaaccuugggacgucaucccuauggugacacagauggcaaugacagacacgacuccauuuggacaacagcgcguuuucaaagaaaaaguggacacgagaacccaagaaccgaaagaaggcacgaaaaaacuaaugaaaaucacggcagaauggcucuggaaagaacuaggaaagaaaaagacaccuaggaugugcaccagagaagaauucacaagaaaggugagaagcaaugcagccuuaggugccauauucacugaugagaacaaguggaagucggcacgugaggcuguugaagacaguggauuuugggaauugguugacaaggaaaggaaucuccaucuugaaggaaagugugagacauguguguauaacaugaugggaaagagagagaagaagcuaggggaguucgguaaagcaaaaggcagcagagcuauaugguacauguggcuuggagcacgcuucuuagaguucgaagcccuaggauuuuugaaugaagaccacugguuuuccagagagaacucccugaguggaguggaaggagaagggcugcacaaacuaggcuacauuuuaagagacgugaguaagaaagaaggaggagcaauguacgccgaugacaccgcaggaugggacacaagaaucacacuagaggacuuaaaaaaugaagaaauggugacaaaccacauggaaggagaacacaggaaacuugcugaagcuauuuucagauuaacguaccaaaacaagguggugcgugugcaaagaccgacaccaagaggcacaguaauggacauuauaucgagaagagaccaaagagguaguggacaaguugucacuuacggccucaauacuuucaccaacauggaagcccaacugaucagacagauggagggagaaggagucuucaaaagcauccaacaccugacagucacagaagaaauugcagugaaaaacugguuagaaagaguggggcgugagagguuaucaagaauggccaucaguggagaugauuguguugugaaacccuuagaugacagguuugcaagcgcucuaacagcucuaaaugacaugggaaagguuaggaaagacauacaacaaugggaaccuucaagaggauggaacgauuggacacaagugcccuuuuguucacaccauuuccaugaguuaaucaugaaagacggucguguacuuguaguuccaugcagaaaccaagaugaacugauugguagggcccgaauuucccagggagccgggugguccuugcgggaaacagccuguuuggggaagucuuacgcccaaauguggagccugauguacuuccacaggcgugaccuuaggcuggcggcaaaugccauuugcucggcagucccaucacauuggguuccaauaagucgaacaaccugguccauacacgccacacaugaguggaugacaacagaagacaugcugacagccuggaacaggguguggauucaagaaaauccauggauggaagacaaaacuccaguagaaucaugggaggaaaucccauaucuggggaaaagagaagaccaguggugcggcucauugauugggcuaacaagcagggccaccugggcaaagaacauccaaacagcaauaaaucaaguuagaucccuaauaggcaaugaggaauacacagacuacaugccauccaugaaaagauucagaagagaagaggaagaggcaggagucuugugguaa

SEQ ID NO: 6419 - RNA, 9876 nt, Artificial Sequence
  derived and/or modified CDS sequence (wt) from DENV-2__KX380821__SS-prME
acugcagguauaauuauuaugaugauuccaacagugauggcguuccauuuaaccacacgcaauggagaaccacacaugaucgucaguagacaagaaaaagggaaaagucuucuguuuaaaacagagaacggugugaacauguguacccucauggccauggaccuuggugaacugugugaagacacaaucacuuauaauuguccucuucucaggcagaaugaaccagaagacauagacuguuggugcaacucuacgucuacauggguaacuuaugggacaugcaccgcuacaggagaacacagaagggaaaaaagaucaguggcacucguuccgcacgugggaaugggacuggagacacgaacugaaacauggaugucaucagaaggggccuggaaacaugcgcagagaauugaaacuugggucuugagacauccaggcuucacuguaauggcagcaauccuggcauacaccauaggaacgacauauuuccaaagaguucugauuuucaucuuacugacagcugucgcuccuucaaugacaaugcguuguauaggaauaucaaauagagacuuuguggaagggguuucaggaggaagcuggguugacauagucuuggaacauggaagcugugugacaacgauggcgaaaaauaaaccaacauuggauuuugaacugauaaaaacagaagccaaacaucccgccacucuaaggaaguauuguauagaggcaaagcugaccaacacaacaacagcaucucgcugcccaacacaaggagaaccuagccuaaaugaagaacaggacaaaagauuugucugcaaacacuccaugguagacagaggauggggaaauggaugcggauuauuuggaaagggagguaucgugaccugugcaauguucacaugcaaaaagaacauggaaggaaaaaucgugcaaccagaaaauuuggaauacaccauugugauaacaccucacucaggggaagagaaugcagucggaaaugauacaggaaaacacggcaaggaaauuaaagugacaccacagagcuccaucacagaagcagaacuaaccggcuauggcacugccacgauggaaugcucuccgagaacgggccucgacuucaaugagaugguguugcugcaaauggaaaacaaggcuuggcuagugcacaggcaaugguucuuagaccugccguuaccauggcugcccggagcagacacacaaggaucaaauuggauacagaaggagacauuggucacuuucaaaaauccccaugcaaagaaacaggauguuguuguguuaggaucccaagaaggggcuaugcacacagcacucacaggggccacggaaauccagaugucaucaggaaacuuacuguucacaggacaucuuaaaugcaggcugagaauggacaaacuacagcucaaaggaaugucauauuccauguguacaggaaaguucaaaguugugaaggaaauagcagaaacacaacauggaacaauaguuauuagaguacaauaugaaggggacgguuccccgugcaagaucccuuuugaaauaauggacuuggaaaaaaggcaugucuuaggacgcuugauuaccgucaacccaauugucacagaaaaagacagcccagucaacauagaagcagaaccuccauuuggagacaguuacaucauuauaggaguagaaccaggacaacugaagcucagcugguuuaagaaaggaaguucuauuggccaaauguuugagacaacaaugagaggagcgaagagaauggccauucuaggugacacagcuugggauuuuggaucccugggaggaguguucacaucuauaggaaaggcccuccaccaagucuuuggagcuaucuauggggcugccuucagugggguuucauggacuaugaaaauccucauaggagucgucaucacauggauaggaaugaauucacgcagcaccucacugucugugucacuaguauuagugggggucgugacauuguauuugggaguuauggugcaggccgauagugggugcguugugaguuggaaaaacaaagaacugaaaugugguagugggauuuuuaucacagacaacgugcacacauggacagaacaauacaaauuccaaccagaauccccuucaaagcuggcuucagcuauccagaaggcucaugaagaaggcauuuguggaauccgcucaguaacaagacuggagaaucugauguggaaacaaauaacaccagaauugaaucacauucuaacagaaaaugaaguaaaguugacuaucaugacaggagacaucaaaggaaucaugcaggcaggaaaacgaacccugcggccucaacccacugagcugaaguacuccuggaaggcauggggcaaagcgaaaaugcuuuccacagagcuucauaaccacaccuuucucauugauggccccgaaacagcagaaugucccaacacaaacagagcuuggaacucacuagaaguugaagacuauggcuuuggaguauucaccacuaacauauggcugaaauugaaagaaaggcaggauguguuuugugacucaaaacucaugucagcagccauaaaggacaauagagccguccacgccgauauggguuauuggauagaaagcgcacucaaugacacauggaagauugagaaagccucuuuuauugaaguuaaaagcugccacuggccaaagucacacacucucuggaguaauggagugcuggaaagugagaugauaauuccaaagaauuuugcaggaccaguuucacaacacaauuacagaccaggcuaccacacacaaacggcaggacccuggcaucuagguaggcuugagauggacuuugauuucugcgaaggaaccacagugguggugacugaggacuguggaaauagaggacccuccuuaagaacaacuacugcuucuggaaaacucauaacagaguggugcugccgaucuugcacauuaccaccgcuaagguacagaggugaggauggaugcugguaugguauggaaaucaggccauugaaagagaaagaagagaaccuggucaacucuuuggucacagccggacauggacagauugacaacuucucacuaggagucuugggaauggcauuguuccuggaagagaugcucaggacucgaguaggaacgaaacaugcaauauuacuaguugcagucucuuucgugacauugaucacagggaacauguccuuucgagauuuggggagagugauggucauggugggcgcuacuaugacggaugacauaggcaugggcgugacuuaucuugcccuauuagcagccuuuaaaaucagaccaaccuuugcggcuggacuacucuuaagaaagcugaccuccaaggaauugaugaugaccaccauaggaaucguacuccucucucagaguaccauaccagagagcauacuugaacugacugacgcguuggcuuuggggaugaugguucuuaaaauagugagaaacauggaaaaguaucagcuagcagugacuaucauggcaaucuugugcgucccaaaugcagugauauugcaaaaugcauggaaagugagcugcacaacacuggcagugguguccguuuccccacugcuuuuaacauccucacagcagaaagcggauuggauaccacuggcguugacgaucaaaggccucaauccaacagccauuuucuuaacaacucucucaagaacuagcaagaaaaggagcuggccacuaaaugaggcuauuauggcagucgggauggugagcauucuagcuaguucucucuuaaagaaugauauucccaugacaggaccauuaguggcuggagggcuucucacuguguguuacgugcucaccggaaggucggcugacuuggaacuggaaagagcugcugacguaagaugggaagaacaggcagagauaucaggaaguaguccaauucugucgauaacaauaucggaagaugguagcaugucgauaaagaaugaagaagaagaacagacacugaccauacucaucagaacaggacuacuggugauaucaggacuuuuuccugugucaauaccaaucacggcagcugcaugguaccuuugggaagugaaaaaacaacgagcaggaguauugugggaugucccuucacccccaccugugggaaaggccgaacuggaagauggagccuauagaaucaagcagaaagggauccuaggauacucacagauuggagccggaguuuacaaagaaggaacauuccacacaauguggcaugucacacguggugcuguccuaaugcauaaagggaagagaauugaaccaucaugggcggacgucaagaaagaccuaauaucguauggaggaggcuggaagcuggaaggagaauggaaggaaggagaagaaguccagguccuggcauuagagcccggaaagaauccaagagccguccaaacaaaacccggucuuuuuaaaaccaacacuggaaccauaggcgccgugucucuggacuuuucuccuggaacgucaggaucuccaaucgucgauaaaaaaggaaaaguugugggccuuuauggcaacggugucgucacaaggaguggaacauaugugagugccauagcccagacugaaaaaagcaucgaagacaauccagagauugaagaugacaucuuuagaaagaaaagauugaccaucauggaccuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagcuauuagagcugagcacacugggcgggagauuguggaucuaaugugucaugccacauuuaccaugaggcuauuaucaccaauuagagugccaaauuacaaccugaucaucauggaugaagcccauuucacagacccagcaagcauagcagcuagaggauacauuucaacucgaguagagaugggugaagcagcugggauuuucaugacagccaccccuccuggaagcagagacccauuuccccagagcaacgcaccaaucauggaugaagaaaaagaaaucccugagcguucguggaacucuggacaugaguggguuacggauuuuaaagggaagacuguuugguuuguuccaaguauaaaagcagggaaugauauagcagcuugccugagaaagaauggaaagaaagugauacaacucagcaggaaaacuuuugauucugaauauaucaagacuaggaccaaugauugggacuuuguggucacgacagacauuucagaaaugggugcuaacuucaaggcugagaggguuauagaccccagacgcugcaugaaaccagucauauuaacagacggugaagagcgggugaucuuggcaggacccaugccagugacccauucuagugcagcacaaagaagagggagaguaggaagaaauccaaaaaaugaaaaugaccaguacauauacaugggggaaccucuggaaaaugaugaagacugugcacacuggaaagaagcuaagaugcucuuggauaacaucaacacgccugaagggaucauucccagcauguucgaaccagagcgugaaaagguggaugccauugauggugaauaccgcuugagaggagaagcgaggaaaacuuuuguggaccuaaugagaagaggagauuuaccagucuggcuagccuacagaguggcggcugaaggcaucaacuacgcagacagaagauggugcuuugauggagucaagaacaaccaaaucuuggaagaaaauguggaaguagaaauuuggacaaaagaaggagaaaggaagaaauuaaaacccagaugguuggaugcuaggaucuacucugacccauuggcgcucaaagaauucaaggaauucgcagcuggaagaaagucccugacccugaaucuaaucacagagauggguagacucccaaccuucaugacccagaaagcaaagaaugcacucgacaacuuagcaguccugcauacggcugaagcaggcggaagggcguacaaucaugcucuuagugaacugccggagacucuggagacauugcuuuuacugacacuuuuagccacagucacgggcggaaucuuccuguucuugaugagcggaaaggguauagggaagaugacccugggaaugugcugcauaaucacggcuaguauccucuuaugguaugcacaaauacagccacacuggauagcagcuucaauaauacuggaguuuuuucucauagucuugcucauuccagaaccagaaaaacagagaacaccccaagauaaccaguuaacuuauguugucauagccauccuuacaguaguggccgcaaccauggcaaacgagauggguuuccuggaaaaaacaaagaaagauuucggauugggaagcauuacaacccagcaaccugagaguaacauccuggacauagaucuacguccugcaucagcuuggacucuauaugccguggcaacaacuuucaucacaccaauguugaggcauagcauugaaaacuccucagugaaugugucccuaacagccauugccaaccaagccacaguguuaaugggucuugggaaaggauggccauugucaaaaauggacaucggaguuccccuucucgcuaucgggugcuauucacaagucaaccccauaacucucacugcagcccuucucuuauugguagcccauuaugccaucauagggccaggacuccaagcgaaagcaacuagagaggcucagaaaagagcagcagcgggcaucaugaaaaacccaacuguggauggaaugacagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcaaccgggcccaucucuacacugugggaaggaaauccagggagauuuuggaauacaacuauugcagugucaauggcuaacauuuuuagagggaguuaccuggccggagccggacuucucuuuucuaucaugaaaaacacggccaacacaagaaggggaacuggcaacacaggagagacgcuuggggagaaauggaaaaaccgguugaaugcauuagggaagagugaauuccagaucuacaagaaaaguggaauccaggaaguggacagaaccuuagcaaaagaaggcaucaaaagaggagaaacggaccaucacgcugugucgcgaggcucagcgaaacugagaugguucgucgagagaaaccuggucacaccagaagggaaaguaguggaccuuggcugcggcagggggggcuggucauacuauugugggggacuaaagaauguaaaagaagucaaaggccuaacaaaaggaggaccaggacacgaagaacccauucccaugucaacauaugguuggaaucuggugcgccuucaaaguggaguugauguuuucuucacuccgccagaaaagugugacacacugcugugugacauaggggagucgucaccaaaccccacgguugaggcaggacgaacacucagaguucuaaacuuaguggaaaauuggcugaacaacaacacccaauuuugcauaaagguucuuaacccauacaugcccucaguuauagaaaaaauggaagcacuacaaaggaaauacggaggagcuuuggugaggaauccacucucacgaaauuccacacacgagauguacuggguauccaaugcuuccgggaauauagugucaucagugaacaugauuucaagaauguugauuaacagauucacaaugagacacaagaaagccacauacgagccagauguugaccucggaaguggaacccgcaacaucggaauugaaagugagacaccaaauuuagacauaauugggaaaagaauagaaaaaauaaaacaagagcaugaaacaucauggcacuaugaccaagaccacccauacaaaacgugggccuaccauggcagcuacgaaacaaaacagacuggaucagcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccgaaagaaggcacgaaaaaacuaaugaaaauuacugcagaauggcucuggaaggaacuaggaaagaaaaagacaccuaggaugugcaccagagaagaauucacaagaaaggugagaagcaaugcagccuuaggugccauauucacugaugagaacaaguggaagucggcacgugaggcuguugaagacaguggauuuugggaauugguugacaaggaaaggaaucuccaucuugaaggaaagugugaaacaugcguguauaacaugaugggaaagagagagaagaagcuaggggaguucggcaaagcaaaaggcagcagagccauaugguacauguggcuuggagcacgcuucuuagaguuugaagcucuaggauucuugaacgaagaucacugguuuuccagagagaacucccugaguggaguggaaggagaagggcuacacaagcuaggcuacauuuuaagagacgugaguaagaaagaaggaggagcaauguaugcugaugacaccgcaggaugggacacaagaaucacacuagaggacuugaaaaaugaagaaauggugacaaaccacauggaaggagaacacaagaaacuugcugaagccauuuucaaauuaacguaccaaaacaagguggugcgugugcaaagaccaacaccaagaggcacaguaauggacauuauaucgagaagagaccaaagagguaguggacaaguugucaccuacggccucaauacuuucaccaauauggaagcccaacugaucagacagauggagggagaaggaguuuucaaaagcauccagcaacugacaguaaaagaagaaauugcagugaaaaacugguuaauaagaguggggcgugagagguuaucaagaauggccaucaguggagaugauuguguugugaaacccuuagaugacagguuugcaagugcucuaacagcucuaaaugacaugggaaagguuaggaaagacauacaacaaugggaaccuucaagaggauggaacgauuggacacaagugcccuuuuguucacaccauuuccaugaguuaaucaugaaggacggucgugugcucguaguuccaugcagaaaccaagaugaacugauuggcagggcccgaauuucccagggagccgggugguccuugcgggaaacagccugucuggggaaguccuacgcccaaauguggagccugauguacuuccacagacgugaccuuaggcuggcggcaaaugccauuugcucggcagucccaucacauuggauuccaacaagucgaacaaccugguccauacacgccacacaugaguggaugacaacagaagacauguugacagucuggaacaggguguggauucaagaaaacccauggauggaagacaaaacuccaguagaaucaugggaggaaaucccguauuuggggaaaagagaagaccaauggugcggcucauugauugggcuaacaagcagggccaccugggcaaagaacauccaaacagcaauaaaucaaguuagaucccuaauaggcaaugaggaauacacagacuacaugccaucuaugaaaagauucagaagagaagaggaagaggcaggggucuugugguag

SEQ ID NO: 6420 - RNA, 9876 nt, Artificial Sequence
  derived and/or modified CDS sequence (wt) from DENV-2__KX380822__SS-prME
acugcagguauaauuauuaugaugauuccaacagugauggcguuccauuuaaccacacgcaauggagaaccacacaugaucgucaguagacaagaaaaagggaaaagucuucuguuuaaaacagagaacggugugaacauguguacccucauggccauggaccuuggugaacugugugaagacacaaucacuuauaauuguccucuucucaggcagaaugaaccagaagacauagacuguuggugcaacucuacgucuacauggguaacuuaugggacaugcaccgcuacaggagaacacagaagggaaaaaagaucaguggcacucguuccgcacgugggaaugggacuggagacacgaacugaaacauggaugucaucagaaggggccuggaaacaugcgcagagaauugaaacuugggucuugagacauccaggcuucacuguaauggcagcaauccuggcauacaccauaggaacgacauauuuccaaagaguccugauuuucaucuuacugacagcugucgcuccuucaaugacaaugcguuguauaggaauaucaaauagagacuuuguggaagggguuucaggaggaagcuggguugacauagucuuggaacauggaagcugugugacaacgauggcgaaaaauaaaccaacauuggauuuugaacugauaaaaacagaagccaaacaucccgccacucuaaggaaguauuguauagaggcaaagcugaccaacacaacaacagcaucucgcugcccaacacaaggagaaccuagccuaaaugaagaacaggacaaaagauuugucugcaaacacuccaugguagacagaggauggggaaauggaugcggauuauuuggaaagggagguaucgugaccugugcaauguucacaugcaaaaagaacauggaaggaaaaaucgugcaaccagaaaauuuggaauacaccauugugauaacaccucacucaggggaagagaaugcagucggaaaugauacaggaaaacacggcaaggaaauuaaagugacaccacagagcuccaucacagaagcagaacuaaccggcuauggcacugccacgauggaaugcucuccgagaacgggccucgacuucaaugagaugguguugcugcaaauggaaaacaaggcuuggcuagugcacaggcaaugguucuuagaccugccguuaccauggcugcccggagcagacacacaaggaucaaauuggauacagaaggagacauuggucacuuucaaaaauccccaugcaaagaaacaggauguuguuguguuaggaucccaagaaggggcuaugcacacagcacucacaggggccacggaaauccagaugucaucaggaaacuuacuguucacaggacaucuuaaaugcaggcugagaauggacaaacuacagcucaaaggaaugucauauuccauguguacaggaaaguucaaaguugugaaggaaauagcagaaacacaacauggaacaauaguuaucagaguacaauaugaaggggacgguucuccgugcaaaaucccuuuugaaauaauggauuuggaaaaaagacaugucuuaggucgcuugaucacagucaacccaauugucacagaaaaagacagcccagucaacauagaagcagaaccuccauucggagacagcuacaucauuauaggaguagaaccggggcaacugaagcucagcugguuuaagaaaggaaguucuauuggccaaauguuugagacaacaaugagaggagcgaagagaauggccauuuuaggugacacagcuugggauuuuggaucucugggaggaguguuuacaucuauaggaaaggcccuccaccaagucuuuggagcaaucuauggggcugccuucagugggguuucauggacuaugaaaauccucauaggaguugucaucacauggauaggaaugaauucacgcagcaccucacugucugugucacuaguauuagugggaaucgugacacuguauuugggaguuauggugcaggcugauaguggcugcguugugagcuggaaaaacaaagaacugaaauguggcagugggaucuuuaucacagacaacgugcacacauggacagaacaauacaaauuccaaccagaauccccuucaaaacuggcuucagcuauccagaaggcccaugaagagggcauuuguggaauccgcucaguaacaagacuggagaaucugauguggaaacaaauaacaccagaacugaaucacauucuaucagaaaaugagguaaaguugacuaucaugacaggagacauuaaaggaaucaugcaggcaggaaaacgaucccugcgaccucaacccacugagcugaaguacucuuggaaagcauggggcaaagcgaaaaugcucuccacagagcuccacaaccacaccuuucucauugauggccccgaaacagcagaaugucccaacacaaacagagcuuggaacucacuagaaguugaagacuauggcuuuggaguauucacuaccaacauauggcugaaauugaaagaaaggcaggauguauuuugugacucaaaacucaugucagcagccauaaaagacaacagagccguccacgccgauauggguuauuggauagaaagcgcacucaacgacacauggaagauugagaaagccucuuuuauugaaguuaaaagcugccacuggccaaagucacacacucucuggagcaauggagugcuagaaagugagaugauaauuccaaagaauuuugcaggaccagugucacaacacaauuacagaccaggcuaucauacacaaacggcaggacccuggcaucuaggcaggcuugagauggacuuugacuucugcgaaggaaccacagugguggugacugaggacuguggaaauagaggacccucuuuaagaacaacuacugcuucuggaaaacucauaacagaauggugcugccgaucuugcacauuaccaccgcuaagguacagaggugaggauggaugcugguauggaauggaaaucagaccauugaaagagaaagaagagaacuuggucaacucuuuggucacagccggacauggacagauugacaacuucucacuaggagucuugggaauggcauuguuccuggaagagaugcucaggacucgaguaggaacgaaacaugcaauauuauuaguugcagucucuuucgugacauugaucacagggaacauguccuuucgagauuuggggagagugauggucauggugggcgcuacuaugacggaugacauaggcaugggcgugacuuaucuugcccuauuagcagccuucaaagucagaccaacuuuugcagcuggacuacucuuaagaaagcugaccuccaaggaauugaugaugaccaccauaggaauuguacuccucucucagagcaccauaccagagacuauacuugaacugacugacgcguuggcuuuggggaugaugguucucaaaauaguaagaaacauggaaaaguaucaacuagcagugacuaucaugacuauccugugcgucccaaaugcagugauauuacaaaacgcauggaaagugagcugcacgauacuggcagugguguccguuuccccacugcuuuuaacauccucacagcagaaagcggauuggauaccacuggcguugacaaucaaaggccucaauccaacagccauuuucuuaacaacccucucaagaacuagcaagaaaaggagcuggccacuaaaugaggcuauuauggcagucgggauggugagcauuuuagccaguucucucuuaaagaaugacauucccaugacaggaccauuaguggcuggagggcuucucacuguguguuacgugcucacuggaagaucggcugauuuggaacuggaaagagcugcugacguaagaugggaggaacaggcagagauaucagggagcaguccaauucugucgauaacaauaucggaagaugguaguaugucgauaaaaaaugaagaagaagaacaaacacugaccauacuuauuagaacaggacugcuggugauaucaggacuuuuucccgugucaauaccaaucacggcagcugcaugguaccugugggaagugaaaaaacaacgagccggaguauugugggacgucccuucaccuccaccugugggaaaagccgaacuggaagauggagccuauagaaucaagcagaaagggauuuuaggauacucgcagauuggagccggaguuuacaaagaaggaacauuccacacaauguggcaugucacacguggugcuguucuaaugcacaaagggaagaggauugaaccaucaugggcggacgucaagaaagacuuaauaucguauggaggaggcuggaagcuagaaggagaauggaaggaaggagaagaaguccagguccuggcauuagagccuggaaagaauccaagagccguccaaacaaaacccggucuuuuuaaaacuaacacuggaaccauaggcgccguaucucuggacuuuucuccuggaacgucaggaucuccaauugucgacaaaaaaggaaaaguugugggccuuuauggcaacggugucgucacaaggagugggacauaugugagcgccauagcccagacugaaaaaagcaucgaagacaauccagagauugaagaugacaucuuucgaaagaaaagauugaccaucauggaccuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagcuaucagagcugagcacacuggacgggagauuguggaucuaaugugucacgccacauucaccaugaggcuacuaucaccaaucagagugccaaauuacaaccugauuaucauggaugaagcccauuuuacagacccagcaagcauagcagcuagaggauacauuucaacucgaguagagaugggugaagcagcugggauuuucaugacagccaccccuccuggaagcagagacccauuuccucagagcaacgcaccaaucauggaugaagaaagggaaaucccugagcguucguggaacucuggacaugaguggguuacggauuuuaaagggaagacuguuugguuuguuccaaguauaaaagcaggaaaugauauaacagcuugccugagaaagaauggaaagaaagugauacaacucagcaggaagaccuuugauucugaauauaucaagacuaggaccaaugauugggacuuuguggucacgacagacauuucagaaaugggugccaacuucaaggcugagaggguuauagaccccagacgcugcaugaaaccagucauacuaacagacggugaagagcgggugaucuuggcaggacccaugccagugacccacucuagugcagcacaaagaagagggagaguaggaagaaauccaaaaaaugaaaaugaccaguacauauacaugggggaaccucuggaaaaugaugaagacugugcgcacuggaaagaagcuaagaugcuucuagauaacaucaacacgccugaaggaaucauucccagcauguucgaaccagagcgugaaaagguggaugccauugauggugaauaccgcuugagaggagaagcaaggaaaacauuuguggaccuaaugagaagaggagaccuaccagucuggcuagccuacagaguggcagcugaagguaucaacuacgcagacagaagauggugcuuugauggagucaagaacaaccaaauccuggaagaaaauguggaaguggaaauuuggacaaaagaaggagaaaggaagaaauuaaaacccagaugguuagaugccaggaucuacucugacccacuggcgcucaaagaauucaaggaauucgcagcuggaagaaaaucccugaccuugaaucuaaucaccgagauggguaggcucccaaccuucaugacccagaaagcaagaaaugcauuggacaacuuagcaguccugcauacggcugaagcaggcggaagggcguacaaccaugcucuuagugaacugccggagacucuggagacauugcuuuuacugacacucuuggccacagucacggguggaaucuuccuguucuugaugagcggaaaggguauagggaaaaugacccugggaaugugcugcauaaucacggccaguauucuccuaugguaugcucaaauacagccacacuggauagcagcuucaauaauacuggaguuuuuucucauagucuugcucauuccagaaccagagaagcagagaacaccccaagauaaccaauuaacuuauguugucauagccauccuuacagugguggccgcaaccauggcaaacgagauggguuuccuggaaaagacaaagaaagauuucggauugggaagcauuacaacccagcaaccugacagcaacauccuggacauagaucuacguccugcaucagcuuggacucuauaugccguggcaacaacuuucaucacaccaauguugagacacagcauugaaaauuccucagugaaugugucucuaacagccauugcuaaccaggccacaguguuaaugggucuugggaaaggauggccauugucaaaaauggacaucggaguuccccuucucgcuaucggaugcuauucacaagucaaccccauaacucucacagcagcccuucucuuauugguagcacacuaugcuaucauagggccaggacuccaagcgaaagcaacuagagaggcucagaaaagagcagcagcggguaucaugaaaaucccagcugccgauggaaugacagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcgaccgggcccaucucuacacugugggaaggaaauccagggagauuuuggaauacaacuauugcagugucaauggcuaacauuuuuagagggaguuaccuagccggagccggacuucucuuuucuaucaugaagaacacggccaacacaagaaggggaacuggcaacacaggagagacgcuuggagagaaauggaaaaaccgguuaaaugcauuggggaagagugaauuccagaucuauaagaaaaguggaauccaggaaguggauagaaccuuagcaaaagaaggcaucaaaaggggagaaacggaccaucacgcugugucgcgaggcucggcgaaacugagaugguucgucgagagaaaccuggucacaccagaagggaaaguaguggaccuuggcugcggcagggggggcuggucauacuauugugggggacuaaagaauguaaaagaagucaaaggccuaacaaaaggaggaccaggacaugaagagcccauucccaugucaacauaugguuggaaucuggugcgucuucaaaguggaguugaugucuuuuuuacuccgccagagaagugugacacauugcugugugacauaggggagucgucaccaaaccccacgguugaggcaggacgaacacucagaguucuaaacuuaguggaaaacuggcugaacaacaacacccaauuuugcauaaagguucucaacccauauaugccuucaguuauagaaaaaauggaagcgcuacaaaggaaauacggaggagcuuuggugaggaauccacucucacgaaauuccacacacgagauguacuggguauccaaugcuuccgggaacauagugucaucagugaacaugauuucaagaauguugauuaacagauucacaaugaaacauaagaaggccacauacgagccagauguugaucucggaagugggacccgcaacaucggaauugaaagugagacaccaaauuuagacauaauugggaaaagaauagaaaaaauaaaacaagagcaugaaacaucauggcacuaugaccaggaccacccauacaaaacgugggccuaccauggcagcuacgaaacaaaacagacuggaucagcaucauccauggugaacggaguaguuaggcugcuaacaaaaccuugggacgucaucccuauggugacacagauggcaaugacagacacgacuccauuuggacaacagcgcguuuucaaagaaaaaguggacacgagaacccaagaaccgaaagaaggcacgaaaaaacuaaugaaaaucacggcagaauggcucuggaaagaacuaggaaagaaaaagacaccuaggaugugcaccagagaagaauucacaagaaaggugagaagcaaugcagccuuaggugccauauucacugaugagaacaaguggaagucggcacgugaggcuguugaagacaguggauuuugggaauugguugacaaggaaaggaaucuccaucuugaaggaaagugugagacauguguguauaacaugaugggaaagagagagaagaagcuaggggaguucgguaaagcaaaaggcagcagagcuauaugguacauguggcuuggagcacgcuucuuagaguucgaagcccuaggauuuuugaaugaagaccacugguuuuccagagagaacucccugaguggaguggaaggagaagggcugcacaaacuaggcuacauuuuaagagacgugaguaagaaagaaggaggagcaauguacgccgaugacaccgcaggaugggacacaagaaucacacuagaggacuuaaaaaaugaagaaauggugacaaaccacauggaaggagaacacaggaaacuugcugaagcuauuuucagauuaacguaccaaaacaagguggugcgugugcaaagaccgacaccaagaggcacaguaauggacauuauaucgagaagagaccaaagagguaguggacaaguugucacuuacggccucaauacuuucaccaacauggaagcccaacugaucagacagauggagggagaaggagucuucaaaagcauccaacaccugacagucacagaagaaauugcagugaaaaacugguuagaaagaguggggcgugagagguuaucaagaauggccaucaguggagaugauuguguugugaaacccuuagaugacagguuugcaagcgcucuaacagcucuaaaugacaugggaaagguuaggaaagacauacaacaaugggaaccuucaagaggauggaacgauuggacacaagugcccuuuuguucgcaccauuuccaugaguuaaucaugaaagacggucguguacuuguaguuccaugcagaaaccaagaugaacugauugguagggcccgaauuucccagggagccgggugguccuugcgggaaacagccuguuuggggaagucuuacgcccaaauguggagccugauguacuuccacaggcgugaccuuaggcuggcggcaaaugccauuugcucggcagucccaucacauuggguuccaacaagucgaacaaccugguccauacacgccacacaugaguggaugacaacagaagacaugcugacagucuggaacaggguguggauucaagaaaauccauggauggaagacaaaacuccaguagaaucaugggaggaaaucccauaucuggggaaaagagaagaccaauggugcggcucauugauugggcuaacaagcagggccaccugggcaaagaacauccaaacagcaauaaaucaaguuagaucccuaauagguaaugaggaauacacagacuacaugccauccaugaaaagauucagaagagaagaggaagaggcaggagucuugugguaa

SEQ ID NO: 6421 - RNA, 9876 nt, Artificial Sequence
  derived and/or modified CDS sequence (wt) from DENV-2__KX380828__SS-prME
acugcaggcgugaucaucaugcuaauuccaacagcgauggcguuccauuuaaccacacgcaacggagaaccacacaugaucgucagcagacaagagaaagggaaaagucucuuguucaaaacagaggauggugugaacauguguacccucauggccauggaccuuggugaacugugugaagacacaaucacuuauaacuguccucuucucaggcagaaugaaccagaagauauagauuguugguguaacuccacguccacauggguaacuuaugggacaugcacugccacaggagaacacagaagggaaaaaagaucaguggcacucgucccacaugugggaaugggauuggagacacgaacugaaacauggaugucaucagaaggggccuggaaacacgcccagagaauugaaaccuggaucuugagacauccagguuuuaccauaauggcagcaaucuuggcauacaccauaggaacgacauacuuccaaagaguccuaaucuucaucuuacugacagccgucgccccuucaaugacaaugcguuguauuggaauaucaaauagagacuuuguggaagggguuucaggaggaagcuggguugacauaguccuagaacauggaagcugcgugacaacgauggcaaaaaacaaaccaacauuggacuuugaacugauaaaaacagaagccaagcaaccugccacucuaaggaaguacuguauagaagcaaagcugaccaacacaacaacagcaucucgaugcccaacacaaggagaacccagccuaaaugaagaacaggacaaaagguuugucugcaaacauuccaugguagacagaggauggggaaauggauguggauuauuuggaaagggaggcaucgugaccugugcuauguucacaugcaaaaaaaacauggaaggaaaaauugugcaaccagaaaaccuggaauacaccauugugguaacaccucauucaggggaagagaaugcaguuggaaaugacacaggaaaacauggcaaggaaaucaaaguaacaccacagaguuccauuacagaagcagaacugacaggcuacggcacugucacgauggagugcucuccaagaacgggccucgacuucaaugaaaugguguugcugcaaauggaaaauaaggcuuggcuggugcacaggcaaugguucuuagaccugccguuaccaugguugcccggagcggacacacaaggaucaaauuggauacagaaggagauguuggucaccuucaaaaacccccaugcgaagaaacaggauguuguuguuuuaggaucccaagaaggggcuaugcauacagcacuuacaggggccacggaaauccagaugucaucaggaaaccuacuguucacaggacaucuuaagugcaggcugagaauggauaaauuacagcucaaaggaaugucauacucuauguguacaggaaaguuuaaaguuguaaaagaaauagcagagacacaacauggaacaauaguugucagaguacaauaugaaggggauggcucuccauguaagaucccuuuugagauaauggauuuggaaaaaagacaugucuuaggucgccugauuacagucaacccaaucguaacagaaaaagacaguccagucaacauagaagcagaaccuccauuuggagacagcuacaucauuauaggaguagaaccgggacaacugaagcucagcugguuuaagaaaggaagcucaaucggccaaauguucgagacaacaaugagaggagcgaagagaauggccauuuuaggugacacagccugggauuuuggaucccugggaggaguauucacaucuauaggaaaggcccuccaccaaguuuuuggagcaaucuauggggcugccuucaguggggucucauggacuaugaaaauccucauaggaguugucaucacauggauaggaaugaauucacguagcaccucacugucugugucacuaguauuagugggagucgugacauuguauuugggaguuauggugcaggcugauagugguuguguugugaguuggaaaaacaaagaacugaaauguggcagugggauuuuuaucacagacaauguacacacauggacagaacaauacaaauuccaaccagaaucccccucaaagcuggcuucagcuauccagaaagcucaugaagagggcauuuguggaauccgcucaguaacaagacuagagaaucuaauguggaaacaaauaacacccgaauugaaucacauucuaucagaaaaugagguaaaguugaccaucaugacaggagacaucaaagguaucaugcaggcaggaaaacgaucccugcggccucagcccacugagcugaaguauucauggaaaacguggggcaaagcgaaaaugcucuccacagagccucauaaccagaccuuucucauugauggccccgaaacagcagaaugucccaacacaaacagagcuuggaacucacuagaaguugaagacuauggcuuugggguguucaccaccaacauauggcugaaguugaaagaaaggcaggauguguuuugcgacucaaagcucaugucagcggccauaaaagacaacagagccguccaugccgauauggguuauuggauagaaagcgcacuuaaugacacauggaagauagaaaaagcuucuuuuauugaagucaaaaguugccacuggccaaaaucacacacucucuggagcaauggagugcuagaaagugagaugauaauuccaaagaauuuugcuggaccaguaucacaacauaauuacagaccaggcuaucacacacaaacggcaggacccuggcaucuaggcaagcuugagauggacuuugauuuuugcgaaggaaccacagugguggugacugaggacuguggaaauagaggacccucucuaagaacaacuaccgccucuggaaaacucauaacagaauggugcugccgauccugcacauuaccaccacuaagauacaaaggugaggauggaugcugguacggaauggaaaucagaccauugaaagagaaagaagagaacuuggucaacuccuuggucacagccggacauggacagauugacaacuucucacuaggggucuugggaauggcacuguuccuggaagaaaugcucaggacccgaguaggaacaaagcaugcaguauuacuaguugcaguuucuuucaugacacugaucacagggaacaugucuuuccgagaccuggggagagugauggucauggugggggcugcuaugacggaugacauagguaugggcgugacuuaucuugccuuacuagcagccuucaaaguuagaccaacuuuugcagcuggacugcuuuugagaaagcugaccuccaaggaauugaugaugaccaccauaggaauuguacuccucucccagagcaccauaccagagaccauacuugaacugacugacgcguuggccuugggcaugaugauucucaagauagugaggaauauggaaaaguaucaauuagcagugacuaucauggcuaucuuaugugcuccaaaugcagugauauuacaaaaugcauggaaagugagcugcacaauacuggcagugguguccguauccccacugcucuuaacaucuucacagcagaaagcggauuggauaccauuggcauugacgaucaaaggucucaauccaacagccauuuuccuaacaacccuuucaagaaccaacaagaaaaggaguuggccacuaaaugaggcuaucauggcaguagggauggugagcauuuuagccaguucucucuugaagaaugacauucccaugacaggaccauuaguggcuggagggcuucucacuguguguuacgugcucacuggaagaucggccgacuuggaacuggagagagccgccgacguaagaugggaagaucaggcagagauaucaggaagcaguccaauucugucaauaacaauaucggaagauggcagcaugucgauaaaaaaugaagaggaagaacaaacacugaccauacucauuagaacaggauugcuggugauaucaggacuuuuucccguaucaauaccaauuacggcagcagcaugguaccugugggaagugaagaaacaacgggcuggaguauugugggauguuccuucacccccaccugugggaaaggccgaacuggaagauggagcuuauagaaucaagcagaaagggauucuuggauacucccagaucggagcuggaguuuacaaagaaggaacauuccacacaauguggcacgucacacguggugcuguucuaaugcauaaagggaagagaauugaaccaucaugggcggaugucaggaaagaccuaauaucguauggaggaggcuggaagcuagaaggagaauggaaggaaggagaagaaguccaggucuuggcauuagagccuggaaagaauccaagagccguccaaacaaaacccggucuuuucaaaacuaacaccggaaccauaggugcugugucucuagacuuuucuccuggaacgucaggauccccaauugucgacaaaaaaggaaaggucgugggucucuauggcaauggugucgucacaaggaguggaacauaugugagugccauagcccagacugaaaaaagcauugaagacaauccagagauugaagaugauaucuuucggaaaaaaagauuaaccaucauggaccuccacccaggagcgggaaagacgaaaagauaccuuccagcaauagucagagaggccauaaaacgaggcuuaagaacauuaauccuggcccccaccagagucguggcagccgaaauggaagaagcucuuagaggacuuccaauaagauaccaaaccccagccauuagagcugagcacacugggcgagaaaucguggauuuaaugugucaugccacauuuaccaugaggcuguuaucaccaguuagagugccaaauuacaacuugaucauuauggaugaagcccauuucacagacccagcaagcauagcagccagaggauacauuucaacucgaguggagaugggugaagcagcugggauuuucaugacggccacuccuccgggaagcagagacccauuuccucaaagcaaugcaccaaucauggaugaagaaagggaaaucccugaacguucguggaacucuggacaugaguggguuacagauuuuaaagggaagacuguuugguuuguuccgaguauaaaagcaggaaaugauauagcagcuugccugagaaaaaauggaaagaaagugauacaacucaguaggaagaccuuugauucugaauacaucaagaccaggaccaaugauugggauuuuguggucacgacugacauuucagaaaugggugcuaacuucaaggcugaaaggguuauagaccccaggcgcugcaugaagccagucauauugacagacggugaagagcgggugauccuggcaggacccaugccagugacucacucuagugcagcacaaagaagagggagaauaggaagaaauccaaaaaaugaaaaugaccaguacauauacaugggggaaccucuggaaaaugaugaagacugcgcacacuggaaagaagccaagaugcuuuuagacaacaucaacacgccugaaggaaucauucccagcauguucgaaccagagcgugaaaaaguggaugccauugauggugaauaccgcuuaagaggagaagcaaggaaaaccuuuguggagcuaaugagaagaggagaccuaccagucuggcuggccuacagaguggcagccgaaggcauuaacuaugcagacagaaggugguguuuugauggaaucaagaacaaccaaaucuuggaagaaaauguggaaguggaaaucuggacaaaagaaggagaaaagaagaaacugaaacccagaugguuggaugcuaggaucuacucugacccacuggcgcucaaagaauucaaagaguuugcagcuggaagaaaaucccugaccaugaauuuaaucacagaaauggguaggcucccaacuuuuaugacucagaaagcaaggaacgcauuggacaacuuagcaguccugcauacagcugaagcaggcggaagggcguacaaucaugcucucagugaacugccagagacccuggagacauugcuuuugcugacacucuuggcuacagucacgggcggaaucuuuuuauuuuugaugaguggaaaaggcauagggaaaaugacccugggaauguguugcauaauuacggccagcauucuccuaugguacgcacaaauacagccacacuggauagcagcuucaauaauacuggaguuuuuucucauagucuugcucauuccagagccagaaaagcaaagaacaccccaagacaaccaauugacuuacguugucauagccauccucacagugguggccgcaaccauggcaaacgagaugggguuccuggaaaaaacgaagaaagauuucggauugggaagcauuguagcccagcaacccgagagcaacauucuggacauagaucuacguccugcaucagcauggacccuguaugcaguggccacaacauuuaucacaccaauguugagacauagcauugaaaauuccucagugaaugugucucuaacagccauugccaaucaagccacagugcuaaugggucuugggaagggauggccauugucaaaaauggacauuggaguuccccuucucgccaucgggugcuauucacaagucaaccccauaacccuuacagcagcccuucuuuuauugguagcacacuaugcaaucauagggccaggacuccaagcaaaagcaaccagagaagcgcagaaaagagcagcagcaggcaucaugaaaaucccaacuguggauggaauaacagugauugaccuagauccaauacccuaugauccaaaauuugagaagcagcugggacaaguaaugcuccuaguccucugcgugacucaaguauugaugaugaggacuacaugggcuuugugugaggcucuaaccuuagcgaccgggcccaucuccacauugugggaaggaaauccagggagauuuuggaacacaaccauugcagugucaauggcuaacauuuuuagaggaaguuaccuagcuggagccggacuucucuuuuccaucaugaagaacacaaccaacacaagaaggggaacuggcaacacaggagagacgcuuggggaaaaauggaaaaaccgauugaauucauuggggaagagugaauuccagauuuacaagagaagcggaauccaggaaguggauagaaccuuggcaaaagaaggcauuaaaagaggagaaacggaccaucacgcugugucgcgaggcucagcaaagcugagaugguucgucgagagaaaccugguuacaccagaggggaaaguaauggaccucgguugcgguagagggggcuggucauacuauugugggggucuaaagaauguaagagaagucaaaggccuaacaaaaggaggaccaggacacgaagaacccauucccaugucaacauauggguggaaucuugugcgucuccaaaguggaguugauguuuucuuuacucccccagaaaagugcgacacauuguugugugauauaggggagucgucaccaaaucccacgguugaagcaggacgaacacuuagaguccuaaacuugguagagaauuggcugaacaacaacacccaauuuugcauaaagguucuaaacccauacaugcccucagucaucgaaaaaauggaaacgcugcaaaggaaauacggaggagcuuuggugaggaauccacucucaagaaauuccacacaugagauguauuggguauccaaugcuuccgggaacauagugucaucagugaacaugauuucaaggauguugaucaauagauucacaaugagacauaagaaggccacauacgagccagauguugaccucggaagcggaacccgcaacaucggaauugaaagugaaacaccaaaccuagacauaauugggaaaagaauagaaaaaauaaaacaagagcaugagacaucauggcacuaugaccaagaccacccauauaaaacgugggccuaccauggcagcuacgaaacaaaacagacuggaucagcaucauccauggugaauggaguaguuagacugcugacaaaaccuugggacgucaucccuauggugacacagauggcaaugacagacacgaccccauuuggacaacagcguguuuucaaagagaaaguggacacgagaacccaagaaccgaaagaaggcacgaagaaacuaaugaaaaucacggccgaauggcucuggaaagaacuaggaaagaaaaagacaccuagaaugugcaccagagaagaauucacaagaaaggugagaagcaaugcagcccuaggugccauauucacugaugagaacaaguggaagucggcacgugaggcuguugaagacaguagauuuugggaacugguugacaaggaaaggaaucuccaucuugaaggaaagugugagacauguguguacaacaugaugggaaagagagagaagaagauaggagaauucggcagagcaaaaggcagcagagccauaugguacauguggcuuggagcacgcuucuuagaguuugaagcccugggauuccugaaugaagaucacugguuuuccagagagaacucucugagcggaguggaaggagaagggcugcacaagcuggguuacauucuaagagaagugagcaagaaagaaggaggagcaauguacgccgacgacacagcaggaugggacacaagaaucacacuagaggacuuaaaaaaugaagaaauggugacaaaccauauggaaggagaacacaagaaacuugccgaggccauuuucaaguuaacguaccaaaacaagguggugcgugugcaaagacccacaccaagaggcacaguaauggauauuauaucgagaagagaccaaagagguaguggacaaguuggcaccuauggccucaacaccuuuaccaauaugggagcccaacuaaucagacagauggagggagaaggagucuuuaaaagcauccagcaucugacaaccacagaagaaguagcagugcaagacugguuagcaagaguggggcgugagagguuaucgagaauggccaucaguggagaugauuguguugugaaacccuuagaugacagguuugcaagcgcuuuaacagcucuaaacgacaugggaaagguuaggaaagacauacaacaaugggaaccuucaaaaggauggaacgacuggacacaagugccuuucuguucacaccauuuccaugaguuaaucaugaaagacggucgugugcucguaguuccauguagaaaccaagaugaacugauugguagagcucgaauuucccagggagccggguggucuuugcgggagacggccugucuggggaagucuuacgcccaaauguggagccugauguacuuccacagacgugaccucaggcuggcggcuaacgcuauuugcucggcagucccaucacauuggguuccaacaagucgaacaaccugguccauacacgccagacaugaauggaugacaacagaagacaugcugacagucuggaacaggguguggauucaagaaaacccauggauggaagacaaaacuccaguggaaucaugggaggaaaucccauacuuggggaaaagagaagaccaauggugcggcucauugauaggguuaacaagcagagccaccugggcaaagaacauccaaacagcaauaaaccaaguuagauccuuaauaggcagugaggaauacacagacuauaugccauccaugaaaagauucagaagagaagaggaagaggcaggggucuugugguag

SEQ ID NO: 6422 - RNA, 9876 nt, Artificial Sequence
  derived and/or modified CDS sequence (wt) from DENV-2__KX380829__SS-prME
acugcaggcgugaucaucaugcuaauuccaacagcgauggcguuccauuuaaccacacgcaacggagaaccacacaugaucgucagcagacaagagaaagggaaaagucucuuguucaaaacagaggauggugugaacauguguacccucauggccauggaccuuggugaacugugugaagacacaaucacuuauaacuguccucuucucaggcagaaugaaccagaagauauagauuguugguguaacuccacguccacauggguaacuuaugggacaugcacugccacaggagaacacagaagggaaaaaagaucaguggcacucgucccacaugugggaaugggauuggagacacgaacugaaacauggaugucaucagaaggggccuggaaacacgcccagagaauugaaaccuggaucuugagacauccagguuuuaccauaauggcagcaaucuuggcauacaccauaggaacgacauacuuccaaagaguccuaaucuucaucuuacugacagccgucgccccuucaaugacaaugcguuguauuggaauaucaaauagagacuuuguggaagggguuucaggaggaagcuggguugacauaguccuagaacauggaagcugcgugacaacgauggcaaaaaacaaaccaacauuggacuuugaacugauaaaaacagaagccaagcaaccugccacucuaaggaaguacuguauagaagcaaagcugaccaacacaacaacagcaucucgaugcccaacacaaggagaacccagccuaaaugaagaacaggacaaaagguuugucugcaaacauuccaugguagacagaggauggggaaauggauguggauuauuuggaaagggaggcaucgugaccugugcuauguucacaugcaaaaaaaacauggaaggaaaaauugugcaaccagaaaaccuggaauacaccauugugguaacaccucauucaggggaagagaaugcaguuggaaaugacacaggaaaacauggcaaggaaaucaaaguaacaccacagaguuccauuacagaagcagaacugacaggcuacggcacugucacgauggagugcucuccaagaacgggccucgacuucaaugaaaugguguugcugcaaauggaaaauaaggcuuggcuggugcacaggcaaugguucuuagaccugccguuaccaugguugcccggagcggacacacaaggaucaaauuggauacagaaggagauguuggucaccuucaaaaacccccaugcgaagaaacaggauguuguuguuuuaggaucccaagaaggggcuaugcauacagcacuuacaggggccacggaaauccagaugucgucaggaaaccuacuguucacaggacaucuuaagugcaggcugagaauggauaaauuacagcucaaaggaaugucauacucuauguguacaggaaaguuuaaaguuguaaaagaaauagcagaaacacaacauggaacaauaguugucagaguacaauaugaaggggauggcucuccauguaagaucccuuuugagauaauggauuuggaaaaaagacaugucuuaggucgccugauuacagucaacccaaucguaacagaaaaagacaguccagucaacauagaagcagaaccuccauuuggagacagcuacaucauuauaggaguagaaccgggacaacugaagcucagcugguuuaagaaaggaagcucaaucggccaaauguucgagacaacaaugagaggagcgaagagaauggccauuuuaggugacacagccugggauuuuggaucccugggaggaguauucacaucuauaggaaaggcccuccaccaaguuuuuggagcaaucuauggggcugccuucaguggggucucauggacuaugaaaauccucauaggaguugucaucacauggauaggaaugaauucacguagcaccucacugucugugucacuaguauuagugggagucgugacauuguauuugggaguuauggugcaggcugauagugguuguguugugaguuggaaaaacaaagaacugaaauguggcagugggauuuuuaucacagacaauguacacacauggacagaacaauacaaauuccaaccagaaucccccucaaagcuggcuucagcuauccagaaagcucaugaagagggcauuuguggaauccgcucaguaacaagacuagagaaucuaauguggaaacaaauaacacccgaauugaaucacauucuaucagaaaaugagguaaaguugaccaucaugacaggagacaucaaagguaucaugcaggcaggaaaacgaucccugcggccucagcccacugagcugaaguauucauggaaaacguggggcaaagcgaaaaugcucuccacagagccucauaaccagaccuuucucauugauggccccgaaacagcagaaugucccaacacaaacagagcuuggaacucacuagaaguugaagacuauggcuuugggguguucaccaccaacauauggcugaaguugaaagaaaggcaggauguguuuugcgacucaaagcucaugucagcggccauaaaagacaacagagccguccaugccgauauggguuauuggauagaaagcgcacuuaaugacacauggaagauagaaaaagcuucuuuuauugaagucaaaaguugccacuggccaaaaucacacacucucuggagcaauggagugcuagaaagugagaugauaauuccaaagaauuuugcuggaccaguaucacaacauaauuacagaccaggcuaucacacacaaacggcaggacccuggcaucuaggcaagcuugagauggacuuugauuuuugcgaaggaaccacagugguggugacugaggacuguggaaauagaggacccucucuaagaacaacuaccgccucuggaaaacucauaacagaauggugcugccgauccugcacauuaccaccacuaagauacaaaggugaggauggaugcugguacggaauggaaaucagaccauugaaagagaaagaagagaacuuggucaacuccuuggucacagccggacauggacagauugacaacuucucacuaggggucuugggaauggcacuguuccuggaagaaaugcucaggacccgaguaggaacaaagcaugcaguauuacuaguugcaguuucuuucaugacacugaucacagggaacaugucuuuccgagaccuggggagagugauggucauggugggggcugcuaugacggaugacauagguaugggcgugacuuaucuugccuuacuagcagccuucaaaguuagaccaacuuuugcagcuggacugcuuuugagaaagcugaccuccaaggaauugaugaugaccaccauaggaauuguacuccucucccagagcaccauaccagagaccauacuugaacugacugacgcguuggccuugggcaugaugauucucaagauagugaggaauauggaaaaguaucaauuagcagugacuaucauggcuaucuuaugugcuccaaaugcagugauauuacaaaaugcauggaaagugagcugcacaauacuggcagugguguccguauccccacugcucuuaacaucuucacagcagaaagcggauuggauaccauuggcauugacgaucaaaggucucaauccaacagccauuuuccuaacaacccuuucaagaaccaacaagaaaaggaguuggccacuaaaugaggcuaucauggcaguagggauggugagcauuuuagccaguucucucuugaagaaugacauucccaugacaggaccauuaguggcuggagggcuucucacuguguguuacgugcucacuggaagaucggccgacuuggaacuggagagagccgccgacguaagaugggaagaucaggcagagauaucaggaagcaguccaauucugucaauaacaauaucggaagauggcagcaugucgauaaaaaaugaagaggaagaacaaacacugaccauacucauuagaacaggauugcuggugauaucaggacuuuuucccguaucaauaccaauuacggcagcagcaugguaccugugggaagugaagaaacaacgggcuggaguauugugggauguuccuucacccccaccugugggaaaggccgaacuggaagauggagcuuauagaaucaagcagaaagggauucuuggauacucccagaucggagcuggaguuuacaaagaaggaacauuccacacaauguggcacgucacacguggugcuguucuaaugcauaaagggaagagaauugaaccaucaugggcggaugucaggaaagaccuaauaucguauggaggaggcuggaagcuagaaggagaauggaaggaaggagaagaaguccaggucuuggcauuagagccuggaaagaauccaagagccguccaaacaaaacccggucuuuucaaaacuaacaccggaaccauaggugcugugucucuagacuuuucuccuggaacgucaggauccccaauugucgacaaaaaaggaaaggucgugggucucuauggcaauggugucgucacaaggaguggaacauaugugagugccauagcccagacugaaaaaagcauugaagacaauccagagauugaagaugauaucuuucggaaaaaaagauuaaccaucauggaccuccacccaggagcgggaaagacgaaaagauaccuuccagcaauagucagagaggccauaaaacgaggcuuaagaacauuaauccuggcccccaccagagucguggcagccgaaauggaagaagcucuuagaggacuuccaauaagauaccaaaccccagccauuagagcugagcacacugggcgagaaaucguggauuuaaugugucaugccacauuuaccaugaggcuguuaucaccaguuagagugccaaauuacaacuugaucauuauggaugaagcccauuucacagacccagcaagcauagcagccagaggauacauuucaacucgaguggagaugggugaagcagcugggauuuucaugacggccacuccuccgggaagcagagacccauuuccucaaagcaaugcaccaaucauggaugaagaaagggaaaucccugaacguucguggaacucuggacaugaguggguuacagauuuuaaagggaagacuguuugguuuguuccgaguauaaaagcaggaaaugauauagcagcuugccugagaaaaaauggaaagaaagugauacaacucaguaggaagaccuuugauucugaauacaucaagaccaggaccaaugauugggauuuuguggucacgacugacauuucagaaaugggugcuaacuucaaggcugaaaggguuauagaccccaggcgcugcaugaagccagucauauugacagacggugaagagcgggugauccuggcaggacccaugccagugacucacucuagugcagcacaaagaagagggagaauaggaagaaauccaaaaaaugaaaaugaccaguacauauacaugggggaaccucuggaaaaugaugaagacugcgcacacuggaaagaagccaagaugcuuuuagacaacaucaacacgccugaaggaaucauucccagcauguucgaaccagagcgugaaaaaguggaugccauugauggugaauaccgcuuaagaggagaagcaaggaaaaccuuuguggagcuaaugagaagaggagaccuaccagucuggcuggccuacagaguggcagccgaaggcauuaacuaugcagacagaaggugguguuuugauggaaucaagaacaaccaaaucuuggaagaaaauguggaaguggaaaucuggacaaaagaaggagaaaagaagaaacugaaacccagaugguuggaugcuaggaucuacucugacccacuggcgcucaaagaauucaaagaguuugcagcuggaagaaaaucccugaccaugaauuuaaucacagaaauggguaggcucccaacuuuuaugacucagaaagcaaggaacgcauuggacaacuuagcaguccugcauacagcugaagcaggcggaagggcguacaaucaugcucucagugaacugccagagacccuggagacauugcuuuugcugacacucuuggcuacagucacgggcggaaucuuuuuauuuuugaugaguggaaaaggcauagggaaaaugacccugggaauguguugcauaauuacggccagcauucuccuaugguacgcacaaauacagccacacuggauagcagcuucaauaauacuggaguuuuuucucauagucuugcucauuccagagccagaaaagcaaagaacaccccaagacaaccaauugacuuacguugucauagccauccucacagugguggccgcaaccauggcaaacgagaugggguuccuggaaaaaacgaagaaagauuucggauugggaagcauuguagcccagcaacccgagagcaacauucuggacauagaucuacguccugcaucagcauggacccuguaugcaguggccacaacauuuaucacaccaauguugagacauagcauugaaaauuccucagugaaugugucucuaacagccauugccaaucaagccacagugcuaaugggucuugggaagggauggccauugucaaaaauggacauuggaguuccccuucucgccaucgggugcuauucacaagucaaccccauaacccuuacagcagcccuucuuuuauugguagcacacuaugcaaucauagggccaggacuccaagcaaaagcaaccagagaagcgcagaaaagagcagcagcgggcaucaugaaaaacccaacuguggauggaaugacagugauugaccuagauccaauacccuaugauccaaaguuugaaaagcaguugggacaaguaaugcucuuaguccucugcgugacucaaguauugaugaugaggacuacaugggcuuugugugaggcucuaaccuuagcgaccgggcccaucuccacauugugggaaggaaauccagggagauuuuggaacacaaccauugcagugucaauggcuaacauuuuuagaggaaguuaccuagcuggagccggacuucucuuuuccaucaugaagaacacaaccaacacaagaaggggaacuggcaacacaggagagacgcuuggggaaaaauggaaaaaccgauugaauucauuggggaagagugaauuccagauuuacaagagaagcggaauccaggaaguggauagaaccuuggcaaaagaaggcauuaaaagaggagaaacggaccaucacgcugugucgcgaggcucagcaaagcugagaugguucgucgagagaaaccugguuacaccagaggggaaaguaauggaccucgguugcgguagagggggcuggucauacuauugugggggucuaaagaauguaagagaagucaaaggccuaacaaaaggaggaccaggacacgaagaacccauucccaugucaacauauggguggaaucuugugcgucuccaaaguggaguugauguuuucuuuacucccccagaaaagugcgacacauuguugugugauauaggggagucgucaccaaaucccacgguugaagcaggacgaacacuuagaguccuaaacuugguagagaauuggcugaacaacaacacccaauuuugcauaaagguucuaaacccauacaugcccucagucaucgaaaaaauggaaacgcugcaaaggaaauacggaggagcuuuggugaggaauccacucucaagaaauuccacacaugagauguauuggguauccaaugcuuccgggaacauagugucaucagugaacaugauuucaaggauguugaucaauagauucacaaugagacauaagaaggccacauacgagccagauguugaccucggaagcggaacccgcaacaucggaauugaaagugaaacaccaaaccuagacauaauugggaaaagaauagaaaaaauaaaacaagagcaugagacaucauggcacuaugaccaagaccacccauauaaaacgugggccuaccauggcagcuacgaaacaaaacagacuggaucagcaucauccauggugaauggaguaguuagacugcugacaaaaccuugggacgucaucccuauggugacacagauggcaaugacagacacgaccccauuuggacaacagcguguuuucaaagagaaaguggacacgagaacccaagaaccgaaagaaggcacgaagaaacuaaugaaaaucacggccgaauggcucuggaaagaacuaggaaagaaaaagacaccuagaaugugcaccagagaagaauucacaagaaaggugagaagcaaugcagcccuaggugccauauucacugaugagaacaaguggaagucggcacgugaggcuguugaagacaguagauuuugggaacugguugacaaggaaaggaaucuccaucuugaaggaaagugugagacauguguguacaacaugaugggaaagagagagaagaagauaggagaauucggcagagcaaaaggcagcagagccauaugguacauguggcuuggagcacgcuucuuagaguuugaagcccugggauuccugaaugaagaucacugguuuuccagagagaacucucugagcggaguggaaggagaagggcugcacaagcuggguuacauucuaagagaagugagcaagaaagaaggaggagcaauguacgccgacgacacagcaggaugggacacaagaaucacacuagaggacuuaaaaaaugaagaaauggugacaaaccauauggaaggagaacacaagaaacuugccgaggccauuuucaaguuaacguaccaaaacaagguggugcgugugcaaagacccacaccaagaggcacaguaauggauauuauaucgagaagagaccaaagagguaguggacaaguuggcaccuauggccucaacaccuuuaccaauaugggagcccaacuaaucagacagauggagggagaaggagucuuuaaaagcauccagcaucugacaaccacagaagaaguagcagugcaagacugguuagcaagaguggggcgugagagguuaucgagaauggccaucaguggagaugauuguguugugaaacccuuagaugacagguuugcaagcgcuuuaacagcucuaaacgacaugggaaagguuaggaaagacauacaacaaugggaaccuucaaaaggauggaacgauuggacacaagugccuuucuguucacaccauuuccaugaguuaaucaugaaagacggucgugugcucguaguuccauguagaaaccaagaugaacugauugguagagcucgaauuucccagggagccggguggucuuugcgggagacggccugucuggggaagucuuacgcccaaauguggagccugauguacuuccacagacgugaccucaggcuggcggcuaacgcuauuugcucggcagucccaucacauuggguuccaacaagucgaacaaccugguccauacacgccagacaugaauggaugacaacagaagacaugcugacagucuggaacaggguguggauucaagaaaacccauggauggaagacaaaacuccaguggaaucaugggaggaaaucccauacuuggggaaaagagaagaccaauggugcggcucauugauaggguuaacaagcagagccaccugggcaaagaacauccaaacagcaauaaaccaaguuagauccuuaauaggcagugaggaauacacagacuauaugccauccaugaaaagauucagaagagaagaggaagaggcaggggucuugugguag

SEQ ID NO: 6423 - RNA, 9876 nt, Artificial Sequence
  derived and/or modified CDS sequence (wt) from DENV-2__KX380830__SS-prME
acugcagguauaauuauuaugaugauuccaacagugauggcguuccauuuaaccacacgcaauggagaaccacacaugaucgucaguagacaagaaaaagggaaaagucuucuguuuaaaacagagaacggugugaacauguguacccucauggccauggaccuuggugaacugugugaagacacaaucacuuauaauuguccucuucucaggcagaaugaaccagaagacauagacuguuggugcaacucuacgucuacauggguaacuuaugggacaugcaccgcuacaggagaacacagaagggaaaaaagaucaguggcacucguuccgcacgugggaaugggacuggagacacgaacugaaacauggaugucaucagaaggggccuggaaacaugcgcagagaauugaaacuugggucuugagacauccaggcuucacuguaauggcagcaauccuggcauacaccauaggaacgacauauuuccaaagaguccugauuuucaucuuacugacagcugucgcuccuucaaugacaaugcguuguauaggaauaucaaauagagacuuuguggaagggguuucaggaggaagcuggguugacauagucuuggaacauggaagcugugugacaacgauggcgaaaaauaaaccaacauuggauuuugaacugauaaaaacagaagccaaacaucccgccacucuaaggaaguauuguauagaggcaaagcugaccaacacaacaacagcaucucgcugcccaacacaaggagaaccuagccuaaaugaagaacaggacaaaagauuugucugcaaacacuccaugguagacagaggauggggaaauggaugcggauuauuuggaaagggagguaucgugaccugugcaauguucacaugcaaaaagaacauggaaggaaaaaucgugcaaccagaaaauuuggaauacaccauugugauaacaccucacucaggggaagagaaugcagucggaaaugauacaggaaaacacggcaaggaaauuaaagugacaccacagagcuccaucacagaagcagaacuaaccggcuauggcacugccacgauggaaugcucuccgagaacgggccucgacuucaaugagaugguguugcugcaaauggaaaacaaggcuuggcuagugcacaggcaaugguucuuagaccugccguuaccauggcugcccggagcagacacacaaggaucaaauuggauacagaaggagacauuggucacuuucaaaaauccccaugcaaagaaacaggauguuguuguguuaggaucccaagaaggggcuaugcacacagcacucacaggggccacggaaauccagaugucaucaggaaacuuacuguucacaggacaucuuaaaugcaggcugagaauggacaaacuacagcucaaaggaaugucauauuccauguguacaggaaaguucaaaguugugaaggaaauagcagaaacacaacauggaacaauaguuaucagaguacaauaugaaggagacgguucuccgugcaaaaucccuuuugaaauaauggauuuggaaaaaagacaugucuuaggucgcuugaucacagucaacccaauugucacagaaaaagacagcccagucaacauagaagcagaaccuccauucggagacagcuacaucauuauaggaguagaaccggggcaacugaagcucagcugguuuaagaaaggaaguucuauuggccaaauguuugagacaacaaugagaggagcgaagagaauggccauuuuaggugacacagcuugggauuuuggaucucugggaggaguguuuacaucuauaggaaaggcccuccaccaagucuuuggagcaaucuauggggcugccuucagugggguuucauggacuaugaaaauccucauaggaguugucaucacauggauaggaaugaauucacgcagcaccucacugucugugucacuaguauuagugggaaucgugacacuguauuugggaguuauggugcaggcugauaguggcugcguagugagcuggaaaaacaaagaacugaaauguggcagugggaucuuuaucacagacaacgugcacacauggacagaacaauacaaauuccaaccagaauccccuucaaaacuggcuucagcuauccagaaggcccaugaagagggcauuuguggaauccgcucaguaacaagacuggagaaucugauguggaaacaaauaacaccagaacugaaucacauucuaucagaaaaugagguaaaguugacuaucaugacaggagacauuaaaggaaucaugcaggcaggaaaacgaucccugcgaccucaacccacugagcugaaguacucuuggaaagcauggggcaaagcgaaaaugcucuccacagagcuccacaaccacaccuuucucauugauggccccgaaacagcagaaugucccaacacaaacagagcuuggaacucacuagaaguugaagacuauggcuuuggaguauucacuaccaacauauggcugaaauugaaagaaaggcaggauguauuuugugacucaaaacucaugucagcagccauaaaagacaacagagccguccacgccgauauggguuauuggauagaaagcgcacucaacgacacauggaagauugagaaagccucuuuuauugaaguuaaaagcugccacuggccaaagucacacacucucuggagcaauggagugcuagaaagugagaugauaauuccaaagaauuuugcaggaccagugucacaacacaauuacagaccaggcuaucauacacaaacggcaggacccuggcaucuaggcaggcuugagauggacuuugacuucugcgaaggaaccacagugguggugacugaggacuguggaaauagaggacccucuuuaagaacaacuacugcuucuggaaaacucauaacagaauggugcugccgaucuugcacauuaccaccgcuaagguacagaggugaggauggaugcugguauggaauggaaaucagaccauugaaagagaaagaagagaacuuggucaacucuuuggucacagccggacauggacagauugacaacuucucacuaggagucuugggaauggcauuguuccuggaagagaugcucaggacucgaguaggaacgaaacaugcaauauuauuaguugcagucucuuucgugacauugaucacagggaacauguccuuucgagauuuggggagagugauggucauggugggcgcuacuaugacggaugacauaggcaugggcgugacuuaucuugcccuauuagcagccuucaaagucagaccaacuuuugcagcuggacuacucuuaagaaagcugaccuccaaggaauugaugaugaccaccauaggaauuguacuccucucucagagcaccauaccagagacuauacuugaacugacugacgcguuggcuuuggggaugaugguucucaaaauaguaagaaacauggaaaaguaucaacuagcagugacuaucauggcuauccugugcgucccaaaugcagugauauuacaaaacgcauggaaagugagcugcacgauacuggcagugguguccguuuccccacugcuuuuaacauccucacagcagaaagcggauuggauaccacuggcguugacaaucaaaggccucaauccaacagccauuuucuuaacaacccucucaagaacuagcaagaaaaggagcuggccacuaaaugaggcuauuauggcagucgggauggugagcauuuuagccaguucucucuuaaagaaugauauucccaugacaggaccauuaguggcuggagggcuucucacuguguguuacgugcucacuggaagaucggcugauuuggaacuggaaagagcugcugacguaagaugggaggaacaggcagagauaucagggagcaguccaauucugucgauaacaauaucggaagaugguaguaugucgauaaaaaaugaagaagaagaacaaacacugaccauacuuauuagaacaggacugcuggugauaucaggacuuuuucccgugucaauaccaaucacggcagcugcaugguaccugugggaagugaaaaaacaacgagccggaguauugugggacgucccuucaccuccaccugugggaaaagccgaacuggaagauggagccuauagaaucaagcagaaagggauuuuaggauacucgcagauuggagccggaguuuacaaagaaggaacauuccacacaauguggcaugucacacguggugcuguucuaaugcacaaagggaagaggauugaaccaucaugggcggacgucaagaaagacuuaauaucguauggaggaggcuggaagcuagaaggagaauggaaggaaggagaagaaguccagguccuggcacuagagccuggaaagaauccaagagccguccaaacaaaacccggucuuuuuaaaacuaacacuggaaccauaggcgccguaucucuggacuuuucuccuggaacgucaggaucuccaauugucgacaaaaaaggaaaaguugugggccuuuauggcaacggugucgucacaaggagugggacauaugugagcgccauagcccagacugaaaaaagcaucgaagacaauccagagauugaagaugacaucuuucgaaagaaaagauugaccaucauggaccuccacccaggagcaggaaaaacaaagagauaucuuccagcaauagucagagaagccauaaaacgaggcuugagaacacuaauccuggcccccacuagaguuguggcggcugaaauggaagaagcucucagaggacuuccaauaagauaccaaaccccagcuaucagagcugagcacacuggacgggagauuguggaucuaaugugucacgccacauucaccaugaggcuacuaucaccaaucagagugccaaauuacaaccugauuaucauggaugaagcccauuuuacagacccagcaagcauagcagcuagaggauacauuucaacucgaguagagaugggugaagcagcugggauuuucaugacagccaccccuccuggaagcagagacccauuuccucagagcaacgcaccaaucauggaugaagaaagggaaaucccugagcguucguggaacucuggacaugaguggguuacggauuuuaaagggaagacuguuugguuuguuccaaguauaaaagcaggaaaugauauagcagcuugccugagaaagaauggaaagaaagugauacaacucagcaggaagaccuuugauucugaauauaucaagacuaggaccaaugauugggacuuuguggucacgacagacauuucagaaaugggugccaacuucaaggcugagaggguuauagaccccagacgcugcaugaaaccagucauacuaacagacggugaagagcgggugaucuuggcaggacccaugccagugacccacucuagugcagcacaaagaagagggagaguaggaagaaauccaaaaaaugaaaaugaccaguacauauacaugggggaaccucuggaaaaugaugaagacugugcgcacuggaaagaagcuaagaugcuucuagauaacaucaacacgccugaaggaaucauucccagcauguucgaaccagagcgugaaaagguggaugccauugauggugaauaccgcuugagaggagaagcgaggaaaacauuuguggaccuaaugagaagaggagaccuaccagucuggcuagccuacagaguggcagcugaagguaucaacuacgcagacagaagauggugcuuugauggagucaagaacaaccaaauccuggaagaaaauguggaaguggaaauuuggacaaaagaaggagaaaggaagaaauuaaaacccagaugguuagaugccaggaucuacucugacccacuggcgcucaaagaauucaaggaauucgcagcuggaagaaaaucacugaccuugaaucuaaucaccgagauggguaggcucccaaccuucaugacccagaaagcaagaaaugcauuggacaacuuagcaguccugcauacggcugaagcaggcggaagggcguacaaucaugcucuuagugaacugccggagacucuggagacauugcuuuuacugacacucuuggccacagucacggguggaaucuuccuguucuugaugagcggaaaggguauagggaaaaugacccugggaaugugcugcauaaucacggccaguauucuccuaugguaugcucaaauacagccacacuggauagcagcuucaauaauacuggaguuuuuucucauagucuugcucauuccagaaccagagaagcagagaacaccccaagauaaccaauuaacuuauguugucauagccauccuuacagugguggccgcaaccauggcaaacgagauggguuuccuggaaaagacaaagaaagauuucggauugggaagcauuacaacccagcaaccugacagcaacauccuggacauagaucuacguccugcaucagcuuggacucuauaugccguggcaacaacuuucaucacaccaauguugagacacagcauugaaaauuccucagugaaugugucucuaacagccauugcuaaccaggccacaguguuaaugggucuugggaaaggauggccauugucaaaaauggacaucggaguuccccuucucgcuaucggaugcuacucacaagucaaccccauaacucucacagcagcccuucucuuauugguagcacacuaugcuaucauagggccaggacuccaagcgaaagcaacuagagaggcucagaaaagagcagcagcggguaucaugaaaaucccagcugccgauggaaugacagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcgaccgggcccaucucuacacugugggaaggaaauccagggagauuuuggaauacaacuauugcagugucaauggcuaacauuuuuagagggaguuaccuagccggagccggacuucucuuuucuaucaugaagaacacggccaacacaagaaggggaacuggcaacacaggagagacgcuuggagagaaauggaaaaaccgguuaaaugcauuggggaagagugaauuccagaucuauaagaaaaguggaauccaggaaguggauagaaccuuagcaaaagaaggcaucaaaaggggagaaacggaccaucacgcugugucgcgaggcucggcgaaacugagaugguucgucgagagaaaccuggucacaccagaagggaaaguaguggaccuuggcugcggcagggggggcuggucauacuauugugggggacuaaagaauguaaaagaagucaaaggccuaacaaaaggaggaccaggacaugaagagcccauucccaugucaacauaugguuggaaucuggugcgucuucaaaguggaguugaugucuuuuuuacuccgccagagaagugugacacauugcugugugacauaggggagucgucaccaaaccccacgguugaggcaggacgaacacucagaguucuaaacuuaguggaaaacuggcugaacaacaacacccaauuuugcauaaagguucucaacccauauaugccuucaguuauagaaaaaauggaagcgcuacaaaggaaauacggaggagcuuuggugaggaauccacucucacgaaauuccacacacgagauguacuggguauccaaugcuuccgggaacauagugucaucagugaacaugauuucaagaauguugauuaacagauucacaaugaaacauaagaaggccacauacgagccagauguugaucucggaagugggacccgcaacaucggaauugaaagugagacaccaaauuuagacauaauugggaaaagaauagaaaaaauaaaacaagagcaugaaacaucauggcacuaugaccaggaccacccauacaaaacgugggccuaccauggcagcuacgaaacaaaacagacuggaucagcaucauccauggugaacggaguaguuaggcugcuaacaaaaccuugggacgucaucccuauggugacacagauggcaaugacagacacgacuccauuuggacaacagcgcguuuucaaagaaaaaguggacacgagaacccaagaaccgaaagaaggcacgaaaaaacuaaugaaaaucacggcagaauggcucuggaaagaacuaggaaagaaaaagacaccuaggaugugcaccagagaagaauucacaagaaaggugagaagcaaugcagccuuaggugccauauucacugaugagaacaaguggaagucggcacgugaggcuguugaagacaguggauuuugggaauugguugacaaggaaaggaaucuccaucuugaaggaaagugugagacauguguguauaacaugaugggaaagagagagaagaagcuaggggaguucgguaaagcaaaaggcagcagagcuauaugguacauguggcuuggagcacgcuucuuagaguucgaagcccuaggauuuuugaaugaagaccacugguuuuccagagagaacucccugaguggaguggaaggagaagggcugcacaaacuaggcuacauuuuaagagacgugaguaagaaagaaggaggagcaauguacgccgaugacaccgcaggaugggacacaagaaucacacuagaggacuuaaaaaaugaagaaauggugacaaaccacauggaaggagaacacaggaaacuugcugaagcuauuuucagauuaacguaccaaaacaagguggugcgugugcaaagaccgacaccaagaggcacaguaauggacauuauaucgagaagagaccaaagagguaguggacaaguugucacuuacggccucaauacuuucaccaacauggaagcccaacugaucagacagauggagggagaaggagucuucaaaagcauccaacaccugacagucacagaagaaauugcagugaaaaacugguuagaaagaguggggcgugagagguuaucaagaauggccaucaguggagaugauuguguugugaaacccuuagaugacagguuugcaagcgcucuaacagcucuaaaugacaugggaaagguuaggaaagacauacaacaaugggaaccuucaagaggauggaacgauuggacacaagugcccuuuuguucacaccauuuccaugaguuaaucaugaaagacggucguguacuuguaguuccaugcagaaaccaagaugaacugauugguagggcccgaauuucccagggagccgggugguccuugcgggaaacagccuguuuggggaagucuuacgcccaaauguggagccugauguacuuccacaggcgugaccuuaggcuggcggcaaaugccauuugcucggcagucccaucacauuggguuccaauaagucgaacaaccugguccauacacgccacacaugaguggaugacaacagaagacaugcugacagucuggaacaggguguggauucaagaaaauccauggauggaagacaaaacuccaguagaaucaugggaggaaaucccauaucuggggaaaagagaagaccaauggugcggcucauugauugggcuaacaagcagggccaccugggcaaagaacauccaaacagcaauaaaucaaguuagaucccuaauaggcaaugaggaauacacagacuacaugccauccaugaaaagauucagaagagaagaggaagaggcaggagucuugugguaa

SEQ ID NO: 6424 - RNA, 9876 nt, Artificial Sequence
  derived and/or modified CDS sequence (wt) from DENV-2__KX380831__SS-prME
acugcagguauaauuauuaugaugaucccaacagugauggcguuccauuuaaccacacgcaacggagaaccacacaugauuguuaguagacaagagaaagggaaaagucuccuguuuaaaacagagaacggugugaacauguguacccucauggccauggaccuuggugaacugugugaagacacaaucacuuauaauuguccucuucucaggcagaaugaaccagaagacauagacuguuggugcaacuccacgucuacauggguaacuuaugggacaugcaccgccacaggagaacacagaagggaaaaaagaucaguggcacucguuccacaugugggaaugggacuggagacacgaacugaaacauggaugucaucagaaggggccuggaaacaugcccagagaauugaaacuuggaucuugagacauccaggcuucaccauaauggcagcaauccuggcauacaccauaggaacaacauauuuccaaagaguccugauuuucauuuuacugacagcugucacuccuucaauggcaaugcguugcauaggaauaucaaauagagacuuuguggaagggguuucaggaggaagcuggguugauauagucuuggaacauggaagcugugugacgacgauggcgaaaaauaaaccaacguuggauuuugaacugauaaaaacagaagccaaacaucucgccacucuaaggaaguauuguguagaggcaaagcugaccaacacaacaacagcaucucgcugcccaacacaaggagaaccuagccuaaacgaagaacaggacaaaagauucgucugcaaacacuccaugguagacagaggauggggaaauggaugcggauuauuuggaaagggaggcaucgugaccugugcaauguucacaugcaaaaagaacauggaaggaaaagucgugcaaccagaaaacuuggaguacaccaucgugauaacaccucacucaggggaagagaaugcagucggaaaugacacaggaaaacauggcaaggaaauuaaaguaacaccacagaguuccaucacagaagcagaacuaacaggcuacggcacugucacgauggaaugcucuccgagaacgggccucgacuucaaugagaugguguugcugcaaauggaaaacaaggcuuggcuggugcacaggcaaugguucuuagaccugccguuaccauggcugcccggagcagacacacaaggaucaaauuggauacagaaggagacacuggucacuuucaaaaauccccaugcaaagaaacaggauguuguuguuuuagguucccaagaaggggccaugcacacggcacucacaggggccacggaaauccagaugucaucaggaaacuuacuguucacaggacaucuuaagugcaggcugagaauggacaaacuacagcucaaaggaaugucauauuccauguguacaggaaaguucaaaguugugaaggaaauagcagaaacacaacauggaacaauaguuauuagaguacaauaugaaggggacgguuccccgugcaagaucccuuuugaaauaauggacuuggaaaaaaggcaugucuuaggucgcuugauuaccgucaacccaauugucacagaaaaagacagcccagucaacauagaagcagaaccuccauuuggagacaguuacaucauuauaggaguagaaccaggacaacugaagcucagcugguuuaagaaaggaaguucuauuggccaaauguuugagacaacaaugagaggagcgaagagaauggccauucuaggugacacagcuugggauuuuggaucccugggaggaguguucacaucuauaggaaaggcccuccaccaagucuuuggagcuaucuauggggcugccuucagugggguuucauggacuaugaaaauccucauaggagucgucaucacauggauaggaaugaauucacgcagcaccucacugucugugucacuaguauuagugggggucgugacauuguauuugggaguuauggugcaggccgauagugggugcguugucaguuggaaaaacaaagaacugaaaugugguagugggauuuuuaucacagacaacgugcacacauggacagaacaauacaaauuccaaccagaauccccuucaaagcuggcuucagcuauccagaaggcucaugaagaaggcauuuguggaauccgcucaguaacaagacuggagaaucugauguggaaacaaauaacaccagaauugaaucacauucuaacagaaaaugaaguaaaguugacuaucaugacaggagacaucaaaggaaucaugcaggcaggaaaacgaucccugcggccucaacccacugagcugaaguacuccuggaaggcauggggcaaagcgaaaaugcuuuccacagagcuucauaaccacaccuuucucauugauggccccgaaacagcagaaugucccaacacaaacagagcuuggaacucacuagaaguugaagacuauggcuuuggaguauucaccacuaacauauggcugaaauugaaagaaaggcaggauguguuuugugacucaaaccucaugucggcagccauaaaggacaauagagccguccacgccgauauggguuauuggauagaaagcgcacucaaugacacauggaagauugagaaagccucuuuuauugaaguuaaaagcugccacuggccaaagucacacacucucuggaguaauggagugcuggaaagugagaugauaauuccaaagaauuuugcaggaccaguuucacaacacaauuacagaccaggcuaccacacacaaacggcaggacccuggcaucuagguaggcuugagauggacuuugauuucugcgaaggaaccacagugguggugacugaggacuguggaaauagaggacccuccuuaagaacaacuacugcuucuggaaaacucauaacagaguggugcugccgaucuugcacauuaccaccgcuaagguacagaggugaggauggaugcugguaugguauggaaaucaggccauugaaagagaaagaagagaaccuggucaacucuuuggucacagccggacauggacagauugacaacuucucacuaggagucuugggaauggcauuguuccuggaagaaaugcucaggacucgaguaggaacgaaacaugcaauauuacuaguugcagucucuuucgugacauugaucacagggaacauguccuuucgagauuuggggagagugauggucauggugggcgcuacuaugacggaugacauaggcaugggcgugacuuaucuugcccuauuagcagccuuuaaagucagaccaaccuuugcggcuggacuacucuuaagaaagcugaccuccaaggaauugaugaugaccaccauaggaaucguacuccucucucagaguaccauaccagagagcauacuugaacugacugacgcguuggcuuuggggaugaugguucucaaaauagugagaaacauggaaaaguaucagcuagcagugacuaucauggcaaucuugugcgucccaaaugcagugauauugcaaaaugcauggaaagugagcugcacaacacuggcagugguguccguuuccccacugcuuuuaacauccucacagcagaaagcggauuggauaccacuggcguugacgaucaaaggccucaauccaacagccauuuucuuaacaacucucucaagaacuagcaagaaaaggagcuggccacuaaaugaggcuauuauggcagucgggauggugagcauucuagcuaguucucucuuaaagaaugauauucccaugacaggaccauuaguggcuggagggcuucucacuguguguuacgugcucacuggaaggucggcugacuuggaacuggaaagagcugcugacguaagaugggaagaacaggcagagauaucaggaaguaguccaauucugucgauaacaauaucggaagaugguagcaugucgauaaagaaugaagaagaagaacagacacugaccauacucaucagaacaggacuacuggugauaucaggacuuuuuccugugucaauaccaaucacggcagcugcaugguaccuuugggaagugaaaaaacaacgagcaggaguauugugggaugucccuucacccccaccugugggaaaggccgaacuggaagauggagccuauagaaucaagcagaaagggauccuaggauacucacagauuggagccggaguuuacaaagaaggaacauuccacacaauguggcaugucacacguggugcuguccuaaugcauaaagggaagagaauugaaccaucaugggcggacgucaagaaagaccuaauaucguauggaggaggcuggaagcuggaaggagaauggaaagaaggagaagaaguccagguccuggcauuagagccuggaaagaauccaagagccguccaaacaaaacccggucuuuuuaaaaccaacacuggaaccauaggcgccgugucucuggacuuuucuccuggaacgucaggaucuccaaucgucgauaaaaaaggaaaaguugugggccuuuauggcaacggugucgucacaaggaguggaacauaugugagugccauagcccagacugaaaaaagcaucgaagacaauccagagauugaagaugacaucuuuagaaagaaaagauugaccaucauggaccuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagcuaucagagcugagcacacugggcgggagauuguggaucuaaugugucaugccacauuuaccaugaggcuauuaucaccaauuagagugccaaauuacaaccugaucaucauggaugaagcccauuucacagacccagcaagcauagcagcuagaggauacauuucaacucgaguagagaugggcgaagcagcugggauuuucaugacagccaccccuccuggaagcagagacccauuuccccagagcaacgcaccaaucauggaugaagaaagagaaaucccugagcguucguggaacucuggacaugaguggguuacggauuuuaaagggaagacuguuugguuuguuccaaguauaaaagcagggaaugauauagcagcuugccugagaaagaauggaaagaaagugauacaacucagcaggaaaacuuuugauucugaauauaucaagacuaggaccaaugauugggacuuuguggucacgacagacauuucagaaaugggugcuaacuucaaggcugagaggguuauagaccccagacgcugcaugaaaccagucauauuaacagacggugaagagcgggugaucuuggcaggacccaugccagugacccauucuagugcagcacaaagaagagggagaguaggaagaaauccaaaaaaugaaaaugaccaguacauauacaugggggaaccucuggaaaaugaugaagacugugcacacuggaaagaagcuaagaugcucuuggauaacaucaacacgccugaaggaaucauucccagcauguucgaaccagagcgugaaaagguggaugccauugauggugaauaccgcuugagaggagaagcgaggaaaacuuuuguggaccuaaugagaagaggagauuuaccagucuggcuagccuacagaguggcggcugaaggcaucaacuacgcagacagaagauggugcuuugauggagucaagaacaaccaaaucuuggaagaaaauguggaaguagaaauuuggacaaaagaaggagaaaggaagaaauuaaaacccagaugguuggaugcuaggaucuacucugacccauuggcgcucaaagaauucaaggaauucgcagcuggaagaaagucccugacccugaaucuaaucacagagauggguagacucccaaccuucaugacccagaaagcaaagaaugcacucgacaacuuagcaguccugcauacggcugaagcaggcggaagggcguacaaucaugcucuuagugaacugccggagacucuggagacauugcuuuuacugacacuuuuggccacagucacgggcggaaucuuccuguucuugaugagcggaaaggguauagggaagaugacccugggaaugugcugcauaaucacggcuaguauccucuuaugguaugcacaaauacagccacacuggauagcagcuucaauaauacuggaguuuuuucucauagucuugcucauuccagaaccagaaaaacagagaacaccccaagauaaccaguuaacuuauguugucauagccauccuuacaguaguggccgcaaccauggcaaacgagauggguuuccuggaaaaaacaaagaaagauuucggauugggaagcauuacaacccagcaaccugagaguaacauccuggacauagaucuacguccugcaucagcuuggacucuauaugccguggcaacaacuuucaucacaccaauguugaggcauagcauugaaaacuccucagugaaugugucccuaacagccauugccaaccaagccacaguguuaaugggucuugggaaaggauggccauugucaaaaauggacaucggaguuccccuucucgcuaucgggugcuauucacaagucaaccccauaacucucacugcagcccuucucuuauugguagcccauuaugccaucauagggccaggacuccaagcgaaagcaacuagagaggcucagaaaagagcagcagcgggcaucaugaaaaacccaacuguggauggaaugacagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcaaccgggcccaucucuacacugugggaaggaaauccagggagauuuuggaauacaacuauugcagugucaauggcuaacauuuuuagagggagcuaccuggccggggccggacuucucuuuucuaucaugaaaaacacggccaacacaagaaggggaacuggcaacacaggagagacgcuuggggagaaauggaaaaaccgguugaaugcauuagggaagagugaauuccagaucuacaagaaaaguggaauccaggaaguggacagaaccuuagcaaaagaaggcaucaaaagaggagaaacggaccaucacgcugugucgcgaggcucagcgaaacugagaugguucgucgagagaaaccuggucacaccagaagggaaaguaguggaccuuggcugcggcagggggggcuggucauacuauugugggggacuaaagaauguaaaagaagucaaaggccuaacaaaaggaggaccaggacacgaagaacccauucccaugucaacauaugguuggaaucuggugcgccuucaaaguggaguugauguuuuuuuuacuccgccagaaaagugugacacacugcugugugacauaggggagucgucaccaaaccccacgguugaggcaggacgaacacucagaguucuaaacuuaguggaaaauuggcugaacaacaacacccaauuuugcauaaagguucuuaacccauacaugcccucaguuauagaaaaaauggaagcacuacaaaggaaauacggaggagcuuuggugaggaauccacucucacgaaauuccacacacgagauguacuggguauccaaugcuuccgggaauauagugucaucagugaacacgauuucaagaauguugauuaacagauucacaaugagacacaagaaagccacauacgagccagauguugaccucggaaguggaacccgcaacaucggaauugaaagugagacaccaaauuuagacauaauugggaaaagaauagaaaaaauaaaacaagagcaugaaacaucauggcacuaugaccaagaccacccauacaaaacgugggccuaccauggcagcuacgaaacaaaacagacuggaucagcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccgaaagaaggcacgaaaaaacuaaugaaaauuacugcagaauggcucuggaaagaacuaggaaagaaaaagacaccuaggaugugcaccagagaagaauucacaagaaaggugagaagcaaugcagcuuuaggugccauauucacugaugagaacaaguggaagucggcacgugaggcuguugaagacaguggauuuugggaauugguugacaaggaaaggaaucuccaucuugaaggaaagugugaaacauguguguauaacaugaugggaaagagagagaagaagcuaggggaguucggcaaagcaaaaggcagcagagccauaugguacauguggcuuggagcacgcuucuuagaguuugaagcucuaggauucuugaaugaagaucacugguuuuccagagagaacucccugaguggaguggaaggagaagggcuacacaagcuaggcuacauuuuaagagacgugaguaagaaagaaggaggagcaauguaugcugaugacaccgcaggaugggacacaagaaucacacuagaggacuuaaaaaaugaagaaauggugacaaaccacauggaaggagaacacaagaaacuugcugaagccauuuucaaauuaacguaccaaaacaagguggugcgugugcaaagaccaacaccaagaggcacaguaauggacauuauaucgagaagagaccaaagagguaguggacaaguugucaccuacggccucaauacuuucaccaauauggaagcccaacugaucagacagauggagggagaaggaguuuucaaaagcauccagcaacugacaguaaaagaagaaauugcagugaaaaacugguuaauaagaguggggcgugagagguuaucaagaauggccaucaguggagaugauuguguugugaaacccuuagaugacagguuugcaagugcucuaacagcucuaaaugacaugggaaagguuaggaaagacauacaacaaugggaaccuucaagaggauggaacgauuggacacaagugcccuuuuguucacaccauuuccaugaguuaaucaugaaggacggucgugugcucguaguuccaugcagaaaccaagaugaacugauuggcagggcccgaauuucccagggagccgggugguccuugcgggaaacagccugucuggggaaguccuacgcccaaauguggagccugauguacuuccacagacgugaccuuaggcuggcggcaaaugccauuugcucggcagucccaucacauuggauuccaacaagucgaacaaccugguccauacacgccacacaugaguggaugacaacagaagacauguugacagucuggaacaggguguggauucaagaaaacccauggauggaagacaaaacuccaguagaaucaugggaggaaaucccguauuuggggaaaagagaagaccaauggugcggcucauugauugggcuaacaagcagggccaccugggcaaagaacauucaaacagcaauaaaucaaguuagaucccuaauaggcaaugaggaauacacagacuacaugccaucuaugaaaagauucagaagagaagaggaagaggcaggagucuugugguag

SEQ ID NO: 6425 - RNA, 9876 nt, Artificial Sequence
  derived and/or modified CDS sequence (wt) from DENV-2__KX380808__SS-prME
acugcagguauaauuauuaugaugaucccaacagugauggcguuccauuuaaccacacgcaauggagaaccacacaugaucgucaguagacaagagaaagggaaaagucuucuguuuaaaacagagaacggugugaacaugugcacccucauggccauggaccuuggugaacugugugaagacacaaucacuuacaauuguccucuucucaagcagaaugagccagaagacauagacuguuggugcaacucuacgucuacauggguaacuuaugggacaugcacagccacaggagaacacagaagggaaaaaagaucaguggcacucguuccacaugugggaaugggacuggagacacgaacugaaacauggaugucaucagaaggggccuggaaacaugcacagagaauugagaccugggucuugagacauccaggcuucaccauaauggcagcaauccuggcauacaccauaggaacgacauauuuccaaagaguccugauuuucaucuuacugacagcuaucgcuccuucaaugacaaugcguuguauaggaauaucaaauagagacuuuguggaagggguuucaggaggaagcuggguugacauagucuuggaacauggaagcugugugacgacgauggcgaaaaauaaaccaacacuggauuuugaacugauuaagacagaagccaaacaucccgccacucuaaggaaguauuguauagaggcaaaacugaccaacacaacaacagcaucucgcugcccaacacaaggagaaccuagccuaaaugaagaacaggacaaaagauuugucugcaaacacuccaugguagacagaggaugggggaauggaugcggauuauuuggaaaaggagguaucgugaccugugcaauguucacaugcaagaagaacauggaaggaaaaaucgugcaaccagaaaacuuggaguacaccauugugauaacaccucacucaggggaagagaaugcaguuggaaaugacacaggaaaacacggcaaggaaauuaaaguaacaccacagaguuccaucacagaagcagaacuaacaggcuauggcacugucacgauggaaugcucuccgagaacgggacucgacuucaaugagaugguguugcugcaaauggaaaacaaggcuuggcuggugcacaggcaaugguucuuagaccugccauuaccauggcugcccggagcagacacacaaggaucaaauuggauacagaaggagacauuggucacuuucaaaaauccccaugcaaagaaacaggauguuguuguuuuaggaucccaagaaggggcuaugcacacagcacucacaggggccacggaaauccagaugucaucaggaaacuuacuauucacaggacaucuuaaauguaggcugagaauggacaaacuacagcucaaaggaaugucauauuccauguguacaggaaaguucaaaguugugaaggaaauagcagaaacacaacauggaacaauaguuaucagaguacaauaugaaggggacgguucuccgugcaagaucccuuuugaaauaauggauuuggaaaaaagacaugucuuaggucgcuugauuacagucaacccaauugucacagaaaaagacagcccagucaacauagaagcagaaccuccauucggagacagcuauaucauuauaggaguagaaccgggacaacugaagcucagcugguucaagaaaggaaguucuauuggccaaauguuugagacaacaaugagaggagcgaagagaauggccauuuuaggugacacagcuugggauuuuggaucccugggaggaguguucacaucuauaggaaaggcccuccaccaagucuuuggagcaaucuauggggcugccuucagugggguuucauggacuaugaaaauucucauaggagucgucaucacauggauaggaaugaauucacguagcaccucacugucugugucacuaguauuagugggagucgugacauuguauuugggaguuauggugcaggccgauagcgguugcguugugagcuggaaaaacaaagaacugaaauguggcagugggauuuuuaucacagacaacgugcacacauggacagaacaauacaaauuccaaccagaauccccuucaaagcuggcuucagcuauccagaaggcucaugaagaaggcauuuguggaauccguucaguaacaagacuggagaaucugauguggaaacaaauaacaccagaacugaaucacauucuaucagaaaaugaggugaaguugaccaucaugacaggagacauuaaaggaaucaugcaggcaggaaaacgaucccugcggccucaacccacugagcugaaguacucuuggaaagcauggggcaaagcgaaaaugcucuccacagagcuucauaaccacaccuuucucauugauggccccgaaacagcagaaugucccaacacaaacagagcuuggaacucacuagagguugaagauuauggcuuuggaguguucaccacuaacauauggcugaaauugaaagaaaggcaggauguauuuugugacucaaaacucaugucggcagccauaaaagacaacagagccguccacgccgacauggguuauuggauagaaagcgcacuaaaugacacauggaagauugagaaagccucuuuuauugaaauuaaaagcugccacuggccaaagucacacacucucuggagcaauggagugcuagaaagugagaugauaauuccaaagaauuuugcaggaccagugucacaacacaauuacagaccaggcuaucauacacaaacggcaggacccuggcaucuaggcaggcuugagauggacuuugauuucugcgaaggaacuacagugguggugacugaggacuguggaaauagaggacccucuuuaagaacaacuacugcuucuggaaaacucauaacagaauggugcugccgaucuugcacauuaccaccgcuaagguacagaggugaggauggaugcugguauggaauggaaaucagaccauugaaagagaaagaagagaacuuggucaacucuuuggucacagccggacauggacagauugacaacuucucacuaggagucuugggaauggcauuguuucuggaagagaugcuuagaacccgaguaggaacgaaacaugcaauauuacuaguugcagucucuuucgugacauugaucacagggaacauguccuuucgagauuuggggagagugauggucauggugggcgcuacuaugacggaugacauaggcaugggcgugacuuaucuugcccuauuagcagccuucaaggucagaccaaccuuugcagcuggacuacucuuaagaaagcugaccuccaaggaauugaugaugaccaccauaggaaucguacuccucucucagagcaccauaccagagaccauacuugaacugacugacgcguuggcuuuggggaugaugguucucaaaauaguaagaaacauggaaaaguaucaacuagcagugacuaucauggcuaucuugugcgucccaaaugcagugauauuacaaaacgcauggaaagugagcugcacaacacuggcagugguguccguuuccccacugcuuuuaacauccucacagcagaaagcggauuggauaccacuggcguugacgaucaaaggccucaauccaacagccauuuucuuaacaacccucucaagaacuagcaagaaaaggagcuggccacuaaaugaggcuaucauggcaguagggauggugagcauuuuagccaguucucucuuaaagaaugacauucccaugacaggaccacuaguggcuggagggcuucucacuguguguuacgugcucacuggaagaucggcugauuuggaacuggagagggcugcugacguaagaugggaagaacaggcagagauaucaggaagcaguccaauucugucgauaacaauaucggaagaugguagcaugucgauaaaaaaugaagaagaagaacaaacacugaccauacugauuagaacaggacugcuggugauaucaggacuguuucccgugucaauaccaaucacggcagcugcaugguaccugugggaagugaaaaagcaacgagccggaguauugugggaugucccuucaccuccaccugugggaaaggccgaacuggaagauggagccuauagaaucaagcagaaagggauucuaggauacucgcagauaggagccggagucuacaaagaaggaacauuccacacaauguggcaugucacacguggugcuguucuaaugcauaaagggaagagaauugaaccaucaugggcggacgucaagaaagaccuaauaucguauggaggaggcuggaagcuagaaggagaauggaaggaaggagaagaaguccagguccuggcauuagagccuggaaagaauccaagagccguccaaacaaaacccggucuuuuuaaaacuaacacuggaaccauaggcgccguaucucuggacuuuucuccuggaacgucaggaucuccaauugucgacaaaaaaggaaaaguugugggccuuuauggcaacggugucgucacaaggaguggaacauaugugagugccauagcccagacugaaaaaagcauugaagacaacccagagauugaagaugacaucuuucgaaagaaaagauugaccaucauggaccuccacccaggagcaggaaagacaaagagauaucuuccagcaauagucagagaagccauaaaacgaggcuugagaacacuaauccuggcccccacuagaguuguggcggcugaaauggaagaagcucucagaggacuuccaauaagauaccaaaccccagcuauuagagcugaacacacuggacgggagauuguggaucuaaugugucacgccacauuuaccaugaggcuacuaucaccaauuagagugccaaauuacaaccugauuaucauggaugaagcccauuucacagacccagcaagcauagcagcuagaggauacauuucaacucgaguagagaugggugaagcagcugggauuuucaugacagcuaccccuccuggaagcagagacccauuuccucagagcaacgcaccaaucauggaugaagaaagggaaaucccugagcguucguggaacucaggacaugaguggguuacggauuuuaaagggaagacuguuugguuuguuccaaguauaaaagcaggaaaugauauagcagcuugccugagaaagaauggaaagaaagugauacaacucagcaggaagacuuuugauacugaauauaucaagacuaggaccaaugauugggacuuuguggucacgacagacauuucagaaaugggugcuaacuucaaggcugagaggguuauagaccccagacgcugcaugaaaccagucauacuaacagacggcgaagagcgggugauccuggcaggacccaugccagugacccacucuagugcagcacagagaagagggagaguaggaagaaauccaaaaaaugaaaaugaccaguacauauacaugggggaaccucuggaaaaugaugaagacugcgcacacuggaaagaagcuaagaugcuucuagauaacaucaacacgccugaaggaaucauucccagcauguuugaaccagagcgugaaaaggucgacgccauugauggugaauaccgcuugagaggagaagcgaggaaaacauuuguggaccuaaugagaagaggggaccuaccaguuuggcuagccuacagaguggcagcugaagguaucaacuacgcagacagaagauggugcuuugauggagucaagaacaaccaaaucuuggaagaaaauguggagguggaaauuuggacaaaagaaggagaaaggaagaaauuaaaacccagaugguuagaugcuaggaucuacucugauccacuggcgcucaaagaauucaaggaauucgcagcuggaaggaaaucccugacccugaaucuaauuaccgaaauggguaggcucccaaccuucaugacccagaaagcaaggaaugcauuggacaacuuagcaguccuacauacggcugaagcaggcggaagggcguauaaucaugcucuuagugaacugccagagacucuggagacauugcuuuuacugacacuuuuggccacagucacgggcggaaucuuccuguucuugaugagcggaaaagguauagggaagaugacccugggaaugugcugcauaaucacagccaguauucuccuaugguaugcacaaauacagccacauuggauagcagcuucaauaauacuggaguuuuuucucauagucuugcucauuccagagccagaaaagcagagaacaccccaagauaaccaauuaacuuauguugucauagccauccuuacagugguggccgcaaccauggcaaacgagauggguuuccuggaaaaaacaaagaaagauuucggauugggaagcauuacaacccagcaaccugagagcaacauccuggacauagaucugcguccugcaucagccuggacucuauaugccguggcaacaacuuucaucacaccaauguugagacauagcauugaaaauuccucagugaaugugucucuaacagccaucgccaaccaagccacaguguuaaugggucuugggaaaggauggccauugucgaaaauggacaucggaguuccccuucucgcuauuggaugcuauucacaagucaaccccauaacccucacagcagcccuucucuuauugguaacacauuaugcuaucauagggccaggacuccaagcgaaagcaacuagagaggcucagaaaagagcagcagcgggcaucaugaaaaucccaacuguggauggaauaacagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcgaccgggcccaucucuacacugugggaaggaaauccagggagauuuuggaacacaacuauugcagugucaauggcuaacauuuuuagagggaguuaccuggccggagccggacuucucuuuucuaucaugaagaacacggccaacacaagaaggggaacuggcaacacaggagagacgcuuggagagaaauggaaaaaccgguugaaugcauuggggaagagugaauuccagaucuauaagaaaaguggaauccaggaaguggauagaacuuuagcaaaagaaggcaucaagagaggagaaacggaccaucacgcugugucgcgaggcucagcgaaacugagaugguucgucgagagaaaccuggucacaccagaagggaaaguaguggaccuuggcugcggcagggggggcuggucauacuauugugggggacuaaagaauguaaaagaagucaaaggccuaacaaaaggaggaccaggacacgaagaacccauucccaugucaacauaugguuggaaucuggugcgucuccaaaguggagucgaugucuuuuuuacuccgccagaaaagugugacacauugcugugugacauaggggagucgucaccaaaccccacgguugaggcaggacgaacacucagaguucuaaacuuaguggaaaacuggcugaacaacaacacccaauuuugcauaaagguucuuaacccauauaugccuucaguuauagaaaaaauggaagcgcuacaaaggaaauacggaggagcuuuggugaggaauccacucucacgaaauuccacacacgagauguacuggguuuccaaugcuuccgggaacauagugucaucagugaacaugauuucaagaauguugauuaacagauucacaaugagacacaagaaggccacauacgagccggauguugaucucggaaguggaacccgcaacaucggaauugaaagugagacaccaaauuuagacauaauugggaaaagaauagaaaaaauaaaacaagagcaugaaacaucauggcacuaugaccaagaccacccauacaaaacgugggccuaccauggcagcuacgaaacaaaacagacuggaucagcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccaaaagaaggcacgaaaaaacuaaugaaaaucacggcagaauggcucuggaaagaacuaggaaagaaaaagacaccuaggaugugcaccagagaagaauucacaagaaaggugagaagcaaugcagccuuaggugccauauucacugaugagaacaaguggaagucggcacgugaggcuguugaagacaguggauucugggaauugguugacaaggaaaggaaucuccaucuugaaggaaagugugagacauguguguauaacaugaugggaaagagagagaagaagcuaggggaguucggcaaagcaaaaggcagcagagccauaugguacauguggcuuggagcacgcuucuuagaguuugaagcccuagguuucuugaaugaagaucacugguuuuccagagagaacucccugaguggaguggaaggagaagggcugcacaaacuaggcuacauuuuaagagacgugaguaagaaagaaggaggagcaauguacgccgaugacaccgcaggaugggacacaagaaucacacuagaggauuugaaaaaugaagaaauggugacaaaucacauggaaggagaacacaagaaacuugcugaagccauuuucagauuaacguaccaaaauaaaguagugcgugugcaaagaccgacaccaagaggcacaguaauggacauuauaucgagaagagaccaaagagguaguggacaaguugucaccuacggccucaauacuuucaccaacauggaagcucaacugaucagacagauggagggagaaggacucuucaaaagcauccagcaucugacagucacagaagaaauugcagugaaaaacugguuaguaagaguggggcgugagagguuaucaagaauggccaucagcggagacgauuguguugugaaacccuuagaugacagguuugcaagcgcucuaacagcucuaaaugacaugggaaaggucaggaaagacauacaacaaugggaaccuucaagaggauggaacgauuggacacaagugcccuuuuguucacaccauuuccaugaguuaaucaugaaggacggucguguacuugugguuccauguagaaaccaagaugaacugauugguagggcccgaauuucccagggagccgggugguccuugcgggaaacagccuguuuggggaagucuuacgcccaaauguggagccuaauguacuuccacagacgugaccuuaggcuggcggcaaaugccauuugcucggcagucccaucacauuggguuccaacaagucgaacaaccugguccauacacgccacacaugaguggaugacaacagaagacaugcugacagucuggaacaggguguggauccaagaaaacccauggauggaagacaaaacuccaguagaaucaugggaggaaaucccauauuuggggaagagagaagaccaauggugcggcucauugauugggcuaacaagcagggccaccugggcaaagaacauccaaacagcaauaaaucaaguuagaucccuaauaggcaaugaggaauacacagacuacaugccauccaugaaaagauucagaagagaagaggaagaggcaggagucuugugguag

SEQ ID NO: 6426 - RNA, 9876 nt, Artificial Sequence
  derived and/or modified CDS sequence (wt) from DENV-2__KX380832__SS-prME
acugcagguauaauuauuaugaugauuccaacagugauggcguuccauuuaaccacacgcaauggagaaccacacaugaucgucaguagacaagaaaaagggaaaagucuucuguuuaaaacagagaacggugugaacauguguacccucauggccauggaccuuggugaacugugugaagacacaaucacuuauaauuguccucuucucaggcagaaugaaccagaagacauagacuguuggugcaacucuacgucuacauggguaacuuaugggacaugcaccgcuacaggagaacacagaagggaaaaaagaucaguggcacucguuccgcacgugggaaugggacuggagacacgaacugaaacauggaugucaucagaaggggccuggaaacaugcgcagagaauugaaacuugggucuugagacauccaggcuucacuguaauggcagcaauccuggcauacaccauaggaacgacauauuuccaaagaguccugauuuucaucuuacugacagcugucgcuccuucaaugacaaugcguuguauaggaauaucaaauagagacuuuguggaagggguuucaggaggaagcuggguugacauagucuuggaacauggaagcugugugacaacgauggcgaaaaauaaaccaacauuggauuuugaacugauaaaaacagaagccaaacaucccgccacucuaaggaaguauuguauagaggcaaagcugaccaacacaacaacagcaucucgcugcccaacacaaggagaaccuagccuaaaugaagaacaggacaaaagauuugucugcaaacacuccaugguagacagaggauggggaaauggaugcggauuauuuggaaagggagguaucgugaccugugcaauguucacaugcaaaaagaacauggaaggaaaaaucgugcaaccagaaaauuuggaauacaccauugugauaacaccucacucaggggaagagaaugcagucggaaaugauacaggaaaacacggcaaggaaauuaaagugacaccacagagcuccaucacagaagcagaacuaaccggcuauggcacugccacgauggaaugcucuccgagaacgggccucgacuucaaugagaugguguugcugcaaauggaaaacaaggcuuggcuagugcacaggcaaugguucuuagaccugccguuaccauggcugcccggagcagacacacaaggaucaaauuggauacagaaggagacauuggucacuuucaaaaauccccaugcaaagaaacaggauguuguuguguuaggaucccaagaaggggcuaugcacacagcacucacaggggccacggaaauccagaugucaucaggaaacuuacuguucacaggacaucuuaaaugcaggcugagaauggacaaacuacagcucaaaggaaugucauauuccauguguacaggaaaguucaaaguugugaaggaaauagcagaaacacaacauggaacaauaguuaucagaguacaauaugaaggggacgguucuccgugcaaaaucccuuuugaaauaauggauuuggaaaaaagacaugucuuaggucgcuugaucacagucaacccaauugucacagaaaaagacagcccagucaacauagaagcagaaccuccauucggagacagcuacaucauuauaggaguagaaccggggcaacugaagcucagcugguuuaagaaaggaaguucuauuggccaaauguuugagacaacaaugagaggagcgaagagaauggccauuuuaggugacacagcuugggauuuuggaucucugggaggaguguuuacaucuauaggaaaggcccuccaccaagucuuuggagcaaucuauggggcugccuucagugggguuucauggacuaugaaaauccucauaggaguugucaucacauggauaggaaugaauucacgcagcaccucacugucugugucacuaguauuagugggaaucgugacacuguauuugggaguuauggugcaggcugauaguggcugcguugugagcuggaaaaacaaagaacugaaauguggcagugggaucuuuaucacagacaacgugcacacauggacagaacaauacaaauuccaaccagaauccccuucaaaacuggcuucagcuauccagaaggcccaugaagagggcauuuguggaauccgcucaguaacaagacuggagaaucugauguggaaacaaauaacaccagaacugaaucacauucuaucagaaaaugagguaaaguugacuaucaugacaggagacauuaaaggaaucaugcaggcaggaaaacgaucccugcgaccucaacccacugagcugaaguacucuuggaaagcauggggcaaagcgaaaaugcucuccacagagcuccacaaccacaccuuucucauugauggccccgaaacagcagaaugucccaacacaaacagagcuuggaacucacuagaaguugaagacuauggcuuuggaguauucacuaccaacauauggcugaaauugaaagaaaggcaggauguauuuugugacucaaaacucaugucagcagccauaaaagacaacagagccguccacgccgauauggguuauuggauagaaagcgcacucaacgacacauggaagauugagaaagccucuuuuauugaaguuaaaagcugccacuggccaaagucacacacucucuggagcaauggagugcuagaaagugagaugauaauuccaaagaauuuugcaggaccagugucacaacacaauuacagaccaggcuaucauacacaaacggcaggacccuggcaucuaggcaggcuugagauggacuuugacuucugcgaaggaaccacagugguggugacugaggacuguggaaauagaggacccucuuuaagaacaacuacugcuucuggaaaacucauaacagaauggugcugccgaucuugcacauuaccaccgcuaagguacagaggugaggauggaugcugguauggaauggaaaucagaccauugaaagagaaagaagagaacuuggucaacucuuuggucacagccggacauggacagauugacaacuucucacuaggagucuugggaauggcauuguuccuggaagagaugcucaggacucgaguaggaacgaaacaugcaauauuauuaguugcagucucuuucgugacauugaucacagggaacauguccuuucgagauuuggggagagugauggucauggugggcgcuacuaugacggaugacauaggcaugggcgugacuuaucuugcccuauuagcagccuucaaagucagaccaacuuuugcagcuggacuacucuuaagaaagcugaccuccaaggaauugaugaugaccaccauaggaauuguacuccucucucagagcaccauaccagagacuauacuugaacugacugacgcguuggcuuuggggaugaugguucucaaaauaguaagaaacauggaaaaguaucaacuagcagugacuaucaugacuauccugugcgucccaaaugcagugauauuacaaaacgcauggaaagugagcugcacgauacuggcagugguguccguuuccccacugcuuuuaacauccucacagcagaaagcggauuggauaccacuggcguugacaaucaaaggccucaauccaacagccauuuucuuaacaacccucucaagaacuagcaagaaaaggagcuggccacuaaaugaggcuauuauggcagucgggauggugagcauuuuagccaguucucucuuaaagaaugauauucccaugacaggaccauuaguggcuggagggcuucucacuguguguuacgugcucacuggaagaucggcugauuuggaacuggaaagagcugcugacguaagaugggaggaacaggcagagauaucagggagcaguccaauucugucgauaacaauaucggaagaugguaguaugucgauaaaaaaugaagaagaagaacaaacacugaccauacuuauuagaacaggacugcuggugauaucaggacuuuuucccgugucaauaccaaucacggcagcugcaugguaccugugggaagugaaaaaacaacgagccggaguauugugggacgucccuucaccuccaccugugggaaaagccgaacuggaagauggagccuauagaaucaagcagaaagggauuuuaggauacucgcagauuggagccggaguuuacaaagaaggaacauuccacacaauguggcaugucacacguggugcuguucuaaugcacaaagggaagaggauugaaccaucaugggcggacgucaagaaagacuuaauaucguauggaggaggcuggaagcuagaaggagaauggaaggaaggagaagaaguccagguccuggcauuagagccuggaaagaauccaagagccguccaaacaaaacccggucuuuuuaaaacuaacacuggaaccauaggcgccguaucucuggacuuuucuccuggaacgucaggaucuccaauugucgacaaaaaaggaaaaguugugggccuuuauggcaacggugucgucacaaggagugggacauaugugagcgccauagcccagacugaaaaaagcaucgaagacaauccagagauugaagaugacaucuuucgaaagaaaagauugaccaucauggaccuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagcuaucagagcugagcacacuggacgggagauuguggaucuaaugugucacgccacauucaccaugaggcuacuaucaccaaucagagugccaaauuacaaccugauuaucauggaugaagcccauuuuacagacccagcaagcauagcagcuagaggauacauuucaacucgaguagagaugggugaggcagcugggauuuucaugacagccaccccuccuggaagcagagacccauuuccucagagcaacgcaccaaucauggaugaagaaagggaaaucccugagcguucguggaacucuggacaugaguggguuacggauuuuaaagggaagacuguuugguuuguuccaaguauaaaagcaggaaaugauauaacagcuugccugagaaagaauggaaagaaagugauacaacucagcaggaagaccuuugauucugaauauaucaagacuaggaccaaugauugggacuuuguggucacgacagacauuucagaaaugggugccaacuucaaggcugagaggguuauagaccccagacgcugcaugaaaccagucauacuaacagacggugaagagcgggugaucuuggcaggacccaugccagugacccacucuagugcagcacaaagaagagggagaguaggaagaaauccaaaaaaugaaaaugaccaguacauauacaugggggaaccucuggaaaaugaugaagacugugcgcacuggaaagaagcuaagaugcuucuagauaacaucaacacgccugaaggaaucauucccagcauguucgaaccagagcgugaaaagguggaugccauugauggugaauaccgcuugagaggagaagcaaggaaaacauuuguggaccuaaugagaagaggagaccuaccagucuggcuagccuacagaguggcagcugaagguaucaacuacgcagacagaagauggugcuuugauggagucaagaacaaccaaauccuggaagaaaauguggaaguggaaauuuggacaaaagaaggagaaaggaagaaauuaaaacccagaugguuagaugccaggaucuacucugacccacuggcgcucaaagaauucaaggaauucgcagcuggaagaaaaucccugaccuugaaucuaaucaccgagauggguaggcucccaaccuucaugacccagaaagcaagaaaugcauuggacaacuuagcaguccugcauacggcugaagcaggcggaagggcguacaaccaugcucuuagugaacugccggagacucuggagacauugcuuuuacugacacucuuggccacagucacggguggaaucuuccuguucuugaugagcggaaaggguauagggaaaaugacccugggaaugugcugcauaaucacggccaguauucuccuaugguaugcucaaauacagccacacuggauagcagcuucaauaauacuggaguuuuuucucauagucuugcucauuccagaaccagagaagcagagaacaccccaagauaaccaauuaacuuauguugucauagccauccuuacagugguggccgcaaccauggcaaacgagauggguuuccuggaaaagacaaagaaagauuucggauugggaagcauuacaacccagcaaccugacagcaacauccuggacauagaucuacguccugcaucagcuuggacucuauaugccguggcaacaacuuucaucacaccaauguugagacacagcauugaaaauuccucagugaaugugucucuaacagccauugcuaaccaggccacaguguuaaugggucuugggaaaggauggccauugucaaaaauggacaucggaguuccccuucucgcuaucggaugcuauucacaagucaaccccauaacucucacagcagcccuucucuuauugguagcacacuaugcuaucauagggccaggacuccaagcgaaagcaacuagagaggcucagaaaagagcagcagcggguaucaugaaaaucccagcugccgauggaauaacagugauugaccuagauccaauacccuaugauccaaaguuugagaagcaguugggacaaguaaugcucuuaguccucugcgugacucaaguauugaugaugaggacuacaugggcuuuaugugaagcucuaaccuuagcgaccgggcccaucucuacacugugggaaggaaauccagggagauuuuggaauacaacuauugcagugucaauggcuaacauuuuuagagggaguuaccuagccggagccggacuucucuuuucuaucaugaagaacacggccaacacaagaaggggaacuggcaacacaggagagacgcuuggagagaaauggaaaaaccgguuaaaugcauuggggaagagugaauuccagaucuauaagaaaaguggaauccaggaaguggauagaaccuuagcaaaagaaggcaucaaaaggggagaaacggaccaucacgcugugucgcgaggcucggcgaaacugagaugguucgucgagagaaaccuggucacaccagaagggaaaguaguggaccuuggcugcggcagggggggcuggucauacuauugugggggacuaaagaauguaaaagaagucaaaggccuaacaaaaggaggaccaggacaugaagagcccauucccaugucaacauaugguuggaaucuggugcgucuucaaaguggaguugaugucuuuuuuacuccgccagagaagugugacacauugcugugugacauaggggagucgucaccaaaccccacgguugaggcaggacgaacacucagaguucuaaacuuaguggaaaacuggcugaacaacaacacccaauuuugcauaaagguucucaacccauauaugccuucaguuauagaaaaaauggaagcgcuacaaaggaaauacggaggagcuuuggugaggaauccacucucacgaaauuccacacacgagauguacuggguauccaaugcuuccgggaacauagugucaucagugaacaugauuucaagaauguugauuaacagauucacaaugaaacauaagaaggccacauacgagccagauguugaucucggaagugggacccgcaacaucggaauugaaagugagacaccaaauuuagacauaauugggaaaagaauagaaaaaauaaaacaagagcaugaaacaucauggcacuaugaccaggaccacccauacaaaacgugggccuaccauggcagcuacgaaacaaaacagacuggaucagcaucauccauggugaacggaguaguuaggcugcuaacaaaaccuugggacgucaucccuauggugacacagauggcaaugacagacacgacuccauuuggacaacagcgcguuuucaaagaaaaaguggacacgagaacccaagaaccgaaagaaggcacgaaaaaacuaaugaaaaucacggcagaauggcucuggaaagaacuaggaaagaaaaagacaccuaggaugugcaccagagaagaauucacaagaaaggugagaagcaaugcagccuuaggugccauauucacugaugagaacaaguggaagucggcacgugaggcuguugaagacaguggauuuugggaauugguugacaaggaaaggaaucuccaucuugaaggaaagugugagacauguguguauaacaugaugggaaagagagagaagaagcuaggggaguucgguaaagcaaaaggcagcagagcuauaugguacauguggcuuggagcacgcuucuuagaguucgaagcccuaggauuuuugaaugaagaccacugguuuuccagagagaacucccugaguggaguggaaggagaagggcugcacaaacuaggcuacauuuuaagagacgugaguaagaaagaaggaggagcaauguacgccgaugacaccgcaggaugggacacaagaaucacacuagaggacuuaaaaaaugaagaaauggugacaaaccacauggaaggagaacacaggaaacuugcugaagcuauuuucagauuaacguaccaaaacaagguggugcgugugcaaagaccgacaccaagaggcacaguaauggacauuauaucgagaagagaccaaagagguaguggacaaguugucacuuacggccucaauacuuucaccaacauggaagcccaacugaucagacagauggagggagaaggagucuucaaaagcauccaacaccugacagucacagaagaaauugcagugaaaaacugguuagaaagaguggggcgugagagguuaucaagaauggccaucaguggagaugauuguguugugaaacccuuagaugacagguuugcaagcgcucuaacagcucuaaaugacaugggaaagguuaggaaagacauacaacaaugggaaccuucaagaggauggaacgauuggacacaagugcccuuuuguucacaccauuuccaugaguuaaucaugaaagacggucguguacuuguaguuccaugcagaaaccaagaugaacugauugguagggcccgaauuucccagggagccgggugguccuugcgggaaacagccuguuuggggaagucuuacgcccaaauguggagccugauguacuuccacaggcgugaccuuaggcuggcggcaaaugccauuugcucggcagucccaucacauuggguuccaacaagucgaacaaccugguccauacacgccacacaugaguggaugacaacagaagacaugcugacagucuggaacaggguguggauucaagaaaauccauggauggaagacaaaacuccaguagaaucaugggaggaaaucccauaucuggggaaaagagaagaccaauggugcggcucauugauugggcuaacaagcagggccaccugggcaaagaacauccaaacagcaauaaaucaaguuagaucccuaauagguaaugaggaauacacagacuacaugccauccaugaaaagauucagaagagaagaggaagaggcaggagucuugugguaa

SEQ ID NO: 6427 - RNA, 9876 nt, Artificial Sequence
  derived and/or modified CDS sequence (wt) from DENV-2__KX380833__SS-prME
acugcagguauaauuauuaugaugauuccaacagugauggcguuccauuuaaccacacgcaauggagaaccacacaugaucgucaguagacaagaaaaagggaaaagucuucuguuuaaaacagagaacggugugaacauguguacccucauggccauggaccuuggugaacugugugaagacacaaucacuuauaauuguccucuucucaggcagaaugaaccagaagacauagacuguuggugcaacucuacgucuacauggguaacuuaugggacaugcaccgcuacaggagaacacagaagggaaaaaagaucaguggcacucguuccgcacgugggaaugggacuggagacacgaacugaaacauggaugucaucagaaggggccuggaaacaugcgcagagaauugaaacuugggucuugagacauccaggcuucacuguaauggcagcaauccuggcauacaccauaggaacgacauauuuccaaagaguccugauuuucaucuuacugacagcugucgcuccuucaaugacaaugcguuguauaggaauaucaaauagagacuuuguggaagggguuucaggaggaagcuggguugacauagucuuggaacauggaagcugugugacaacgauggcgaaaaauaaaccaacauuggauuuugaacugauaaaaacagaagccaaacaucccgccacucuaaggaaguauuguauagaggcaaagcugaccaacacaacaacagcaucucgcugcccaacacaaggagaaccuagccuaaaugaagaacaggacaaaagauuugucugcaaacacuccaugguagacagaggauggggaaauggaugcggauuauuuggaaagggagguaucgugaccugugcaauguucacaugcaaaaagaacauggaaggaaaaaucgugcaaccagaaaauuuggaauacaccauugugauaacaccucacucaggggaagagaaugcagucggaaaugauacaggaaaacacggcaaggaaauuaaagugacaccacagagcuccaucacagaagcagaacuaaccggcuauggcacugccacgauggaaugcucuccgagaacgggccucgacuucaaugagaugguguugcugcaaauggaaaacaaggcuuggcuagugcacaggcaaugguucuuagaccugccguuaccauggcugcccggagcagacacacaaggaucaaauuggauacagaaggagacauuggucacuuucaaaaauccccaugcaaagaaacaggauguuguuguguuaggaucccaagaaggggcuaugcacacagcacucacaggggccacggaaauccagaugucaucaggaaacuuacuguucacaggacaucuuaaaugcaggcugagaauggacaaacuacagcucaaaggaaugucauauuccauguguacaggaaaguucaaaguugugaaggaaauagcagaaacacaacauggaacaauaguuaucagaguacaauaugaaggggacgguucuccgugcaaaaucccuuuugaaauaauggauuuggaaaaaagacaugucuuaggucgcuugaucacagucaacccaauugucacagaaaaagacagcccagucaacauagaagcagaaccuccauucggagacagcuacaucauuauaggaguagaaccggggcaacugaagcucagcugguuuaagaaaggaaguucuauuggccaaauguuugagacaacaaugagaggagcgaagagaauggccauuuuaggugacacagcuugggauuuuggaucucugggaggaguguuuacaucuauaggaaaggcccuccaccaagucuuuggagcaaucuauggggcugccuucagugggguuucauggacuaugaaaauccucauaggaguugucaucacauggauaggaaugaauucacgcagcaccucacugucugugucacuaguauuagugggaaucgugacacuguauuugggaguuauggugcaggcugauaguggcugcguugugagcuggaaaaacaaagaacugaaauguggcagugggaucuuuaucacagacaacgugcacacauggacagaacaauacaaauuccaaccagaauccccuucaaaacuggcuucagcuauccagaaggcccaugaagagggcauuuguggaauccgcucaguaacaagacuggagaaucugauguggaaacaaauaacaccagaacugaaucacauucuaucagaaaaugagguaaaguugacuaucaugacaggagacauuaaaggaaucaugcaggcaggaaaacgaucccugcgaccucaacccacugagcugaaguacucuuggaaagcauggggcaaagcgaaaaugcucuccacagagcuccacaaccacaccuuucucauugauggccccgaaacagcagaaugucccaacacaaacagagcuuggaacucacuagaaguugaagacuauggcuuuggaguauucacuaccaacauauggcugaaauugaaagaaaggcaggauguauuuugugacucaaaacucaugucagcagccauaaaagacaacagagccguccacgccgauauggguuauuggauagaaagcgcacucaacgacacauggaagauugagaaagccucuuuuauugaaguuaaaagcugccacuggccaaagucacacacucucuggagcaauggagugcuagaaagugagaugauaauuccaaagaauuuugcaggaccagugucacaacacaauuacagaccaggcuaucauacacaaacggcaggacccuggcaucuaggcaggcuugagauggacuuugacuucugcgaaggaaccacagugguggugacugaggacuguggaaauagaggacccucuuuaagaacaacuacugcuucuggaaaacucauaacagaauggugcugccgaucuugcacauuaccaccgcuaagguacagaggugaggauggaugcugguauggaauggaaaucagaccauugaaagagaaagaagagaacuuggucaacucuuuggucacagccggacauggacagauugacaacuucucacuaggagucuugggaauggcauuguuccuggaagagaugcucaggacucgaguaggaacgaaacaugcaauauuauuaguugcagucucuuucgugacauugaucacagggaacauguccuuucgagauuuggggagagugauggucauggugggcgcuacuaugacggaugacauaggcaugggcgugacuuaucuugcccuauuagcagccuucaaagucagaccaacuuuugcagcuggacuacucuuaagaaagcugaccuccaaggaauugaugaugaccaccauaggaauuguacuccucucucagagcaccauaccagagacuauacuugaacugacugacgcguuggcuuuggggaugaugguucucaaaauaguaagaaacauggaaaaguaucaacuagcagugacuaucauggcuauccugugcgucccaaaugcagugauauuacaaaacgcauggaaagugagcugcacgauacuggcagugguguccguuuccccacugcuuuuaacauccucacagcagaaagcggauuggauaccacuggcguugacaaucaaaggccucaauccaacagccauuuucuuaacaacccucucaagaacuagcaagaaaaggagcuggccacuaaaugaggcuauuauggcagucgggauggugagcauuuuagccaguucucucuuaaagaaugauauucccaugacaggaccauuaguggcuggagggcuucucacuguguguuacgugcucacuggaagaucggcugauuuggaacuggaaagagcugcugacguaagaugggaggaacaggcagagauaucagggagcaguccaauucugucgauaacaauaucggaagaugguaguaugucgauaaaaaaugaagaagaagaacaaacacugaccauacuuauuagaacaggacugcuggugauaucaggacuuuuucccgugucaauaccaaucacggcagcugcaugguaccugugggaagugaaaaaacaacgagccggaguauugugggacgucccuucaccuccaccugugggaaaagccgaacuggaagauggagccuauagaaucaagcagaaagggauuuuaggauacucgcagauuggagccggaguuuacaaagaaggaacauuccacacaauguggcaugucacacguggugcuguucuaaugcacaaagggaagaggauugaaccaucaugggcggacgucaagaaagacuuaauaucguauggaggaggcuggaagcuagaaggagaauggaaggaaggagaagaaguccagguccuggcacuagagccuggaaagaauccaagagccguccaaacaaaacccggucuuuuuaaaacuaacacuggaaccauaggcgccguaucucuggacuuuucuccuggaacgucaggaucuccaauugucgacaaaaaaggaaaaguugugggccuuuauggcaacggugucgucacaaggagugggacauaugugagcgccauagcccagacugaaaaaagcaucgaagacaauccagagauugaagaugacaucuuucgaaagaaaagauugaccaucauggaccuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagcuaucagagcugagcacacuggacgggagauuguggaucuaaugugucacgccacauucaccaugaggcuacuaucaccaaucagagugccaaauuacaaccugauuaucauggaugaagcccauuuuacagacccagcaagcauagcagcuagaggauacauuucaacucgaguagagaugggugaagcagcugggauuuucaugacagccaccccuccuggaagcagagacccauuuccucagagcaacgcaccaaucauggaugaagaaagggaaaucccugagcguucguggaacucuggacaugaguggguuacggauuuuaaagggaagacuguuugguuuguuccaaguauaaaagcaggaaaugauauagcagcuugccugagaaagaauggaaagaaagugauacaacucagcaggaagaccuuugauucugaauauaucaagacuaggaccaaugauugggacuuuguggucacgacagacauuucagaaaugggugccaacuucaaggcugagaggguuauagaccccagacgcugcaugaaaccagucauacuaacagacggugaagagcgggugaucuuggcaggacccaugccagugacccacucuagugcagcacaaagaagagggagaguaggaagaaauccaaaaaaugaaaaugaccaguacauauacaugggggaaccucuggaaaaugaugaagacugugcgcacuggaaagaagcuaagaugcuucuagauaacaucaacacgccugaaggaaucauucccagcauguucgaaccagagcgugaaaagguggaugccauugauggugaauaccgcuugagaggagaagcgaggaaaacauuuguggaccuaaugagaagaggagaccuaccagucuggcuagccuacagaguggcagcugaagguaucaacuacgcagacagaagauggugcuuugauggagucaagaacaaccaaauccuggaagaaaauguggaaguggaaauuuggacaaaagaaggagaaaggaagaaauuaaaacccagaugguuagaugccaggaucuacucugacccacuggcgcucaaagaauucaaggaauucgcagcuggaagaaaaucacugaccuugaaucuaaucaccgagauggguaggcucccaaccuucaugacccagaaagcaagaaaugcauuggacaacuuagcaguccugcauacggcugaagcaggcggaagggcguacaaucaugcucuuagugaacugccggagacucuggagacauugcuuuuacugacacucuuggccacagucacggguggaaucuuccuguucuugaugagcggaaaggguauagggaaaaugacccugggaaugugcugcauaaucacggccaguauucuccuaugguaugcucaaauacagccacacuggauagcagcuucaauaauacuggaguuuuuucucauagucuugcucauuccagaaccagagaagcagagaacaccccaagauaaccaauuaacuuauguugucauagccauccuuacagugguggccgcaaccauggcaaacgagauggguuuccuggaaaagacaaagaaagauuucggauugggaagcauuacaacccagcaaccugacagcaacauccuggacauagaucuacguccugcaucagcuuggacucuauaugccguggcaacaacuuucaucacaccaauguugagacacagcauugaaaauuccucagugaaugugucucuaacagccauugcuaaccaggccacaguguuaaugggucuugggaaaggauggccauugucaaaaauggacaucggaguuccccuucucgcuaucggaugcuacucacaagucaaccccauaacucucacagcagcccuucucuuauugguagcacacuaugcuaucauagggccaggacuccaagcgaaagcaacuagagaggcucagaaaagagcagcagcggguaucaugaaaaucccagcugccgauggaauaacagugauugaccuagauccaauacccuaugauccaaaguuugagaagcaguugggacaaguaaugcucuuaguccucugcgugacucaaguauugaugaugaggacuacaugggcuuuaugugaagcucuaaccuuagcgaccgggcccaucucuacacugugggaaggaaauccagggagauuuuggaauacaacuauugcagugucaauggcuaacauuuuuagagggaguuaccuagccggagccggacuucucuuuucuaucaugaagaacacggccaacacaagaaggggaacuggcaacacaggagagacgcuuggagagaaauggaaaaaccgguuaaaugcauuggggaagagugaauuccagaucuauaagaaaaguggaauccaggaaguggauagaaccuuagcaaaagaaggcaucaaaaggggagaaacggaccaucacgcugugucgcgaggcucggcgaaacugagaugguucgucgagagaaaccuggucacaccagaagggaaaguaguggaccuuggcugcggcagggggggcuggucauacuauugugggggacuaaagaauguaaaagaagucaaaggccuaacaaaaggaggaccaggacaugaagagcccauucccaugucaacauaugguuggaaucuggugcgucuucaaaguggaguugaugucuuuuuuacuccgccagagaagugugacacauugcugugugacauaggggagucgucaccaaaccccacgguugaggcaggacgaacacucagaguucuaaacuuaguggaaaacuggcugaacaacaacacccaauuuugcauaaagguucucaacccauauaugccuucaguuauagaaaaaauggaagcgcuacaaaggaaauacggaggagcuuuggugaggaauccacucucacgaaauuccacacacgagauguacuggguauccaaugcuuccgggaacauagugucaucagugaacaugauuucaagaauguugauuaacagauucacaaugaaacauaagaaggccacauacgagccagauguugaucucggaagugggacccgcaacaucggaauugaaagugagacaccaaauuuagacauaauugggaaaagaauagaaaaaauaaaacaagagcaugaaacaucauggcacuaugaccaggaccacccauacaaaacgugggccuaccauggcagcuacgaaacaaaacagacuggaucagcaucauccauggugaacggaguaguuaggcugcuaacaaaaccuugggacgucaucccuauggugacacagauggcaaugacagacacgacuccauuuggacaacagcgcguuuucaaagaaaaaguggacacgagaacccaagaaccgaaagaaggcacgaaaaaacuaaugaaaaucacggcagaauggcucuggaaagaacuaggaaagaaaaagacaccuaggaugugcaccagagaagaauucacaagaaaggugagaagcaaugcagccuuaggugccauauucacugaugagaacaaguggaagucggcacgugaggcuguugaagacaguggauuuugggaauugguugacaaggaaaggaaucuccaucuugaaggaaagugugagacauguguguauaacaugaugggaaagagagagaagaagcuaggggaguucgguaaagcaaaaggcagcagagcuauaugguacauguggcuuggagcacgcuucuuagaguucgaagcccuaggauuuuugaaugaagaccacugguuuuccagagagaacucccugaguggaguggaaggagaagggcugcacaaacuaggcuacauuuuaagagacgugaguaagaaagaaggaggagcaauguacgccgaugacaccgcaggaugggacacaagaaucacacuagaggacuuaaaaaaugaagaaauggugacaaaccacauggaaggagaacacaggaaacuugcugaagcuauuuucagauuaacguaccaaaacaagguggugcgugugcaaagaccgacaccaagaggcacaguaauggacauuauaucgagaagagaccaaagagguaguggacaaguugucacuuacggccucaauacuuucaccaacauggaagcccaacugaucagacagauggagggagaaggagucuucaaaagcauccaacaccugacagucacagaagaaauugcagugaaaaacugguuagaaagaguggggcgugagagguuaucaagaauggccaucaguggagaugauuguguugugaaacccuuagaugacagguuugcaagcgcucuaacagcucuaaaugacaugggaaagguuaggaaagacauacaacaaugggaaccuucaagaggauggaacgauuggacacaagugcccuuuuguucacaccauuuccaugaguuaaucaugaaagacggucguguacuuguaguuccaugcagaaaccaagaugaacugauugguagggcccgaauuucccagggagccgggugguccuugcgggaaacagccuguuuggggaagucuuacgcccaaauguggagccugauguacuuccacaggcgugaccuuaggcuggcggcaaaugccauuugcucggcagucccaucacauuggguuccaauaagucgaacaaccugguccauacacgccacacaugaguggaugacaacagaagacaugcugacagucuggaacaggguguggauucaagaaaauccauggauggaagacaaaacuccaguagaaucaugggaggaaaucccauaucuggggaaaagagaagaccaauggugcggcucauugauugggcuaacaagcagggccaccugggcaaagaacauccaaacagcaauaaaucaaguuagaucccuaauaggcaaugaggaauacacagacuacaugccauccaugaaaagauucagaagagaagaggaagaggcaggagucuugugguaa

SEQ ID NO: 6428 - RNA, 9876 nt, Artificial Sequence
  derived and/or modified CDS sequence (wt) from DENV-2__KX380834__SS-prME
acugcagguauaauuauuaugaugaucccaacagugauggcguuccauuuaaccacacgcaacggagaaccacacaugauuguuaguagacaagagaaagggaaaagucuccuguuuaaaacagagaacggugugaacauguguacccucauggccauggaccuuggugaacugugugaagacacaaucacuuauaauuguccucuucucaggcagaaugaaccagaagacauagacuguuggugcaacuccacgucuacauggguaacuuaugggacaugcaccgccacaggagaacacagaagggaaaaaagaucaguggcacucguuccacaugugggaaugggacuggagacacgaacugaaacauggaugucaucagaaggggccuggaaacaugcccagagaauugaaacuuggaucuugagacauccaggcuucaccauaauggcagcaauccuggcauacaccauaggaacaacauauuuccaaagaguccugauuuucauuuuacugacagcugucacuccuucaauggcaaugcguugcauaggaauaucaaauagagacuuuguggaagggguuucaggaggaagcuggguugauauagucuuggaacauggaagcugugugacgacgauggcgaaaaauaaaccaacguuggauuuugaacugauaaaaacagaagccaaacaucucgccacucuaaggaaguauuguguagaggcaaagcugaccaacacaacaacagcaucucgcugcccaacacaaggagaaccuagccuaaacgaagaacaggacaaaagauucgucugcaaacacuccaugguagacagaggauggggaaauggaugcggauuauuuggaaagggaggcaucgugaccugugcaauguucacaugcaaaaagaacauggaaggaaaagucgugcaaccagaaaacuuggaguacaccaucgugauaacaccucacucaggggaagagaaugcagucggaaaugacacaggaaaacauggcaaggaaauuaaaguaacaccacagaguuccaucacagaagcagaacuaacaggcuacggcacugucacgauggaaugcucuccgagaacgggccucgacuucaaugagaugguguugcugcaaauggaaaacaaggcuuggcuggugcacaggcaaugguucuuagaccugccguuaccauggcugcccggagcagacacacaaggaucaaauuggauacagaaggagacacuggucacuuucaaaaauccccaugcaaagaaacaggauguuguuguuuuagguucccaagaaggggccaugcacacggcacucacaggggccacggaaauccagaugucaucaggaaacuuacuguucacaggacaucuuaagugcaggcugagaauggacaaacuacagcucaaaggaaugucauauuccauguguacaggaaaguucaaaguugugaaggaaauagcagaaacacaacauggaacaauaguuauuagaguacaauaugaaggggacgguuccccgugcaagaucccuuuugaaauaauggacuuggaaaaaaggcaugucuuaggucgcuugauuaccgucaacccaauugucacagaaaaagacagcccagucaacauagaagcagaaccuccauuuggagacaguuacaucauuauaggaguagaaccaggacaacugaagcucagcugguuuaagaaaggaaguucuauuggccaaauguuugagacaacaaugagaggagcgaagagaauggccauucuaggugacacagcuugggauuuuggaucccugggaggaguguucacaucuauaggaaaggcccuccaccaagucuuuggagcuaucuauggggcugccuucagugggguuucauggacuaugaaaauccucauaggagucgucaucacauggauaggaaugaauucacgcagcaccucacugucugugucacuaguauuagugggggucgugacauuguauuugggaguuauggugcaggccgauagugggugcguugucaguuggaaaaacaaagaacugaaaugugguagugggauuuuuaucacagacaacgugcacacauggacagaacaauacaaauuccaaccagaauccccuucaaagcuggcuucagcuauccagaaggcucaugaagaaggcauuuguggaauccgcucaguaacaagacuggagaaucugauguggaaacaaauaacaccagaauugaaucacauucuaacagaaaaugaaguaaaguugacuaucaugacaggagacaucaaaggaaucaugcaggcaggaaaacgaucccugcggccucaacccacugagcugaaguacuccuggaaggcauggggcaaagcgaaaaugcuuuccacagagcuucauaaccacaccuuucucauugauggccccgaaacagcagaaugucccaacacaaacagagcuuggaacucacuagaaguugaagacuauggcuuuggaguauucaccacuaacauauggcugaaauugaaagaaaggcaggauguguuuugugacucaaaccucaugucggcagccauaaaggacaauagagccguccacgccgauauggguuauuggauagaaagcgcacucaaugacacauggaagauugagaaagccucuuuuauugaaguuaaaagcugccacuggccaaagucacacacucucuggaguaauggagugcuggaaagugagaugauaauuccaaagaauuuugcaggaccaguuucacaacacaauuacagaccaggcuaccacacacaaacggcaggacccuggcaucuagguaggcuugagauggacuuugauuucugcgaaggaaccacagugguggugacugaggacuguggaaauagaggacccuccuuaagaacaacuacugcuucuggaaaacucauaacagaguggugcugccgaucuugcacauuaccaccgcuaagguacagaggugaggauggaugcugguaugguauggaaaucaggccauugaaagagaaagaagagaaccuggucaacucuuuggucacagccggacauggacagauugacaacuucucacuaggagucuugggaauggcauuguuccuggaagaaaugcucaggacucgaguaggaacgaaacaugcaauauuacuaguugcagucucuuucgugacauugaucacagggaacauguccuuucgagauuuggggagagugauggucauggugggcgcuacuaugacggaugacauaggcaugggcgugacuuaucuugcccuauuagcagccuuuaaagucagaccaaccuuugcggcuggacuacucuuaagaaagcugaccuccaaggaauugaugaugaccaccauaggaaucguacuccucucucagaguaccauaccagagagcauacuugaacugacugacgcguuggcuuuggggaugaugguucucaaaauagugagaaacauggaaaaguaucagcuagcagugacuaucauggcaaucuugugcgucccaaaugcagugauauugcaaaaugcauggaaagugagcugcacaacacuggcagugguguccguuuccccacugcuuuuaacauccucacagcagaaagcggauuggauaccacuggcguugacgaucaaaggccucaauccaacagccauuuucuuaacaacucucucaagaacuagcaagaaaaggagcuggccacuaaaugaggcuauuauggcagucgggauggugagcauucuagcuaguucucucuuaaagaaugauauucccaugacaggaccauuaguggcuggagggcuucucacuguguguuacgugcucacuggaaggucggcugacuuggaacuggaaagagcugcugacguaagaugggaagaacaggcagagauaucaggaaguaguccaauucugucgauaacaauaucggaagaugguagcaugucgauaaagaaugaagaagaagaacagacacugaccauacucaucagaacaggacuacuggugauaucaggacuuuuuccugugucaauaccaaucacggcagcugcaugguaccuuugggaagugaaaaaacaacgagcaggaguauugugggaugucccuucacccccaccugugggaaaggccgaacuggaagauggagccuauagaaucaagcagaaagggauccuaggauacucacagauuggagccggaguuuacaaagaaggaacauuccacacaauguggcaugucacacguggugcuguccuaaugcauaaagggaagagaauugaaccaucaugggcggacgucaagaaagaccuaauaucguauggaggaggcuggaagcuggaaggagaauggaaggaaggagaagaaguccagguccuggcauuagagccuggaaagaauccaagagccguccaaacaaaacccggucuuuuuaaaaccaacacuggaaccauaggcgccgugucucuggacuuuucuccuggaacgucaggaucuccaaucgucgauaaaaaaggaaaaguugugggccuuuauggcaacggugucgucacaaggaguggaacauaugugagugccauagcccagacugaaaaaagcaucgaagacaauccagagauugaagaugacaucuuuagaaagaaaagauugaccaucauggaccuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagcuaucagagcugagcacacugggcgggagauuguggaucuaaugugucaugccacauuuaccaugaggcuauuaucaccaauuagagugccaaauuacaaccugaucaucauggaugaagcccauuucacagacccagcaagcauagcagcuagaggauacauuucaacucgaguagagaugggugaggcagcugggauuuucaugacagccaccccuccuggaagcagagacccauuuccccagagcaacgcaccaaucauggaugaagaaagagaaaucccugagcguucguggaacucuggacaugaguggguuacggauuuuaaagggaagacuguuugguuuguuccaaguauaaaagcagggaaugauauagcagcuugccugagaaagaauggaaagaaagugauacaacucagcaggaaaacuuuugauucugaauauaucaagacuaggaccaaugauugggacuuuguggucacgacagacauuucagaaaugggugcuaacuucaaggcugagaggguuauagaccccagacgcugcaugaaaccagucauauuaacagacggugaagagcgggugaucuuggcaggacccaugccagugacccauucuagugcagcacaaagaagagggagaguaggaagaaauccaaaaaaugaaaaugaccaguacauauacaugggggaaccucuggaaaaugaugaagacugugcacacuggaaagaagcuaagaugcucuuggauaacaucaacacgccugaaggaaucauucccagcauguucgaaccagagcgugaaaagguggaugccauugauggugaauaccgcuugagaggagaagcgaggaaaacuuuuguggaccuaaugagaagaggagauuuaccagucuggcuagccuacagaguggcggcugaaggcaucaacuacgcagacagaagauggugcuuugauggagucaagaacaaccaaaucuuggaagaaaauguggaaguagaaauuuggacaaaagaaggagaaaggaagaaauuaaaacccagaugguuggaugcuaggaucuacucugacccauuggcgcucaaagaauucaaggaauucgcagcuggaagaaagucccugacccugaaucuaaucacagagauggguagacucccaaccuucaugacccagaaagcaaagaaugcacucgacaacuuagcaguccugcauacggcugaagcaggcggaagggcguacaaucaugcucuuagugaacugccggagacucuggagacauugcuuuuacugacacuuuuggccacagucacgggcggaaucuuccuguucuugaugagcggaaaggguauagggaagaugacccugggaaugugcugcauaaucacggcuaguauccucuuaugguaugcacaaauacagccacacuggauagcagcuucaauaauacuggaguuuuuucucauagucuugcucauuccagaaccagaaaaacagagaacaccccaagauaaccaguuaacuuauguugucauagccauccuuacaguaguggccgcaaccauggcaaacgagauggguuuccuggaaaaaacaaagaaagauuucggauugggaagcauuacaacccagcaaccugagaguaacauccuggacauagaucuacguccugcaucagcuuggacucuauaugccguggcaacaacuuucaucacaccaauguugaggcauagcauugaaaacuccucagugaaugugucccuaacagccauugccaaccaagccacaguguuaaugggucuugggaaaggauggccauugucaaaaauggacaucggaguuccccuucucgcuaucgggugcuauucacaagucaaccccauaacucucacugcagcccuucucuuauugguagcccauuaugccaucauagggccaggacuccaagcgaaagcaacuagagaggcucagaaaagagcagcagcgggcaucaugaaaaacccaacuguggauggaaugacagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcaaccgggcccaucucuacacugugggaaggaaauccagggagauuuuggaauacaacuauugcagugucaauggcuaacauuuuuagagggagcuaccuggccggggccggacuucucuuuucuaucaugaaaaacacggccaacacaagaaggggaacuggcaacacaggagagacgcuuggggagaaauggaaaaaccgguugaaugcauuagggaagagugaauuccagaucuacaagaaaaguggaauccaggaaguggacagaaccuuagcaaaagaaggcaucaaaagaggagaaacggaccaucacgcugugucgcgaggcucagcgaaacugagaugguucgucgagagaaaccuggucacaccagaagggaaaguaguggaccuuggcugcggcagggggggcuggucauacuauugugggggacuaaagaauguaaaagaagucaaaggccuaacaaaaggaggaccaggacacgaagaacccauucccaugucaacauaugguuggaaucuggugcgccuucaaaguggaguugauguuuuuuucacuccgccagaaaagugugacacacugcugugugacauaggggagucgucaccaaaccccacgguugaggcaggacgaacacuuagaguucuaaacuuaguggaaaauuggcugaacaacaacacccaauuuugcauaaagguucuuaacccauacaugcccucaguuauagaaaaaauggaagcacuacaaaggaaauacggaggagcuuuggugaggaauccacucucacgaaauuccacacacgagauguacuggguauccaaugcuuccgggaauauagugucaucagugaacaugauuucaagaauguugauuaacagauucacaaugagacacaagaaagccacauacgagccagauguugaccucggaaguggaacccgcaacaucggaauugaaagugagacaccaaauuuagacauaauugggaaaagaauagaaaaaauaaaacaagagcaugaaacaucauggcacuaugaccaagaccacccauacaaaacgugggccuaccauggcagcuacgaaacaaaacagacuggaucagcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccgaaagaaggcacgaaaaaacuaaugaaaauuacugcagaauggcucuggaaagaacuaggaaagaaaaagacaccuaggaugugcaccagagaagaauucacaagaaaggugagaagcaaugcagcuuuaggugccauauucacugaugagaacaaguggaagucggcacgugaggcuguugaagacaguggauuuugggaauugguugacaaggaaaggaaucuccaucuugaaggaaagugugaaacauguguguauaacaugaugggaaagagagagaagaagcuaggggaguucggcaaagcaaaaggcagcagagccauaugguacauguggcuuggagcacgcuucuuagaguuugaagcucuaggauucuugaaugaagaucacugguuuuccagagagaacucccugaguggaguggaaggagaagggcuacacaagcuaggcuacauuuuaagagacgugaguaagaaagaaggaggagcaauguaugcugaugacaccgcaggaugggacacaagaaucacacuagaggacuuaaaaaaugaagaaauggugacaaaccacauggaaggagaacacaagaaacuugcugaagccauuuucaaauuaacguaccaaaacaagguggugcgugugcaaagaccaacaccaagaggcacaguaauggacauuauaucgagaagagaccaaagagguaguggacaaguugucaccuacggccucaauacuuucaccaauauggaagcccaacugaucagacagauggagggagaaggaguuuucaaaagcauccagcaacugacaguaaaagaagaaauugcagugaaaaacugguuaauaagaguggggcgugagagguuaucaagaauggccaucaguggagaugauuguguugugaaacccuuagaugacagguuugcaagugcucuaacagcucuaaaugacaugggaaagguuaggaaagacauacaacaaugggaaccuucaagaggauggaacgauuggacacaagugcccuuuuguucacaccauuuccaugaguuaaucaugaaggacggucgugugcucguaguuccaugcagaaaccaagaugaacugauuggcagggcccgaauuucccagggagccgggugguccuugcgggaaacagccugucuggggaaguccuacgcccaaauguggagccugauguacuuccacagacgugaccuuaggcuggcggcaaaugccauuugcucggcagucccaucacauuggauuccaacaagucgaacaaccugguccauacacgccacacaugaguggaugacaacagaagacauguugacagucuggaacaggguguggauucaagaaaacccauggauggaagacaaaacuccaguagaaucaugggaggaaaucccguauuuggggaaaagagaagaccaauggugcggcucauugauugggcuaacaagcagggccaccugggcaaagaacauucaaacagcaauaaaucaaguuagaucccuaauaggcaaugaggaauacacagacuacaugccaucuaugaaaagauucagaagagaagaggaagaggcaggagucuugugguag

SEQ ID NO: 6429 - RNA, 9876 nt, Artificial Sequence
  derived and/or modified CDS sequence (wt) from DENV-2__KX380835__SS-prME
acugcagguauaauuauuaugaugauuccaacagugauggcguuccauuuaaccacacgcaauggagaaccacacaugaucgucaguagacaagaaaaagggaaaagucuucuguuuaaaacagagaacggugugaacauguguacccucauggccauggaccuuggugaacugugugaagacacaaucacuuauaauuguccucuucucaggcagaaugaaccagaagacauagacuguuggugcaacucuacgucuacauggguaacuuaugggacaugcaccgcuacaggagaacacagaagggaaaaaagaucaguggcacucguuccgcacgugggaaugggacuggagacacgaacugaaacauggaugucaucagaaggggccuggaaacaugcgcagagaauugaaacuugggucuugagacauccaggcuucacuguaauggcagcaauccuggcauacaccauaggaacgacauauuuccaaagaguucugauuuucaucuuacugacagcugucgcuccuucaaugacaaugcguuguauaggaauaucaaauagagacuuuguggaagggguuucaggaggaagcuggguugacauagucuuggaacauggaagcugugugacaacgauggcgaaaaauaaaccaacauuggauuuugaacugauaaaaacagaagccaaacaucccgccacucuaaggaaguauuguauagaggcaaagcugaccaacacaacaacagcaucucgcugcccaacacaaggagaaccuagccuaaaugaagaacaggacaaaagauuugucugcaaacacuccaugguagacagaggauggggaaauggaugcggauuauuuggaaagggagguaucgugaccugugcaauguucacaugcaaaaagaacauggaaggaaaaaucgugcaaccagaaaauuuggaauacaccauugugauaacaccucacucaggggaagagaaugcagucggaaaugauacaggaaaacacggcaaggaaauuaaagugacaccacagagcuccaucacagaagcagaacuaaccggcuauggcacugccacgauggaaugcucuccgagaacgggccucgacuucaaugagaugguguugcugcaaauggaaaacaaggcuuggcuagugcacaggcaaugguucuuagaccugccguuaccauggcugcccggagcagacacacaaggaucaaauuggauacagaaggagacauuggucacuuucaaaaauccccaugcaaagaaacaggauguuguuguguuaggaucccaagaaggggcuaugcacacagcacucacaggggccacggaaauccagaugucaucaggaaacuuacuguucacaggacaucuuaaaugcaggcugagaauggacaaacuacagcucaaaggaaugucauauuccauguguacaggaaaguucaaaguugugaaggaaauagcagaaacacaacauggaacaauaguuaucagaguacaauaugaaggggacgguucuccgugcaaaaucccuuuugaaauaauggauuuggaaaaaagacaugucuuaggucgcuugaucacagucaacccaauugucacagaaaaagacagcccagucaacauagaagcagaaccuccauucggagacagcuacaucauuauaggaguagaaccggggcaacugaagcucagcugguuuaagaaaggaaguucuauuggccaaauguuugagacaacaaugagaggagcgaagagaauggccauuuuaggugacacagcuugggauuuuggaucucugggaggaguguuuacaucuauaggaaaggcccuccaccaagucuuuggagcaaucuauggggcugccuucagugggguuucauggacuaugaaaauccucauaggaguugucaucacauggauaggaaugaauucacgcagcaccucacugucugugucacuaguauuagugggaaucgugacacuguauuugggaguuauggugcaggcugauaguggcugcguugugagcuggaaaaacaaagaacugaaauguggcagugggaucuuuaucacagacaacgugcacacauggacagaacaauacaaauuccaaccagaauccccuucaaaacuggcuucagcuauccagaaggcccaugaagagggcauuuguggaauccgcucaguaacaagacuggagaaucugauguggaaacaaauaacaccagaacugaaucacauucuaucagaaaaugagguaaaguugacuaucaugacaggagacauuaaaggaaucaugcaggcaggaaaacgaucccugcgaccucaacccacugagcugaaguacucuuggaaagcauggggcaaagcgaaaaugcucuccacagagcuccacaaccacaccuuucucauugauggccccgaaacagcagaaugucccaacacaaacagagcuuggaacucacuagaaguugaagacuauggcuuuggaguauucacuaccaacauauggcugaaauugaaagaaaggcaggauguauuuugugacucaaaacucaugucagcagccauaaaagacaacagagccguccacgccgauauggguuauuggauagaaagcgcacucaacgacacauggaagauugagaaagccucuuuuauugaaguuaaaagcugccacuggccaaagucacacacucucuggagcaauggagugcuagaaagugagaugauaauuccaaagaauuuugcaggaccagugucacaacacaauuacagaccaggcuaucauacacaaacggcaggacccuggcaucuaggcaggcuugagauggacuuugacuucugcgaaggaaccacagugguggugacugaggacuguggaaauagaggacccucuuuaagaacaacuacugcuucuggaaaacucauaacagaauggugcugccgaucuugcacauuaccaccgcuaagguacagaggugaggauggaugcugguauggaauggaaaucagaccauugaaagagaaagaagagaacuuggucaacucuuuggucacagccggacauggacagauugacaacuucucacuaggagucuugggaauggcauuguuccuggaagagaugcucaggacucgaguaggaacgaaacaugcaauauuauuaguugcagucucuuucgugacauugaucacagggaacauguccuuucgagauuuggggagagugauggucauggugggcgcuacuaugacggaugacauaggcaugggcgugacuuaucuugcccuauuagcagccuucaaagucagaccaacuuuugcagcuggacuacucuuaagaaagcugaccuccaaggaauugaugaugaccaccauaggaauuguacuccucucucagagcaccauaccagagacuauacuugaacugacugacgcguuggcuuuggggaugaugguucucaaaauaguaagaaacauggaaaaguaucaacuagcagugacuaucauggcuauccugugcgucccaaaugcagugauauuacaaaacgcauggaaagugagcugcacgauacuggcagugguguccguuuccccacugcuuuuaacauccucacagcagaaagcggauuggauaccacuggcguugacaaucaaaggccucaauccaacagccauuuucuuaacaacccucucaagaacuagcaagaaaaggagcuggccacuaaaugaggcuauuauggcagucgggauggugagcauuuuagccaguucucucuuaaagaaugauauucccaugacaggaccauuaguggcuggagggcuucucacuguguguuacgugcucacuggaagaucggcugauuuggaacuggaaagagcugcugacguaagaugggaggaacaggcagagauaucagggagcaguccaauucugucgauaacaauaucggaagaugguaguaugucgauaaaaaaugaagaagaagaacaaacacugaccauacuuauuagaacaggacugcuggugauaucaggacuuuuucccgugucaauaccaaucacggcagcugcaugguaccugugggaagugaaaaaacaacgagccggaguauugugggacgucccuucaccuccaccugugggaaaagccgaacuggaagauggagccuauagaaucaagcagaaagggauuuuaggauacucgcagauuggagccggaguuuacaaagaaggaacauuccacacaauguggcaugucacacguggugcuguucuaaugcacaaagggaagaggauugaaccaucaugggcggacgucaagaaagacuuaauaucguauggaggaggcuggaagcuagaaggagaauggaaggaaggagaagaaguccagguccuggcacuagagccuggaaagaauccaagagccguccaaacaaaacccggucuuuuuaaaacuaacacuggaaccauaggcgccguaucucuggacuuuucuccuggaacgucaggaucuccaauugucgacaaaaaaggaaaaguugugggccuuuauggcaacggugucgucacaaggagugggacauaugugagcgccauagcccagacugaaaaaagcaucgaagacaauccagagauugaagaugacaucuuucgaaagaaaagauugaccaucauggaccuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagcuaucagagcugagcacacuggacgggagauuguggaucuaaugugucacgccacauucaccaugaggcuacuaucaccaaucagagugccaaauuacaaccugauuaucauggaugaagcccauuuuacagacccagcaagcauagcagcuagaggauacauuucaacucgaguagagaugggugaagcagcugggauuuucaugacagccaccccuccuggaagcagagacccauuuccucagagcaacgcaccaaucauggaugaagaaagggaaaucccugagcguucguggaacucuggacaugaguggguuacggauuuuaaagggaagacuguuugguuuguuccaaguauaaaagcaggaaaugauauagcagcuugccugagaaagaauggaaagaaagugauacaacucagcaggaagaccuuugauucugaauauaucaagacuaggaccaaugauugggacuuuguggucacgacagacauuucagaaaugggugccaacuucaaggcugagaggguuauagaccccagacgcugcaugaaaccagucauacuaacagacggugaagagcgggugaucuuggcaggacccaugccagugacccacucuagugcagcacaaagaagagggagaguaggaagaaauccaaaaaaugaaaaugaccaguacauauacaugggggaaccucuggaaaaugaugaagacugugcgcacuggaaagaagcuaagaugcuucuagauaacaucaacacgccugaaggaaucauucccagcauguucgaaccagagcgugaaaagguggaugccauugauggugaauaccgcuugagaggagaagcgaggaaaacauuuguggaccuaaugagaagaggagaccuaccagucuggcuagccuacagaguggcagcugaagguaucaacuacgcagacagaagauggugcuuugauggagucaagaacaaccaaauccuggaagaaaauguggaaguggaaauuuggacaaaagaaggagaaaggaagaaauuaaaacccagaugguuagaugccaggaucuacucugacccacuggcgcucaaagaauucaaggaauucgcagcuggaagaaaaucacugaccuugaaucuaaucaccgagauggguaggcucccaaccuucaugacccagaaagcaagaaaugcauuggacaacuuagcaguccugcauacggcugaagcaggcggaagggcguacaaucaugcucuuagugaacugccggagacucuggagacauugcuuuuacugacacucuuggccacagucacggguggaaucuuccuguucuugaugagcggaaaggguauagggaaaaugacccugggaaugugcugcauaaucacggccaguauucuccuaugguaugcucaaauacagccacacuggauagcagcuucaauaauacuggaguuuuuucucauagucuugcucauuccagaaccagagaagcagagaacaccccaagauaaccaauuaacuuauguugucauagccauccuuacagugguggccgcaaccauggcaaacgagauggguuuccuggaaaagacaaagaaagauuucggauugggaagcauuacaacccagcaaccugacagcaacauccuggacauagaucuacguccugcaucagcuuggacucuauaugccguggcaacaacuuucaucacaccaauguugagacacagcauugaaaauuccucagugaaugugucucuaacagccauugcuaaccaggccacaguguuaaugggucuugggaaaggauggccauugucaaaaauggacaucggaguuccccuucucgcuaucggaugcuacucacaagucaaccccauaacucucacagcagcccuucucuuauugguagcacacuaugcuaucauagggccaggacuccaagcgaaagcaacuagagaggcucagaaaagagcagcagcgggcaucaugaaaaacccaacuguggauggaaugacagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcgaccgggcccaucucuacacugugggaaggaaauccagggagauuuuggaauacaacuauugcagugucaauggcuaacauuuuuagagggaguuaccuagccggagccggacuucucuuuucuaucaugaagaacacggccaacacaagaaggggaacuggcaacacaggagagacgcuuggagagaaauggaaaaaccgguuaaaugcauuggggaagagugaauuccagaucuauaagaaaaguggaauccaggaaguggauagaaccuuagcaaaagaaggcaucaaaaggggagaaacggaccaucacgcugugucgcgaggcucggcgaaacugagaugguucgucgagagaaaccuggucacaccagaagggaaaguaguggaccuuggcugcggcagggggggcuggucauacuauugugggggacuaaagaauguaaaagaagucaaaggccuaacaaaaggaggaccaggacaugaagagcccauucccaugucaacauaugguuggaaucuggugcgucuucaaaguggaguugaugucuuuuuuacuccgccagagaagugugacacauugcugugugacauaggggagucgucaccaaaccccacgguugaggcaggacgaacacucagaguucuaaacuuaguggaaaacuggcugaacaacaacacccaauuuugcauaaagguucucaacccauauaugccuucaguuauagaaaaaauggaagcgcuacaaaggaaauacggaggagcuuuggugaggaauccacucucacgaaauuccacacacgagauguacuggguauccaaugcuuccgggaacauagugucaucagugaacaugauuucaagaauguugauuaacagauucacaaugaaacauaagaaggccacauacgagccagauguugaucucggaagugggacccgcaacaucggaauugaaagugagacaccaaauuuagacauaauugggaaaagaauagaaaaaauaaaacaagagcaugaaacaucauggcacuaugaccaggaccacccauacaaaacgugggccuaccauggcagcuacgaaacaaaacagacuggaucagcaucauccauggugaacggaguaguuaggcugcuaacaaaaccuugggacgucaucccuauggugacacagauggcaaugacagacacgacuccauuuggacaacagcgcguuuucaaagaaaaaguggacacgagaacccaagaaccgaaagaaggcacgaaaaaacuaaugaaaaucacggcagaauggcucuggaaagaacuaggaaagaaaaagacaccuaggaugugcaccagagaagaauucacaagaaaggugagaagcaaugcagccuuaggugccauauucacugaugagaacaaguggaagucggcacgugaggcuguugaagacaguggauuuugggaauugguugacaaggaaaggaaucuccaucuugaaggaaagugugagacauguguguauaacaugaugggaaagagagagaagaagcuaggggaguucgguaaagcaaaaggcagcagagcuauaugguacauguggcuuggagcacgcuucuuagaguucgaagcccuaggauuuuugaaugaagaccacugguuuuccagagagaacucccugaguggaguggaaggagaagggcugcacaaacuaggcuacauuuuaagagacgugaguaagaaagaaggaggagcaauguacgccgaugacaccgcaggaugggacacaagaaucacacuagaggacuuaaaaaaugaagaaauggugacaaaccacauggaaggagaacacaggaaacuugcugaagcuauuuucagauuaacguaccaaaacaagguggugcgugugcaaagaccgacaccaagaggcacaguaauggacauuauaucgagaagagaccaaagagguaguggacaaguugucacuuacggccucaauacuuucaccaacauggaagcccaacugaucagacagauggagggagaaggagucuucaaaagcauccaacaccugacagucacagaagaaauugcagugaaaaacugguuagaaagaguggggcgugagagguuaucaagaauggccaucaguggagaugauuguguugugaaacccuuagaugacagguuugcaagcgcucuaacagcucuaaaugacaugggaaagguuaggaaagacauacaacaaugggaaccuucaagaggauggaacgauuggacacaagugcccuuuuguucacaccauuuccaugaguuaaucaugaaagacggucguguacuuguaguuccaugcagaaaccaagaugaacugauugguagggcccgaauuucccagggagccgggugguccuugcgggaaacagccuguuuggggaagucuuacgcccaaauguggagccugauguacuuccacaggcgugaccuuaggcuggcggcaaaugccauuugcucggcagucccaucacauuggguuccaauaagucgaacaaccugguccauacacgccacacaugaguggaugacaacagaagacaugcugacagucuggaacaggguguggauucaagaaaauccauggauggaagacaaaacuccaguagaaucaugggaggaaaucccauaucuggggaaaagagaagaccaauggugcggcucauugauugggcuaacaagcagggccaccugggcaaagaacauccaaacagcaauaaaucaaguuagaucccuaauaggcaaugaggaauacacagacuacaugccauccaugaaaagauucagaagagaagaggaagaggcaggagucuugugguaa

SEQ ID NO: 6430 - RNA, 9876 nt, Artificial Sequence
  derived and/or modified CDS sequence (wt) from DENV-2__KX380836__SS-prME
acugcagguauaauuauuaugaugauuccaacagugauggcguuccauuuaaccacacgcaauggagaaccacacaugaucgucaguagacaagaaaaagggaaaagucuucuguuuaaaacagagaacggugugaacauguguacccucauggccauggaccuuggugaacugugugaagacacaaucacuuauaauuguccucuucucaggcagaaugaaccagaagacauagacuguuggugcaacucuacgucuacauggguaacuuaugggacaugcaccgcuacaggagaacacagaagggaaaaaagaucaguggcacucguuccgcacgugggaaugggacuggagacacgaacugaaacauggaugucaucagaaggggccuggaaacaugcgcagagaauugaaacuugggucuugagacauccaggcuucacuguaauggcagcaauccuggcauacaccauaggaacgacauauuuccaaagaguccugauuuucaucuuacugacagcugucgcuccuucaaugacaaugcguuguauaggaauaucaaauagagacuuuguggaagggguuucaggaggaagcuggguugacauagucuuggaacauggaagcugugugacaacgauggcgaaaaauaaaccaacauuggauuuugaacugauaaaaacagaagccaaacaucccgccacucuaaggaaguauuguauagaggcaaagcugaccaacacaacaacagcaucucgcugcccaacacaaggagaaccuagccuaaaugaagaacaggacaaaagauuugucugcaaacacuccaugguagacagaggauggggaaauggaugcggauuauuuggaaagggagguaucgugaccugugcaauguucacaugcaaaaagaacauggaaggaaaaaucgugcaaccagaaaauuuggaauacaccauugugauaacaccucacucaggggaagagaaugcagucggaaaugauacaggaaaacacggcaaggaaauuaaagugacaccacagagcuccaucacagaagcagaacuaaccggcuauggcacugccacgauggaaugcucuccgagaacgggccucgacuucaaugagaugguguugcugcaaauggaaaacaaggcuuggcuagugcacaggcaaugguucuuagaccugccguuaccauggcugcccggagcagacacacaaggaucaaauuggauacagaaggagacauuggucacuuucaaaaauccccaugcaaagaaacaggauguuguuguguuaggaucccaagaaggggcuaugcacacagcacucacaggggccacggaaauccagaugucaucaggaaacuuacuguucacaggacaucuuaaaugcaggcugagaauggacaaacuacagcucaaaggaaugucauauuccauguguacaggaaaguucaaaguugugaaggaaauagcagaaacacaacauggaacaauaguuaucagaguacaauaugaaggggacgguucuccgugcaaaaucccuuuugaaauaauggauuuggaaaaaagacaugucuuaggucgcuugaucacagucaacccaauugucacagaaaaagacagcccagucaacauagaagcagaaccuccauucggagacagcuacaucauuauaggaguagaaccggggcaacugaagcucagcugguuuaagaaaggaaguucuauuggccaaauguuugagacaacaaugagaggagcgaagagaauggccauuuuaggugacacagcuugggauuuuggaucucugggaggaguguuuacaucuauaggaaaggcccuccaccaagucuuuggagcaaucuauggggcugccuucagugggguuucauggacuaugaaaauccucauaggaguugucaucacauggauaggaaugaauucacgcagcaccucacugucugugucacuaguauuagugggaaucgugacacuguauuugggaguuauggugcaggcugauaguggcugcguugugagcuggaaaaacaaagaacugaaauguggcagugggaucuuuaucacagacaacgugcacacauggacagaacaauacaaauuccaaccagaauccccuucaaaacuggcuucagcuauccagaaggcccaugaagagggcauuuguggaauccgcucaguaacaagacuggagaaucugauguggaaacaaauaacaccagaacugaaucacauucuaucagaaaaugagguaaaguugacuaucaugacaggagacauuaaaggaaucaugcaggcaggaaaacgaucccugcgaccucaacccacugagcugaaguacucuuggaaagcauggggcaaagcgaaaaugcucuccacagagcuccacaaccacaccuuucucauugauggccccgaaacagcagaaugucccaacacaaacagagcuuggaacucacuagaaguugaagacuauggcuuuggaguauucacuaccaacauauggcugaaauugaaagaaaggcaggauguauuuugugacucaaaacucaugucagcagccauaaaagacaacagagccguccacgccgauauggguuauuggauagaaagcgcacucaacgacacauggaagauugagaaagccucuuuuauugaaguuaaaagcugccacuggccaaagucacacacucucuggagcaauggagugcuagaaagugagaugauaauuccaaagaauuuugcaggaccagugucacaacacaauuacagaccaggcuaucauacacaaacggcaggacccuggcaucuaggcaggcuugagauggacuuugacuucugcgaaggaaccacagugguggugacugaggacuguggaaauagaggacccucuuuaagaacaacuacugcuucuggaaaacucauaacagaauggugcugccgaucuugcacauuaccaccgcuaagguacagaggugaggauggaugcugguauggaauggaaaucagaccauugaaagagaaagaagagaacuuggucaacucuuuggucacagccggacauggacagauugacaacuucucacuaggagucuugggaauggcauuguuccuggaagagaugcucaggacucgaguaggaacgaaacaugcaauauuauuaguugcagucucuuucgugacauugaucacagggaacauguccuuucgagauuuggggagagugauggucauggugggcgcuacuaugacggaugacauaggcaugggcgugacuuaucuugcccuauuagcagccuucaaagucagaccaacuuuugcagcuggacuacucuuaagaaagcugaccuccaaggaauugaugaugaccaccauaggaauuguacuccucucucagagcaccauaccagagacuauacuugaacugacugacgcguuggcuuuggggaugaugguucucaaaauaguaagaaacauggaaaaguaucaacuagcagugacuaucauggcuauccugugcgucccaaaugcagugauauuacaaaacgcauggaaagugagcugcacgauacuggcagugguguccguuuccccacugcuuuuaacauccucacagcagaaagcggauuggauaccacuggcguugacaaucaaaggccucaauccaacagccauuuucuuaacaacccucucaagaacuagcaagaaaaggagcuggccacuaaaugaggcuauuauggcagucgggauggugagcauuuuagccaguucucucuuaaagaaugauauucccaugacaggaccauuaguggcuggagggcuucucacuguguguuacgugcucacuggaagaucggcugauuuggaacuggaaagagcugcugacguaagaugggaggaacaggcagagauaucagggagcaguccaauucugucgauaacaauaucggaagaugguaguaugucgauaaaaaaugaagaagaagaacaaacacugaccauacuuauuagaacaggacugcuggugauaucaggacuuuuucccgugucaauaccaaucacggcagcugcaugguaccugugggaagugaaaaaacaacgagccggaguauugugggacgucccuucaccuccaccugugggaaaagccgaacuggaagauggagccuauagaaucaagcagaaagggauuuuaggauacucgcagauuggagccggaguuuacaaagaaggaacauuccacacaauguggcaugucacacguggugcuguucuaaugcacaaagggaagaggauugaaccaucaugggcggacgucaagaaagacuuaauaucguauggaggaggcuggaagcuagaaggagaauggaaggaaggagaagaaguccagguccuggcacuagagccuggaaagaauccaagagccguccaaacaaaacccggucuuuuuaaaacuaacacuggaaccauaggcgccguaucucuggacuuuucuccuggaacgucaggaucuccaauugucgacaaaaaaggaaaaguugugggccuuuauggcaacggugucgucacaaggagugggacauaugugagcgccauagcccagacugaaaaaagcaucgaagacaauccagagauugaagaugacaucuuucgaaagaaaagauugaccaucauggaccuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagcuaucagagcugagcacacuggacgggagauuguggaucuaaugugucacgccacauucaccaugaggcuacuaucaccaaucagagugccaaauuacaaccugauuaucauggaugaagcccauuuuacagacccagcaagcauagcagcuagaggauacauuucaacucgaguagagaugggugaagcagcugggauuuucaugacagccaccccuccuggaagcagagacccauuuccucagagcaacgcaccaaucauggaugaagaaagggaaaucccugagcguucguggaacucuggacaugaguggguuacggauuuuaaagggaagacuguuugguuuguuccaaguauaaaagcaggaaaugauauagcagcuugccugagaaagaauggaaagaaagugauacaacucagcaggaagaccuuugauucugaauauaucaagacuaggaccaaugauugggacuuuguggucacgacagacauuucagaaaugggugcuaacuucaaggcugagaggguuauagaccccagacgcugcaugaaaccagucauauuaacagacggugaagagcgggugaucuuggcaggacccaugccagugacccauucuagugcagcacaaagaagagggagaguaggaagaaauccaaaaaaugaaaaugaccaguacauauacaugggggaaccucuggaaaaugaugaagacugugcacacuggaaagaagcuaagaugcucuuggauaacaucaacacgccugaaggaaucauucccagcauguucgaaccagagcgugaaaagguggaugccauugauggugaauaccgcuugagaggagaagcgaggaaaacuuuuguggaccuaaugagaagaggagauuuaccagucuggcuagccuacagaguggcggcugaaggcaucaacuacgcagacagaagauggugcuuugauggagucaagaacaaccaaaucuuggaagaaaauguggaaguagaaauuuggacaaaagaaggagaaaggaagaaauuaaaacccagaugguuggaugcuaggaucuacucugacccauuggcgcucaaagaauucaaggaauucgcagcuggaagaaagucccugacccugaaucuaaucacagagauggguagacucccaaccuucaugacccagaaagcaaagaaugcacucgacaacuuagcaguccugcauacggcugaagcaggcggaagggcguacaaucaugcucuuagugaacugccggagacucuggagacauugcuuuuacugacacuuuuggccacagucacgggcggaaucuuccuguucuugaugagcggaaaggguauagggaagaugacccugggaaugugcugcauaaucacggcuaguauccucuuaugguaugcacaaauacagccacacuggauagcagcuucaauaauacuggaguuuuuucucauagucuugcucauuccagaaccagaaaaacagagaacaccccaagauaaccaguuaacuuauguugucauagccauccuuacaguaguggccgcaaccauggcaaacgagauggguuuccuggaaaaaacaaagaaagauuucggauugggaagcauuacaacccagcaaccugagaguaacauccuggacauagaucuacguccugcaucagcuuggacucuauaugccguggcaacaacuuucaucacaccaauguugaggcauagcauugaaaacuccucagugaaugugucccuaacagccauugccaaccaagccacaguguuaaugggucuugggaaaggauggccauugucaaaaauggacaucggaguuccccuucucgcuaucgggugcuauucacaagucaaccccauaacucucacugcagcccuucucuuauugguagcccauuaugccaucauagggccaggacuccaagcgaaagcaacuagagaggcucagaaaagagcagcagcgggcaucaugaaaaacccaacuguggauggaaugacagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcgaccgggcccaucucuacacugugggaaggaaauccagggagauuuuggaauacaacuauugcagugucaauggcuaacauuuuuagagggaguuaccuagccggagccggacuucucuuuucuaucaugaagaacacggccaacacaagaaggggaacuggcaacacaggagagacgcuuggagagaaauggaaaaaccgguuaaaugcauuggggaagagugaauuccagaucuauaagaaaaguggaauccaggaaguggauagaaccuuagcaaaagaaggcaucaaaaggggagaaacggaccaucacgcugugucgcgaggcucggcgaaacugagaugguucgucgagagaaaccuggucacaccagaagggaaaguaguggaccuuggcugcggcagggggggcuggucauacuauugugggggacuaaagaauguaaaagaagucaaaggccuaacaaaaggaggaccaggacaugaagagcccauucccaugucaacauaugguuggaaucuggugcgucuucaaaguggaguugaugucuuuuuuacuccgccagagaagugugacacauugcugugugacauaggggagucgucaccaaaccccacgguugaggcaggacgaacacucagaguucuaaacuuaguggaaaacuggcugaacaacaacacccaauuuugcauaaagguucucaacccauauaugccuucaguuauagaaaaaauggaagcgcuacaaaggaaauacggaggagcuuuggugaggaauccacucucacgaaauuccacacacgagauguacuggguauccaaugcuuccgggaacauagugucaucagugaacaugauuucaagaauguugauuaacagauucacaaugaaacauaagaaggccacauacgagccagauguugaucucggaagugggacccgcaacaucggaauugaaagugagacaccaaauuuagacauaauugggaaaagaauagaaaaaauaaaacaagagcaugaaacaucauggcacuaugaccaggaccacccauacaaaacgugggccuaccauggcagcuacgaaacaaaacagacuggaucagcaucauccauggugaacggaguaguuaggcugcuaacaaaaccuugggacgucaucccuauggugacacagauggcaaugacagacacgacuccauuuggacaacagcgcguuuucaaagaaaaaguggacacgagaacccaagaaccgaaagaaggcacgaaaaaacuaaugaaaaucacggcagaauggcucuggaaagaacuaggaaagaaaaagacaccuaggaugugcaccagagaagaauucacaagaaaggugagaagcaaugcagccuuaggugccauauucacugaugagaacaaguggaagucggcacgugaggcuguugaagacaguggauuuugggaauugguugacaaggaaaggaaucuccaucuugaaggaaagugugagacauguguguauaacaugaugggaaagagagagaagaagcuaggggaguucgguaaagcaaaaggcagcagagcuauaugguacauguggcuuggagcacgcuucuuagaguucgaagcccuaggauuuuugaaugaagaccacugguuuuccagagagaacucccugaguggaguggaaggagaagggcugcacaaacuaggcuacauuuuaagagacgugaguaagaaagaaggaggagcaauguacgccgaugacaccgcaggaugggacacaagaaucacacuagaggacuuaaaaaaugaagaaauggugacaaaccacauggaaggagaacacaggaaacuugcugaagcuaucuucagauuaacguaccaaaacaagguggugcgugugcaaagaccgacaccaagaggcacaguaauggacauuauaucgagaagagaccaaagagguaguggacaaguugucacuuacggccucaauacuuucaccaacauggaagcccaacugaucagacagauggagggagaaggagucuucaaaagcauccaacaccugacagucacagaagaaauugcagugaaaaacugguuagaaagaguggggcgugagagguuaucaagaauggccaucaguggagaugauuguguugugaaacccuuagaugacagguuugcaagcgcucuaacagcucuaaaugacaugggaaagguuaggaaagacauacaacaaugggaaccuucaagaggauggaacgauuggacacaagugcccuuuuguucacaccauuuccaugaguuaaucaugaaagacggucguguacuuguaguuccaugcagaaaccaagaugaacugauugguagggcccgaauuucccagggagccgggugguccuugcgggaaacagccuguuuggggaagucuuacgcccaaauguggagccugauguacuuccacaggcgugaccuuaggcuggcggcaaaugccauuugcucggcagucccaucacauuggguuccaauaagucgaacaaccugguccauacacgccacacaugaguggaugacaacagaagacaugcugacagucuggaacaggguguggauucaagaaaauccauggauggaagacaaaacuccaguagaaucaugggaggaaaucccauaucuggggaaaagagaagaccaauggugcggcucauugauugggcuaacaagcagggccaccugggcaaagaacauccaaacagcaauaaaucaaguuagaucccuaauaggcaaugaggaauacacagacuacaugccauccaugaaaagauucagaagagaagaggaagaggcaggagucuugugguaa

SEQ ID NO: 6431 - RNA, 9876 nt, Artificial Sequence
  derived and/or modified CDS sequence (wt) from DENV-2__KX380838__SS-prME
acugcagguauaauuauuaugaugauuccaacagugauggcguuccauuuaaccacacgcaauggagaaccacacaugaucgucaguagacaagaaaaagggaaaagucuucuguuuaaaacagagaacggugugaacauguguacccucauggccauggaccuuggugaacugugugaagacacaaucacuuauaauuguccucuucucaggcagaaugaaccagaagacauagacuguuggugcaacucuacgucuacauggguaacuuaugggacaugcaccgcuacaggagaacacagaagggaaaaaagaucaguggcacucguuccgcacgugggaaugggacuggagacacgaacugaaacauggaugucaucagaaggggccuggaaacaugcgcagagaauugaaacuugggucuugagacauccaggcuucacuguaauggcagcaauccuggcauacaccauaggaacgacauauuuccaaagaguccugauuuucaucuuacugacagcugucgcuccuucaaugacaaugcguuguauaggaauaucaaauagagacuuuguggaagggguuucaggaggaagcuggguugacauagucuuggaacauggaagcugugugacaacgauggcgaaaaauaaaccaacauuggauuuugaacugauaaaaacagaagccaaacaucccgccacucuaaggaaguauuguauagaggcaaagcugaccaacacaacaacagcaucucgcugcccaacacaaggagaaccuagccuaaaugaagaacaggacaaaagauuugucugcaaacacuccaugguagacagaggauggggaaauggaugcggauuauuuggaaagggagguaucgugaccugugcaauguucacaugcaaaaagaacauggaaggaaaaaucgugcaaccagaaaauuuggaauacaccauugugauaacaccucacucaggggaagagaaugcagucggaaaugauacaggaaaacacggcaaggaaauuaaagugacaccacagagcuccaucacagaagcagaacuaaccggcuauggcacugccacgauggaaugcucuccgagaacgggccucgacuucaaugagaugguguugcugcaaauggaaaacaaggcuuggcuagugcacaggcaaugguucuuagaccugccguuaccauggcugcccggagcagacacacaaggaucaaauuggauacagaaggagacauuggucacuuucaaaaauccccaugcaaagaaacaggauguuguuguguuaggaucccaagaaggggcuaugcacacagcacucacaggggccacggaaauccagaugucaucaggaaacuuacuguucacaggacaucuuaaaugcaggcugagaauggacaaacuacagcucaaaggaaugucauauuccauguguacaggaaaguucaaaguugugaaggaaauagcagaaacacaacauggaacaauaguuaucagaguacaauaugaaggggacgguucuccgugcaaaaucccuuuugaaauaauggauuuggaaaaaagacaugucuuaggucgcuugaucacagucaacccaauugucacagaaaaagacagcccagucaacauagaagcagaaccuccauucggagacagcuacaucauuauaggaguagaaccggggcaacugaagcucagcugguuuaagaaaggaaguucuauuggccaaauguuugagacaacaaugagaggagcgaagagaauggccauuuuaggugacacagcuugggauuuuggaucucugggaggaguguuuacaucuauaggaaaggcccuccaccaagucuuuggagcaaucuauggggcugccuucagugggguuucauggacuaugaaaauccucauaggaguugucaucacauggauaggaaugaauucacgcagcaccucacugucugugucacuaguauuagugggaaucgugacacuguauuugggaguuauggugcaggcugauaguggcugcguugugagcuggaaaaacaaagaacugaaauguggcagugggaucuuuaucacagacaacgugcacacauggacagaacaauacaaauuccaaccagaauccccuucaaaacuggcuucagcuauccagaaggcccaugaagagggcauuuguggaauccgcucaguaacaagacuggagaaucugauguggaaacaaauaacaccagaacugaaucacauucuaucagaaaaugagguaaaguugacuaucaugacaggagacauuaaaggaaucaugcaggcaggaaaacgaucccugcgaccucaacccacugagcugaaguacucuuggaaagcauggggcaaagcgaaaaugcucuccacagagcuccacaaccacaccuuucucauugauggccccgaaacagcagaaugucccaacacaaacagagcuuggaacucacuagaaguugaagacuauggcuuuggaguauucacuaccaacauauggcugaaauugaaagaaaggcaggauguauuuugugacucaaaacucaugucagcagccauaaaagacaacagagccguccacgccgauauggguuauuggauagaaagcgcacucaacgacacauggaagauugagaaagccucuuuuauugaaguuaaaagcugccacuggccaaagucacacacucucuggagcaauggagugcuagaaagugagaugauaauuccaaagaauuuugcaggaccagugucacaacacaauuacagaccaggcuaucauacacaaacggcaggacccuggcaucuaggcaggcuugagauggacuuugacuucugcgaaggaaccacagugguggugacugaggacuguggaaauagaggacccucuuuaagaacaacuacugcuucuggaaaacucauaacagaauggugcugccgaucuugcacauuaccaccgcuaagguacagaggugaggauggaugcugguauggaauggaaaucagaccauugaaagagaaagaagagaacuuggucaacucuuuggucacagccggacauggacagauugacaacuucucacuaggagucuugggaauggcauuguuccuggaagagaugcucaggacucgaguaggaacgaaacaugcaauauuauuaguugcagucucuuucgugacauugaucacagggaacauguccuuucgagauuuggggagagugauggucauggugggcgcuacuaugacggaugacauaggcaugggcgugacuuaucuugcccuauuagcagccuucaaagucagaccaacuuuugcagcuggacuacucuuaagaaagcugaccuccaaggaauugaugaugaccaccauaggaauuguacuccucucucagagcaccauaccagagacuauacuugaacugacugacgcguuggcuuuggggaugaugguucucaaaauaguaagaaacauggaaaaguaucaacuagcagugacuaucauggcuacccugugcgucccaaaugcagugauauuacaaaacgcauggaaagugagcugcacgauacuggcagugguguccgucuccccacugcuuuuaacauccucacagcagaaagcggauuggauaccacuggcguugacaaucaaaggccucaauccaacagccauuuucuuaacaacccucucaagaacuagcaagaaaaggagcuggccacuaaaugaggcuauuauggcagucgggauggugagcauuuuagccaguucucucuuaaagaaugauauucccaugacaggaccauuaguggcuggagggcuucucacuguguguuacgugcucacuggaagaucggcugauuuggaacuggaaagagcugcugacguaagaugggaggaacaggcagagauaucagggagcaguccaauucugucgauaacaauaucggaagaugguaguaugucgauaaaaaaugaagaagaagaacaaacacugaccauacuuauuagaacaggacugcuggugauaucaggacuuuuucccgugucaauaccaaucacggcagcugcaugguaccugugggaagugaaaaaacaacgagccggaguauugugggacgucccuucaccuccaccugugggaaaagccgaacuggaagauggagccuauagaaucaagcagaaagggauuuuaggauacucgcagauuggagccggaguuuacaaagaaggaacauuccacacaauguggcaugucacacguggugcuguucuaaugcacaaagggaagaggauugaaccaucaugggcggacgucaagaaagacuuaauaucguauggaggaggcuggaagcuagaaggagaauggaaggaaggagaagaaguccagguccuggcacuagagccuggaaagaauccaagagccguccaaacaaaacccggucuuuuuaaaacuaacacuggaaccauaggcgccguaucucuggacuuuucuccuggaacgucaggaucuccaauugucgacaaaaaaggaaaaguugugggccuuuauggcaacggugucgucacaaggagugggacauaugugagcgccauagcccagacugaaaaaagcaucgaagacaauccagagauugaagaugacaucuuucgaaagaaaagauugaccaucauggaccuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagcuaucagagcugagcacacuggacgggagauuguggaucuaaugugucacgccacauucaccaugaggcuacuaucaccaaucagagugccaaauuacaaccugauuaucauggaugaagcccauuuuacagacccagcaagcauagcagcuagaggauacauuucaacucgaguagagaugggugaagcagcugggauuuucaugacagccaccccuccuggaagcagagacccauuuccucagagcaacgcaccaaucauggaugaagaaagggaaaucccugagcguucguggaacucuggacaugaguggguuacggauuuuaaagggaagacuguuugguuuguuccaaguauaaaagcaggaaaugauauagcagcuugccugagaaagaauggaaagaaagugauacaacucagcaggaagaccuuugauucugaauauaucaagacuaggaccaaugauugggacuuuguggucacgacagacauuucagaaaugggugccaacuucaaggcugagaggguuauagaccccagacgcugcaugaaaccagucauacuaacagacggugaagagcgagugaucuuggcaggacccaugccagugacccacucuagugcagcacaaagaagagggagaguaggaagaaauccaaaaaaugaaaaugaccaguacauauacaugggggaaccucuggaaaaugaugaagacugugcgcacuggaaagaagcuaagaugcuucuagauaacaucaacacgccugaaggaaucauucccagcauguucgaaccagagcgugaaaagguggaugccauugauggugaauaccgcuugagaggagaagcgaggaaaacauuuguggaccuaaugagaagaggagaccuaccagucuggcuagccuacagaguggcagcugaagguaucaacuacgcagacagaagauggugcuuugauggagucaagaacaaccaaauccuggaagaaaauguggaaguggaaauuuggacaaaagaaggagaaaggaagaaauuaaaacccagaugguuagaugccaggaucuacucugacccacuggcgcucaaagaauucaaggaauucgcagcuggaagaaaaucccugaccuugaaucuaaucaccgagauggguaggcucccaaccuucaugacccagaaagcaagaaaugcauuggacaacuuagcaguccuacauacggcugaagcaggcggaagggcguacaaucaugcucuuagugaacugccggagacucuggagacauugcuuuuacugacacucuuggccacagucacggguggaaucuuccuguucuugaugagcggaaaggguauagggaaaaugacccugggaaugugcugcauaaucacggccaguauucuccuaugguaugcucaaauacagccacacuggauagcagcuucaauaauacuggaguuuuuucucauagucuugcucauuccagaaccagagaagcagagaacaccccaagauaaccaauuaacuuauguugucauagccauccuuacagugguggccgcaaccauggcaaacgagauggguuuccuggaaaagacaaagaaagauuucggauugggaagcauuacaacccagcaaccugacagcaacauccuggacauagaucuacguccugcaucagcuuggacucuauaugccguggcaacaacuuucaucacaccaauguugagacacagcauugaaaauuccucagugaaugugucucuaacagccauugcuaaccaggccacaguguuaaugggucuugggaaaggauggccauugucaaaaauggacaucggaguuccccuucucgcuaucggaugcuauucacaagucaaccccauaacucucacagcagcccuucucuuauugguagcacacuaugcuaucauagggccaggacuccaagcgaaagcaacuagagaggcucagaaaagagcagcagcggguaucaugaaaaucccagcugccgauggaauaacagugauugaccuagauccaauacccuaugauccaaaguuugagaagcaguugggacaaguaaugcucuuaguccucugcgugacucaaguauugaugaugaggacuacaugggcuuuaugugaagcucuaaccuuagcgaccgggcccaucucuacacugugggaaggaaauccagggagauuuuggaauacaacuauugcagugucaauggcuaacauuuuuagagggaguuaccuagccggagccggacuucucuuuucuaucaugaagaacacggccaacacaagaaggggaacuggcaacacaggagagacgcuuggagagaaauggaaaaaccgguuaaaugcauuggggaagagugaauuccagaucuauaagaaaaguggaauccaggaaguggauagaaccuuagcaaaagaaggcaucaaaaggggagaaacggaccaucacgcugugucgcgaggcucggcgaaacugagaugguucgucgagagaaaccuggucacaccagaagggaaaguaguggaccuuggcugcggcagggggggcuggucauacuauugugggggacuaaagaauguaaaagaagucaaaggccuaacaaaaggaggaccaggacaugaagagcccauucccaugucaacauaugguuggaaucuggugcgucuucaaaguggaguugaugucuuuuuuacuccgccagagaagugugacacauugcugugugacauaggggagucgucaccaaaccccacgguugaggcaggacgaacacucagaguucuaaacuuaguggaaaacuggcugaacaacaacacccaauuuugcauaaagguucucaacccauauaugccuucaguuauagaaaaaauggaagcgcuacaaaggaaauacggaggagcuuuggugaggaauccacucucacgaaauuccacacacgagauguacuggguauccaaugcuuccgggaacauagugucaucagugaacaugauuucaagaauguugauuaacagauucacaaugaaacauaagaaggccacauacgagccagauguugaucucggaagugggacccgcaacaucggaauugaaagugagacaccaaauuuagacauaauugggaaaagaauagaaaaaauaaaacaagagcaugaaacaucauggcacuaugaccaggaccacccauacaaaacgugggccuaccauggcagcuacgaaacaaaacagacuggaucagcaucauccauggugaacggaguaguuaggcugcuaacaaaaccuugggacgucaucccuauggugacacagauggcaaugacagacacgacuccauuuggacaacagcgcguuuucaaagaaaaaguggacacgagaacccaagaaccgaaagaaggcacgaaaaaacuaaugaaaaucacggcagaauggcucuggaaagaacuaggaaagaaaaagacaccuaggaugugcaccagagaagaauucacaagaaaggugagaagcaaugcagccuuaggugccauauucacugaugagaacaaguggaagucggcacgugaggcuguugaagacaguggauuuugggaauugguugacaaggaaaggaaucuccaucuugaaggaaagugugagacauguguguauaacaugaugggaaagagagagaagaagcuaggggaguucgguaaagcaaaaggcagcagagcuauaugguacauguggcuuggagcacgcuucuuagaguucgaagcccuaggauuuuugaaugaagaccacugguuuuccagagagaacucccugaguggaguggaaggagaagggcugcacaaacuaggcuacauuuuaagagacgugaguaagaaagaaggaggagcaauguacgccgaugacaccgcaggaugggacacaagaaucacacuagaggacuuaaaaaaugaagaaauggugacaaaccacauggaaggagaacacaggaaacuugcugaagcuauuuucagauuaacguaccaaaacaagguggugcgugugcaaagaccgacaccaagaggcacaguaauggacauuauaucgagaagagaccaaagagguaguggacaaguugucacuuacggccucaauacuuucaccaacauggaagcccaacugaucagacagauggagggagaaggagucuucaaaagcauccaacaccugacagucacagaagaaauugcagugaaaaacugguuagaaagaguggggcgugagagguuaucaagaauggccaucaguggagaugauuguguugugaaacccuuagaugacagguuugcaagcgcucuaacagcucuaaaugacaugggaaagguuaggaaagacauacaacaaugggaaccuucaagaggauggaacgauuggacacaagugcccuuuuguucacaccauuuccaugaguuaaucaugaaagacggucguguacuuguaguuccaugcagaaaccaagaugaacugauugguagggcccgaauuucccagggagccgggugguccuugcgggaaacagccuguuuggggaagucuuacgcccaaauguggagccugauguacuuccacaggcgugaccuuagacuggcggcaaaugccauuugcucggcagucccaucacauuggguuccaauaagucgaacaaccugguccauacacgccacacaugaguggaugacaacagaagacaugcugacagucuggaacaggguguggauucaagaaaauccauggauggaagacaaaacuccaguagaaucaugggaggaaaucccauaucuggggaaaagagaagaccaauggugcggcucauugauugggcuaacaagcagggccaccugggcaaagaacauccaaacagcaauaaaucaaguuagaucccuaauaggcaaugaggaauacacagacuacaugccauccaugaaaagauucagaagagaagaggaagaggcaggagucuugugguaa

SEQ ID NO: 6432 - RNA, 9876 nt, Artificial Sequence
  derived and/or modified CDS sequence (wt) from DENV-2__KM279515__SS-prME
acugcagguauaauuauuaugaugaucccaacagugauggcguuccauuuaaccacacgcaacggagaaccacacaugaucguuaguagacaagagaaagggaaaagucuccuguuuaaaacagagaacggugugaacauguguacccucauggccauggaccuuggugaacugugugaagacacaaucacuuauaauuguccucuucucaggcagaaugaaccagaagacauagacuguuggugcaacuccacgucuacauggguaacuuaugggacaugcaccgccacaggagaacacagaagggaaaaaagaucaguggcacucguuccacaugugggaaugggacuggagacacgaacugaaacauggaugucaucagaaggggccuggaaacaugcccagagaauugaaacuuggaucuugagacauccaggcuucaccauaauggcagcaauccuggcauacaccauaggaacaacauauuuccaaagaguccugauuuucauuuuacugacagcugucacuccuucaauggcaaugcguuguauaggaauaucaaauagagacuuuguggaagggguuucaggaggaagcuggguugauauagucuuggaacauggaagcugugugacgacgauggcgaaaaauaaaccaacguuggauuuugaacugauaaaaacagaagccaaacaucucgccacucuaaggaaguauuguguagaggcaaagcugaccaacacaacaacagcaucucgcugcccaacacaaggagaaccuagccuaaacgaagaacaggacaaaagauucgucugcaaacacuccaugguagacagaggauggggaaauggaugcggauuauuuggaaagggaggcaucgugaccugugcaauguucacaugcaaaaagaacauggaaggaaaagucgugcaaccagaaaacuuggaguacaccaucgugauaacaccucacucaggggaagagaaugcagucggaaaugacacaggaaaacauggcaaggaaauuaaaguaacaccacagaguuccaucacagaagcagaacuaacaggcuacggcacugucacgauggaaugcucuccgagaacgggccucgacuucaaugagaugguguugcugcaaauggaaaacaaggcuuggcuggugcacaggcaaugguucuuagaccugccguuaccauggcugcccggagcagacacacaaggaucaaacuggauacagaaggagacacuggucacuuucaaaaauccccaugcaaagaaacaggauguuguuguuuuagguucccaagaaggggccaugcacacggcacucacaggggccacggaaauccagaugucaucaggaaacuuacuguucacaggacaucuuaagugcaggcugagaauggacaaacuacagcucaaaggaaugucauauuccauguguacaggaaaguucaaaguugugaaggaaauagcagaaacacaacauggaacaauaguuauuagaguacaauaugaaggggacgguuccccgugcaagaucccuuuugaaauaauggacuuggaaaaaaggcaugccuuaggucgcuugauuaccgucaacccaauugucacagaaaaagacagcccagucaacauagaagcagaaccuccauuuggagacaguuacaucauuauaggaguagaaccaggacaacugaagcucagcugguuuaagaaaggaaguucuauuggccaaauguuugagacaacaaugagaggagcgaagagaauggccauucuaggugacacagcuugggauuuuggaucccugggaggaguguucacaucuauaggaaaggcccuccaccaagucuuuggagcuaucuauggggcugccuucagugggguuucauggacuaugaaaauccucauaggagucgucaucacauggauaggaaugaauucacgcagcaccucacugucugugucacuaguauuagugggggucgugacauuguauuugggaguuauggugcaggccgauagugggugcguugugaguuggaaaaacaaagaacugaaaugugguagugggauuuuuaucacagacaacgugcacacauggacagaacaauacaaauuccaaccagaauccccuucaaagcuggcuucagcuauccagaaggcucaugaagaaggcauuuguggaauccgcucaguaacaagacuggagaaucugauguggaaacaaauaacaccagaauugaaucacauucuaacagaaaaugaaguaaaguugacuaucaugacaggagacaucaaaggaaucaugcaggcaggaaaacgaucccugcggccucaacccacugagcugaaguacuccuggaaggcauggggcaaagcgaaaaugcuuuccacagagcuucauaaccacaccuuucucauugauggccccgaaacagcagaaugucccaacacaaacagagcuuggaacucacuagaaguugaagacuauggcuuuggaguauucaccacuaacauauggcugaaauugaaagaaaggcaggauguguuuugugacucaaaacucaugucagcagccauaaaggacaauagagccguccacgccgauauggguuauuggauagaaagcgcacucaaugacacauggaagauugagaaagccucuuuuauugaaguuaaaagcugccacuggccaaagucacacacucucuggaguaauggagugcuggaaagugagaugauaauuccaaagaauuuugcaggaccaguuucacaacacaauuacagaccaggcuaccacacacaaacggcaggacccuggcaucuagguaggcuugagauggacuuugauuucugcgaaggaaccacagugguggugacugaggacuguggaaauagaggacccuccuuaagaacaacuacugcuucuggaaaacucauaacagaguggugcugccgaucuugcacauuaccaccgcuaagguacagaggugaggauggaugcugguaugguauggaaaucaggccauugaaagagaaagaagagaaccuggucaacucuuuggucacagccggacauggacagauugacaacuucucacuaggagucuugggaauggcauuguuccuggaagagaugcucaggacucgaguaggaacgaaacaugcaauauuacuaguugcagucucuuucgugacauugaucacagggaacauguccuuucgagauuuggggagagugauggucauggugggcgcuacuaugacggaugacauaggcaugggcgugacuuaucuugcccuauuagcagccuuuaaagucagaccaaccuuugcggcuggacuacucuuaagaaagcugaccuccaaggaauugaugaugaccaccauaggaaucguacuccucucucagaguaccauaccagagagcauacuugaacugacugacgcguuggcuuuggggaugaugguucucaaaauagugagaaacauggaaaaguaucagcuagcagugacuaucauggcaaucuugugcgucccaaaugcagugauauugcaaaaugcauggaaagugagcugcacaacacuggcagugguguccguuuccccacugcuuuuaacauccucacagcagaaagcggauuggauaccacuggcguugacgaucaaaggccucaauccaacagccauuuucuuaacaacucucucaagaacuagcaagaaaaggagcuggccacuaaaugaggcuauuauggcagucgggauggugagcauucuagcuaguucucucuuaaagaaugauauucccaugacaggaccauuaguggcuggagggcuucucacuguguguuacgugcucacuggaaggucggcugacuuggaacuggaaagagcugcugacguaagaugggaagaacaggcagagauaucaggaaguaguccaauucugucgauaacaauaucggaagaugguagcaugucgauaaagaaugaagaagaagaacagacacugaccauacucaucagaacaggacuacuggugauaucaggacuuuuuccugugucaauaccaaucacggcagcugcaugguaccuuugggaagugaaaaaacaacgagcaggaguauugugggaugucccuucacccccaccugugggaaaggccgaacuggaagauggagccuauagaaucaagcagaaagggauccuaggauacucacagauuggagccggaguuuacaaagaaggaacauuccacacaauguggcaugucacacguggugcuguccuaaugcauaaagggaagagaauugaaccaucaugggcggacgucaagaaagaccuaauaucguauggaggaggcuggaagcuggaaggagaauggaaggaaggagaagaaguccagguccuggcauuagagccuggaaagaauccaagagccguccaaacaaaacccggucuuuuuaaaaccaacacuggaaccauaggcgccgugucucuggacuuuucuccuggaacgucaggaucuccaaucgucgauaaaaaaggaaaaguugugggccuuuauggcaacggugucgucacaaggaguggaacauaugugagugccauagcccagacugaaaaaagcaucgaagacaauccagagauugaagaugacaucuuuagaaagaaaagauugaccaucauggaccuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagcuaucagagcugagcacacugggcgggagauuguggaucuaaugugucaugccacauuuaccaugaggcuauuaucaccaauuagagugccaaauuacaaccugaucaucauggaugaagcccauuucacagacccagcaagcauagcagcuagaggauacauuucaacucgaguagagaugggugaagcagcugggauuuucaugacagccaccccuccuggaagcagagacccauuuccccagagcaacgcaccaaucauggaugaagaaagagaaaucccugagcguucguggaacucuggacaugaguggguuacggauuuuaaagggaagacuguuugguuuguuccaaguauaaaagcagggaaugauauagcagcuugccugagaaagaauggaaagaaagugauacaacucagcaggaaaacuuuugauucugaauauaucaagacuaggaccaaugauugggacuuuguggucacgacagacauuucagaaaugggugcuaacuucaaggcugagaggguuauagaccccagacgcugcaugaaaccagucauauuaacagacggugaagagcgggugaucuuggcaggacccaugccagugacccauucuagugcagcacaaagaagagggagaguaggaagaaauccaaaaaaugaaaaugaccaguacauauacaugggggaaccucuggaaaaugaugaagacugugcacacuggaaagaagcuaagaugcucuuggauaacaucaacacgccugaaggaaucauucccagcauguucgaaccagagcgugaaaagguggaugccauugauggugaauaccgcuugagaggagaagcgaggaaaacuuuuguggaccuaaugagaagaggagauuuaccagucuggcuagccuacagaguggcggcugaaggcaucaacuacgcagacagaagauggugcuuugauggagucaagaacaaccaaaucuuggaagaaaauguggaaguagaaauuuggacaaaagaaggagaaaggaagaaauuaaaacccagaugguuggaugcuaggaucuacucugacccauuggcgcucaaagaauucaaggaauucgcagcuggaagaaagucccugacccugaaucuaaucacagagauggguagacucccaaccuucaugacccagaaagcaaagaaugcacucgacaacuuagcaguccugcauacggcugaagcaggcggaagggcguacaaucaugcucuuagugaacugccggagacucuggagacauugcuuuuacugacacuuuuggccacagucacgggcggaaucuuccuguucuugaugagcggaaaggguauagggaagaugacccugggaaugugcugcauaaucacggcuaguauccucuuaugguaugcacaaauacagccacacuggauagcagcuucaauaauacuggaguuuuuucucauagucuugcucauuccagaaccagaaaaacagagaacaccccaagauaaccaguuaacuuauguugucauagccauccuuacaguaguggccgcaaccauggcaaacgagauggguuuccuggaaaaaacaaagaaagauuucggauugggaagcauuacaacccagcaaccugagaguaacauccuggacauagaucuacguccugcaucagcuuggacucuauaugccguggcaacaacuuucauuacaccaauguugaggcauagcauugaaaacuccucagugaaugugucccuaacagccauugccaaccaagccacaguguuaaugggucuugggaaaggauggccauugucaaaaauggacaucggaguuccccuucucgcuaucgggugcuauucacaagucaaccccauaacucucacugcagcccuucucuuauugguagcccauuaugccaucauagggccaggacuccaagcgaaagcaacuagagaggcucagaaaagagcagcagcgggcaucaugaaaaacccaacuguggauggaaugacagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcaaccgggcccaucucuacacugugggaaggaaauccagggagauuuuggaauacaacuauugcagugucaauggcuaacauuuuuagagggaguuaccuggccggagccggacuucucuuuucuaucaugaaaaacacggccaacacaagaaggggaacuggcaacacaggagagacgcuuggggagaaauggaaaaaccgguugaaugcauuagggaagagugaauuccagaucuacaagaaaaguggaauccaggaaguggacagaaccuuagcaaaagaaggcaucaaaagaggagaaacggaccaucacgcugugucgcgaggcucagcgaaacugagaugguucgucgagagaaaccuggucacaccagaagggaaaguaguggaccuuggcugcggcagggggggcuggucauacuauugugggggacuaaagaauguaaaagaagucaaaggccuaacaaaaggaggaccaggacacgaagaacccauucccaugucaacauaugguuggaaucuggugcgccuucaaaguggaguugauguuuuuuucacuccgccagaaaagugugacacacugcugugugacauaggggagucgucaccaaaccccacgguugaggcaggacgaacacucagaguucuaaacuuaguggaaaauuggcugaacaacaacacccaauuuugcauaaagguucuuaacccauacaugcccucaguuauagaaaaaauggaagcacuacaaaggaaauacggaggagcuuuggugaggaauccacucucacgaaauuccacacacgagauguacuggguauccaaugcuuccgggaauauagugucaucagugaacaugauuucaagaauguugauuaacagauucacaaugagacacaagaaagccacauacgagccagauguugaccucggaaguggaacccgcaacaucggaauugaaagugagacaccaaauuuagacauaauugggaaaagaauagaaaaaauaaaacaagagcaugaaacaucauggcacuaugaccaagaccacccauacaaaacgugggccuaccauggcagcuacgaaacaaaacagacuggaucagcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccgaaagaaggcacgaaaaaacuaaugaaaauuacugcagaauggcucuggaaagaacuaggaaagaaaaagacaccuaggaugugcaccagagaagaauucacaagaaaggugagaagcaaugcagccuuaggcgccauauucacugaugagaacaaguggaagucggcacgugaggcuguugaagacaguggauuuugggaauugguugacaaggaaaggaaucuccaucuugaaggaaagugugaaacauguguguauaacaugaugggaaagagagagaagaagcuaggggaguucggcaaagcaaaaggcagcagagccauaugguacauguggcuuggagcacgcuucuuagaguuugaagcucuaggauucuugaacgaagaucacugguuuuccagagagaacucccugaguggaguggaaggagaagggcuacacaagcuaggcuacauuuuaagagacgugaguaagaaagaaggaggagcaauguaugcugaugacaccgcaggaugggacacaagaaucacacuagaggacuuaaaaaaugaagaaauggugacaaaccacauggaaggagaacacaagaaacuugcugaagccauuuucaaauuaacguaccaaaacaagguggugcgugugcaaagaccaacaccaagaggcacaguaauggacauuauaucgagaagagaccaaagagguaguggacaaguugucaccuacggccucaauacuuucaccaauauggaagcccaacugaucagacagauggagggagaaggaguuuucaaaagcauccagcaacugacaguaaaagaagaaauugcagugaaaaacugguuaauaagaguggggcgugagagguuaucaagaauggccaucaguggagaugauuguguugugaaacccuuagaugacagguuugcaagugcucuaacagcucuaaaugacaugggaaagguuaggaaagacauacaacaaugggaaccuucaagaggauggaacgauuggacacaagugcccuuuuguucacaccauuuccaugaguuaaucaugaaggacggucgugugcucguaguuccaugcagaaaccaagaugaacugauuggcagggcccgaauuucccagggagccgggugguccuugcgggaaacagccugucuggggaaguccuacgcccaaauguggagccugauguacuuccacagacgugaccuuaggcuggcggcaaaugccauuugcucggcagucccaucacauuggauuccaacaagucgaacaaccugguccauacacgccacacaugaguggaugacaacagaagacauguugacagucuggaacaggguguggauucaagaaaacccauggauggaagacaaaacuccaguagaaacaugggaggaaaucccguauuuggggaaaagagaagaccaauggugcggcucauugauugggcuaacaagcagggccaccugggcaaagaacauccaaacagcaauaaaucaaguuagaucccuaauaggcaaugaggaauacacagacuacaugccaucuaugaaaagauucagaagagaagaggaagaggcaggagucuugugguag

SEQ ID NO: 6433 - RNA, 9876 nt, Artificial Sequence
  derived and/or modified CDS sequence (wt) from DENV-2__KM279516__SS-prME
acugcagguauaauuauuaugaugaucccaacagugauggcguuccauuuaaccacacgcaacggagaaccacacaugaucguuaguagacaagagaaagggaaaagucuccuguuuaaaacagagaacggugugaacauguguacccucauggccauggaccuuggugaacugugugaagacacaaucacuuauaauuguccucuucucaggcagaaugaaccagaagacauagacuguuggugcaacuccacgucuacauggguaacuuaugggacaugcaccgccacaggagaacacagaagggaaaaaagaucaguggcacucguuccacaugugggaaugggacuggagacacgaacugaaacauggaugucaucagaaggggccuggaaacaugcccagagaauugaaacuuggaucuugagacauccaggcuucaccauaauggcagcaauccuggcauacaccauaggaacaacauauuuccaaagaguccugauuuucauuuuacugacagcugucacuccuucaauggcaaugcguugcauaggaauaucaaauagagacuuuguggaagggguuucaggaggaagcuggguugauauagucuuggaacauggaagcugugugacgacgauggcgaaaaauaaaccaacguuggauuuugaacugauaaaaacagaagccaaacaucucgccacucuaaggaaguauuguguagaggcaaagcugaccaacacaacaacagcaucucgcugcccaacacaaggagaaccuagccuaaacgaagaacaggacaaaagauucgucugcaaacacuccaugguagacagaggauggggaaauggaugcggauuauuuggaaagggaggcaucgugaccugugcaauguucacaugcaaaaagaacauggaaggaaaagucgugcaaccagaaaacuuggaguacaccaucgugauaacaccucacucaggggaagagaaugcagucggaaaugacacaggaaaacauggcaaggaaauuaaaguaacaccacagaguuccaucacagaagcagaacuaacgggcuacggcacugucacgauggaaugcucuccgagaacgggccucgacuucaaugagaugguguugcugcaaauggaaaacaaggcuuggcuggugcacaggcaaugguucuuagaccugccguuaccauggcugcccggagcagacacacaaggaucaaauuggauacagaaggagacacuggucacuuucaaaaauccccaugcaaagaaacaggauguuguuguuuuagguucccaagaaggggccaugcacacggcacucacaggggccacggaaauccagaugucaucaggaaacuuacuguucacaggacaucuuaagugcaggcugagaauggacaaacuacagcucaaaggaaugucauauuccauguguacaggaaaguucaaaguugugaaggaaauagcagaaacacaacauggaacaauaguuauuagaguacaauaugaaggggacgguuccccgugcaagaucccuuuugaaauaauggacuuggaaaaaaggcaugucuuaggucgcuugauuaccgucaacccaauugucacagaaaaagacagcccagucaacauagaagcagaaccuccauuuggagacaguuacaucauuauaggaguagaaccaggacaacugaagcucagcugguuuaagaaaggaaguucuauuggccaaauguuugagacaacaaugagaggagcgaagagaauggccauucuaggugacacagcuugggauuuuggaucccugggaggaguguucacaucuauaggaaaggcccuccaccaagucuuuggagcuaucuauggggcugccuucagugggguuucauggacuaugaaaauccucauaggagucgucaucacauggauaggaaugaauucacgcagcaccucacugucugugucacuaguauuagugggggucgugacauuguauuugggaguuauggugcaggccgauagugggugcguugucaguuggaaaaacaaagaacugaaaugugguagugggauuuuuaucacagacaacgugcacacauggacagaacaauacaaauuccaaccagaauccccuucaaagcuggcuucagcuauccagaaggcucaugaagaaggcauuuguggaauccgcucaguaacaagacuggagaaucugauguggaaacaaauaacaccagaauugaaucacauucuaacagaaaaugaaguaaaguugacuaucaugacaggagacaucaaaggaaucaugcaggcaggaaaacgaucccugcggccucaacccacugagcugaaguacuccuggaaggcauggggcaaagcgaaaaugcuuuccacagagcuucauaaccacaccuuucucauugauggccccgaaacagcagaaugucccaacacaaacagagcuuggaacucacuagaaguugaagacuauggcuuuggaguauucaccacuaacauauggcugaaauugaaagaaaggcaggauguguuuugugacucaaaacucaugucagcagccauaaaggacaauagagccguccacgccgauauggguuauuggauagaaagcgcacucaaugacacauggaagauugagaaagccucuuuuauugaaguuaaaagcugccacuggccaaagucacacacucucuggaguaauggagugcuggaaagugagaugauaauuccaaagaauuuugcaggaccaguuucacaacacaauuacagaccaggcuaccacacacaaacggcaggacccuggcaucuagguaggcuugagauggacuuugauuucugcgaaggaaccacagugguggugacugaggacuguggaaauagaggacccuccuuaagaacaacuacugcuucuggaaaacucauaacagaguggugcugccgaucuugcacauuaccaccgcuaagguacagaggugaggauggaugcugguaugguauggaaaucaggccauugaaagagaaagaagagaaccuggucaacucuuuggucacagccggacauggacagauugacaacuucucacuaggagucuugggaauggcauuguuccuggaagagaugcucaggacucgaguaggaacgaaacaugcaauauuacuaguugcagucucuuucgugacauugaucacagggaacauguccuuucgagauuuggggagagugauggucauggugggcgcuacuaugacggaugacauaggcaugggcgugacuuaucuugcccuauuagcagccuuuaaagucagaccaaccuuugcggcuggacuacucuuaagaaagcugaccuccaaggaauugaugaugaccaccauaggaaucguacuccucucucagaguaccauaccagagaacauacuugaacugacugacgcguuggcuuuggggaugaugguucucaaaauagugagaaacauggaaaaguaucagcuagcagugacuaucauggcaaucuugugcgucccaaaugcagugauauugcaaaaugcauggaaagugagcugcacaacacuggcagugguguccguuuccccacugcuuuuaacauccucacagcagaaagcggauuggauaccacuggcguugacgaucaaaggccucaauccaacagccauuuucuuaacaacucucucaagaacuagcaagaaaaggagcuggccacuaaaugaggcuauuauggcagucgggauggugagcauucuagcuaguucucucuuaaagaaugauauucccaugacaggaccauuaguggcuggagggcuucucacuguguguuacgugcucacuggaaggucggcugacuuggaacuggaaagagcugcugacguaagaugggaagaacaggcagagauaucaggaaguaguccaauucugucgauaacaauaucggaagaugguagcaugucgauaaagaaugaagaagaagaacagacacugaccauacucaucagaacaggacuacuggugauaucaggacuuuuuccugugucaauaccaaucacggcagcugcaugguaccuuugggaagugaaaaaacaacgagcaggaguauugugggaugucccuucacccccaccugugggaaaggccgaacuggaagauggagccuauagaaucaagcagaaagggauccuaggauacucacagauuggagccggaguuuacaaagaaggaacauuccacacaauguggcaugucacacguggugcuguccuaaugcauaaagggaagagaauugaaccaucaugggcggacgucaagaaagaccuaauaucguauggaggaggcuggaagcuggaaggagaauggaaggaaggagaagaaguccagguccuggcauuagagccuggaaagaauccaagagccguccaaacaaaacccggucuuuuuaaaaccaacacuggaaccauaggcgccgugucucuggacuuuucuccuggaacgucaggaucuccaaucgucgauaaaaaaggaaaaguugugggccuuuauggcaacggugucgucacaaggaguggaacauaugugagugccauagcccagacugaaaaaagcaucgaagacaauccagagauugaagaugacaucuuuagaaagaaaagauugaccaucauggaccuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagcuaucagagcugagcacacugggcgggagauuguggaucuaaugugucaugccacauuuaccaugaggcuauuaucaccaauuagagugccaaauuacaaccugaucaucauggaugaagcccauuucacagacccagcaagcauagcagcuagaggauacauuucaacucgaguagagaugggugaagcagcugggauuuucaugacagccaccccuccuggaagcagagacccauuuccccagagcaacgcaccaaucauggaugaagaaagagaaaucccugagcguucguggaacucuggacaugaguggguuacggauuuuaaagggaagacuguuugguuuguuccaaguauaaaagcagggaaugauauagcagcuugccugagaaagaauggaaagaaagugauacaacucagcaggaaaacuuuugauucugaauauaucaagacuaggaccaaugauugggacuuuguggucacgacagacauuucagaaaugggugcuaacuucaaggcugagaggguuauagaccccagacgcugcaugaaaccagucauauuaacagacggugaagagcgggugaucuuggcaggacccaugccagugacccauucuagugcagcacaaagaagagggagaguaggaagaaauccaaaaaaugaaaaugaccaguacauauacaugggggaaccucuggaaaaugaugaagacugugcacacuggaaagaagcuaagaugcucuuggauaacaucaacacgccugaaggaaucauucccagcauguucgaaccagagcgugaaaagguggaugccauugauggugaauaccgcuugagaggagaagcgaggaaaacuuuuguggaccuaaugagaagaggagauuuaccagucuggcuagccuacagaguggcggcugaaggcaucaacuacgcagacagaagauggugcuuugauggagucaagaacaaccaaaucuuggaagaaaauguggaaguagaaauuuggacaaaagaaggagaaaggaagaaauuaaaacccagaugguuggaugcuaggaucuacucugacccauuggcgcucaaagaauucaaggaauucgcagcuggaagaaagucccugacccugaaucuaaucacagagauggguagacucccaaccuucaugacccagaaagcaaagaaugcacucgacaacuuagcaguccugcauacggcugaagcaggcggaagggcguacaaucaugcucuuagugaacugccggagacucuggagacauugcuuuuacugacacuuuuggccacagucacgggcggaaucuuccuguucuugaugagcggaaaggguauagggaagaugacccugggaaugugcugcauaaucacggcuaguauccucuuaugguaugcacaaauacagccacacuggauagcagcuucaauaauacuggaguuuuuucucauagucuugcucauuccagaaccagaaaaacagagaacaccccaagauaaccaguuaacuuauguugucauagccauccuuacaguaguggccgcaaccauggcaaacgagauggguuuccuggaaaaaacaaagaaagauuucggauugggaagcauuacaacccagcaaccugagaguaacauccuggacauagaucuacguccugcaucagcuuggacucuauaugccguggcaacaacuuucaucacaccaauguugaggcauagcauugaaaacuccucagugaaugugucccuaacagccauugccaaccaagccacaguguuaaugggucuugggaaaggauggccauugucaaaaauggacaucggaguuccccuucucgcuaucgggugcuauucacaagucaaccccauaacucucacugcagcccuucucuuauugguagcccauuaugccaucauagggccaggacuccaagcgaaagcaacuagagaggcucagaaaagagcagcagcgggcaucaugaaaaacccaacuguggauggaaugacagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcaaccgggcccaucucuacacugugggaaggaaauccagggagauuuuggaauacaacuauugcagugucaauggcuaacauuuuuagagggaguuaccuggccggagccggacuucucuuuucuaucaugaaaaacacggccaacacaagaaggggaacuggcaacacaggagagacgcuuggggagaaauggaaaaaccgguugaaugcauuagggaagagugaauuccagaucuacaagaaaaguggaauccaggaaguggacagaaccuuagcaaaagaaggcaucaaaagaggagaaacggaccaucacgcugugucgcgaggcucagcgaaacugagaugguucgucgagagaaaccuggucacaccagaagggaaaguaguggaccuuggcugcggcagggggggcuggucauacuauugugggggacuaaagaauguaaaagaagucaaaggccuaacaaaaggaggaccaggacacgaagaacccauucccaugucaacauaugguuggaaucuggugcgccuucaaaguggaguugauguuuuuuucacuccgccagaaaagugugacacacugcugugugacauaggggagucgucaccaaaccccacgguugaggcaggacgaacacucagaguucuaaacuuaguggaaaauuggcugaacaacaacacccaauuuugcauaaagguucuuaacccauacaugcccucaguuauagaaaaaauggaagcacuacaaaggaaauacggaggagcuuuggugaggaauccacucucacgaaauuccacacacgagauguacuggguauccaaugcuuccgggaauauagugucaucagugaacaugauuucaagaauguugauuaacagauucacaaugagacacaagaaagccacauacgagccagauguugaccucggaaguggaacccgcaacaucggaauugaaagugagacaccaaauuuagacauaauugggaaaagaauagaaaaaauaaaacaagagcaugaaacaucauggcacuaugaccaagaccacccauacaaaacgugggccuaccauggcagcuacgaaacaaaacagacuggaucagcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccgaaagaaggcacgaaaaaacuaaugaaaauuacugcagaauggcucuggaaagaacuaggaaagaaaaagacaccuaggaugugcaccagagaagaauucacaagaaaggugagaagcaaugcagcuuuaggugccauauucacugaugagaacaaguggaagucggcacgugaggcuguugaagacaguggauuuugggaauugguugacaaggaaaggaaucuccaucuugaaggaaagugugaaacauguguguauaacaugaugggaaagagagagaagaagcuaggggaguucggcaaagcaaaaggcagcagagccauaugguacauguggcuuggagcacgcuucuuagaguuugaagcucuaggauucuugaacgaagaucacugguuuuccagagagaacucccugaguggaguggaaggagaagggcuacacaagcuaggcuacauuuuaagagacgugaguaagaaagaaggaggagcaauguaugcugaugacaccgcaggaugggacacaagaaucacacuagaggacuuaaaaaaugaagaaauggugacaaaccacauggaaggagaacacaagaaacuugcugaagccauuuucaaauuaacguaccaaaacaagguggugcgugugcaaagaccaacaccaagaggcacaguaauggacauuauaucgagaagagaccaaagagguaguggacaaguugucaccuacggccucaauacuuucaccaauauggaagcccaacugaucagacagauggagggagaaggaguuuucaaaagcauccagcaacugacaguaaaagaagaaauugcagugaaaaacugguuaauaagaguggggcgugagagguuaucaagaauggccaucaguggagaugauuguguugugaaacccuuagaugacagguuugcaagugcucuaacagcucuaaaugacaugggaaagguuaggaaagacauacaacaaugggaaccuucaagaggauggaacgauuggacacaagugcccuuuuguucacaccauuuccaugaguuaaucaugaaggacggucgugugcucguaguuccaugcagaaaccaagaugaacugauuggcagggcccgaauuucccagggagccgggugguccuugcgggaaacagccugucuggggaaguccuacgcccaaauguggagccugauguacuuccacagacgugaccuuaggcuggcggcaaaugccauuugcucggcagucccaucacauuggauuccaacaagucgaacaaccugguccauacacgccacacaugaguggaugacaacagaagacauguugacagucuggaacaggguguggauucaagaaaacccauggauggaagacaaaacuccaguagaaucaugggaggaaaucccguauuuggggaaaagagaagaccaauggugcggcucauugauugggcuaacaagcagggccaccugggcaaagaacauccaaacagcaauaaaucaaguuagaucccuaauaggcaaugaggaauacacagacuacaugccaucuaugaaaagauucagaagagaagaggaagaggcaggagucuugugguag

SEQ ID NO: 6434 - RNA, 9876 nt, Artificial Sequence
  derived and/or modified CDS sequence (wt) from DENV-2__KM279517__SS-prME
acugcagguauaauuauuaugaugaucccaacagugauggcguuccauuuaaccacacgcaacggagaaccacacaugaucguuaguagacaagagaaggggaaaagucuccuguuuaaaacagagaacggugugaacauguguacccucauggccauggaccuuggugaacugugugaagacacaaucacuuauaauuguccucuucucaggcagaaugaaccagaagacauagacuguuggugcaacuccacgucuacauggguaacuuacgggacaugcaccgccacaggagaacacagaagggaaaaaagaucaguggcacucguuccacaugugggaaugggacuggagacacgaacugaaacauggaugucaucagaaggggccuggaaacaugcccagagaauugaaacuuggaucuugagacauccaggcuucaccauaauggcagcaauccuggcauacaccauaggaacaacauauuuccaaagaguccugauuuucauuuuacugacagcugucacuccuucaauggcaaugcguuguauaggaauaucaaauagagacuuuguggaagggguuucaggaggaagcuggguugauauagucuuggaacauggaagcugugugacgacgauggcgaaaaauaaaccaacguuggauuuugaacugauaaaaacagaagccaaacaucucgccacucuaaggaaguauuguguagaggcaaagcugaccaacacaacaacagcaucucgcugcccaacacaaggagaaccuagccuaaacgaagaacaggacaaaagauucgucugcaaacacuccaugguagacagaggauggggaaauggaugcggauuauuuggaaagggaggcaucgugaccugugcaauguucacaugcaaaaagaacauggaaggaaaagucgugcaaccagaaaacuuggaguacaccaucgugauaacaccucacucaggggaagagaaugcagucggaaaugacacaggaaaacauggcaaggaaauuaaaguaacaccacagaguuccaucacagaagcagaacuaacaggcuacggcacugucacgauggaaugcucuccgagaacgggccucgacuucaaugagaugguguugcugcaaauggaaaacaaggcuuggcuggugcacaggcaaugguuccuagaccugccguuaccauggcugcccggagcagacacacaaggaucaaauuggauacagaaggagacacuggucacuuucaaaaauccccaugcaaagaaacaggauguuguugucuuagguucccaagaaggggccaugcacacggcacucacaggggccacggaaauccagaugucaucaggaaacuuacuguucacaggacaucuuaagugcaggcugagaauggacaaacuacagcucaaaggaaugucauauuccauguguacaggaaaguucaaaguugugaaggaaauagcagaaacacaacauggaacaauaguuauuagaguacaauaugaaggggacgguuccccgugcaagaucccuuuugaaauaauggacuuggaaaaaaggcaugucuuaggucgcuugauuacagucaacccaauugucacagaaaaagacagcccagucaacauagaagcagaaccuccauuuggagacaguuacaucauuauaggaguagaaccaggacaacugaagcucagcugguuuaagaaaggaaguucuauuggccaaauguuugagacaacaaugagaggagcgaagagaauggccauucuaggugacacagcuugggauuuuggaucccugggaggaguguucacaucuauaggaaaggcccuccaccaagucuuuggagcuaucuauggggcugccuucagugggguuucauggacuaugaaaauccucauaggagucgucaucacauggauaggaaugaauucacgcagcaccucacugucugugucacuaguauuagugggggucgugacauuguauuugggaguuauggugcaggccgauagugguugcguugugaguuggaaaaacaaagaacugaaaugugguagugggauuuuuaucacagacaacgugcacacauggacagagcaauacaaauuccaaccagaauccccuccaaagcuggcuucagcuauccagaaggcucaugaagaaggcauuuguggaauccgcucaguaacaagacuggagaaucugauguggaaacaaauaacaccagaauugaaucacauucuaacagaaaaugaaguaaaguugacuaucaugacaggagacaucaaaggaaucaugcaggcaggaaaacgaucccugcggccucaacccacugagcugaaguacuccuggaaggcauggggcaaagcgaaaaugcuuuccacagagcuucauaaccacaccuuucucauugauggccccgaaacagcagaaugucccaacacaaacagagcuuggaacucacuagaaguugaagacuauggcuuuggaguauucaccacuaacauauggcugaaauugaaagaaaggcaggauguguuuugugacucaaaacucaugucagcagccauaaaggacaauagagccguccacgccgauauggguuauuggauagaaagcgcacucaaugacacauggaagauugagaaagccucuuuuauugaaguuaaaagcugccacuggccaaagucacacacucucuggaguaauggagugcuggaaagugagaugauaauuccaaagaauuuugcaggaccaguuucacaacacaauuacagaccaggcuaccacacacaaacggcaggacccuggcaucuagguaggcuugagauggacuuugauuucugcgaaggaaccacagugguggugacugaggacuguggaaauagaggacccuccuuaagaacaacuacugcuucuggaaaacucauaacagaguggugcugccgaucuugcacauuaccaccgcuaagguacagaggugaggauggaugcugguaugguauggaaaucaggccauugaaagagaaagaagagaaccuggucaacucuuuggucacagccggacauggacagauugacaacuucucacuaggagucuugggaauggcauuguuccuggaagagaugcucaggacucgaguaggaacgaaacaugcaauauuacuaguugcagucucuuucgugacauugaucacagggaacauguccuuucgagauuuggggagagugauggucauggugggcgcuacuaugacggaugacauaggcaugggcgugacuuaucuugcccuauuagcagccuuuaaagucagaccaaccuuugcggcuggacuacucuuaagaaagcugaccuccaaggaauugaugaugaccaccauaggaaucguacuccucucucagaguaccauaccagagagcauacuugaacugacugacgcguuggcuuuggggaugaugguucucaaaauagugagaaacauggaaaaguaucagcuagcagugacuaucauggcaaucuugugcgucccaaaugcagugauauugcaaaaugcauggaaagugagcugcacaacacuggcagugguguccguuuccccacugcuuuuaacauccucacagcagaaagcggauuggauaccacuggcguugacgaucaaaggccucaauccaacagccauuuucuuaacaacucucucaagaacuagcaagaaaaggagcuggccacuaaaugaggcuauuauggcagucgggauggugagcauucuagcuaguucucucuuaaagaaugauauucccaugacaggaccauuaguggcuggagggcuucucacuguguguuacgugcucacuggaaggucggcugacuuggaacuggaaagagcugcugacguaagaugggaagaacaggcagagauaucaggaaguaguccaauucugucgauaacaauaucggaagaugguagcaugucgauaaagaaugaagaagaagaacagacacugaccauacucaucagaacaggacuacuggugauaucaggacuuuuuccugugucaauaccaaucacggcagcugcaugguaccuuugggaagugaaaaaacaacgagcaggaguauugugggaugucccuucacccccaccugugggaaaggccgaacuggaagauggagccuauagaaucaagcagaaagggauccuaggauacucacagauuggagccggaguuuacaaagaaggaacauuccacacaauguggcaugucacacguggugcuguccuaaugcauaaagggaagagaauugaaccaucaugggcggacgucaagaaagaccuaauaucguauggaggaggcuggaagcuggaaggagaauggaaggaaggagaagaaguccagguccuggcauuagagccuggaaagaauccaagagccguccaaacaaaacccggucuuuuuaaaaccaacacuggaaccauaggcgccgugucucuggacuuuucuccuggaacgucaggaucuccaaucgucgauaaaaaaggaaaaguugugggccuuuauggcaacggugucgucacaaggaguggaacauaugugagugccauagcccagacugaaaaaagcaucgaagacaauccagagauugaagaugacaucuuuagaaagaaaagauugaccaucauggaccuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagcuaucagagcugagcacacugggcgggagauuguggaucuaaugugucaugccacauuuaccaugaggcuauuaucaccaauuagagugccaaauuacaaccugaucaucauggaugaagcccauuucacagacccagcaagcauagcagcuagaggauacauuucaacucgaguagagaugggugaagcagcugggauuuucaugacagccaccccuccugggagcagagacccauuuccccagagcaacgcaccaaucauggaugaagaaagagaaaucccugagcguucguggaacucuggacaugaguggguuacggauuuuaaagggaagacuguuugguuuguuccaaguauaaaagcagggaaugauauagcagcuugccugagaaagaauggaaagaaagugauacaacucagcaggaaaacuuuugauucugaauauaucaagacuaggaccaaugauugggacuuuguggucacgacagacauuucagaaaugggugcuaacuucaaggcugagaggguuauagaccccagacgcugcaugaaaccagucauauuaacagacggugaagagcgggugaucuuggcaggacccaugccagugacccauucuagugcagcacaaagaagagggagaguaggaagaaauccaaaaaaugaaaaugaccaguacauauacaugggggaaccucuggaaaaugaugaagacugugcacacuggaaagaagcuaagaugcucuuggauaacaucaacacgccugaaggaaucauucccagcauguucgaaccagagcgugaaaagguggaugccauugauggugaauaccgcuugagaggagaagcgaggaaaacuuuuguggaccuaaugagaagaggagauuuaccagucuggcuagccuacagaguggcggcugaaggcaucaacuacgcagacagaagauggugcuuugauggagucaagaacaaccaaaucuuggaagaaaauguggaaguagaaauuuggacaaaagaaggagaaaggaagaaauuaaaacccagaugguuggaugcuaggaucuacucugacccauuggcgcucaaagaauucaaggaauucgcagcuggaagaaagucccugacccugaaucuaaucacagagauggguagacucccaaccuucaugacccagaaagcaaagaaugcacucgacaacuuagcaguccugcauacggcugaagcaggcggaagggcguacaaucaugcucuuagugaacugccggagacucuggagacauugcuuuuacugacacuuuuggccacagucacgggcggaaucuuccuguucuugaugagcggaaaggguauagggaagaugacccugggaaugugcugcauaaucacggcuaguauccucuuaugguaugcacaaauacagccacacuggauagcagcuucaauaauacuggaguuuuuucucauagucuugcucauuccagaaccagaaaaacagagaacaccccaagauaaccaguuaacuuauguugucauagccauccuuacaguaguggccgcaaccauggcaaacgagauggguuuccuggaaaaaacaaagaaagauuucggauugggaagcauuacaacccagcaaccugagaguaacauccuggacauagaucuacguccugcaucagcuuggacucuauaugccguggcaacaacuuucaucacaccaauguugaggcauagcauugaaaacuccucagugaaugugucccuaacagccauugccaaccaagccacaguguuaaugggucuugggaaaggauggccauugucaaaaauggacaucggaguuccccuucucgcuaucgggugcuauucacaagucaaccccauaacucucacugcagcccuucucuuauugguagcccauuaugccaucauagggccaggacuccaagcgaaagcaacuagagaggcucagaaaagagcagcagcgggcaucaugaaaaacccaacuguggauggaaugacagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcaaccgggcccaucucuacacugugggaaggaaauccagggagauuuuggaauacaacuauugcagugucaauggcuaacauuuuuagagggaguuaccuggccggagccggacuucucuuuucuaucaugaaaaacacggccaacacaagaaggggaacuggcaacacaggagagacgcuuggggagaaauggaaaaaccgguugaaugcauuagggaagagugaauuccagaucuacaagaaaaguggaauccaggaaguggauagaaccuuagcaaaagaaggcaucaaaagaggagaaacggaccaucacgcugugucgcgaggcucagcgaaacugagaugguucgucgagagaaaccuggucacaccagaagggaaaguaguggaccuuggcugcggcagggggggcuggucauacuauugugggggacuaaagaauguaaaagaagucaaaggccuaacaaaaggaggaccaggacacgaagaacccauucccaugucaacauaugguuggaaucuggugcgucuucaaaguggaguugauguuuuuuucacuccgccagaaaagugugacacacugcugugugacauaggggagucgucaccaaaccccacgguugaggcaggacgaacacucagaguucuaaacuuaguggaaaauuggcugaacaacaacacccaauuuugcauaaagguucuuaacccauacaugcccucaguuauagaaaaaauggaaacacuacaaaggaaauacggaggagcuuuggugaggaauccacucucacgaaauuccacacacgagauguacuggguauccaaugcuuccgggaauauagugucaucagugaacaugauuucaagaauguugauuaacagauucacaaugagacacaagaaagccacauacgaaccagauguugaccucggaaguggaacccgcaacaucggaauugaaagugagacaccaaauuuagacauaauugggaaaagaauagaaaaaauaaaacaagagcaugaaacaucauggcacuaugaccaagaccacccauacaaaacgugggccuaccauggcagcuacgaaacaaaacagacuggaucagcaucauccauggugaacggagugguuaggcugcuaacaaaaccuugggacgucaucccuauggugacacagauggcaaugacagacacgacuccguuuggacaacagcgcguuuucaaagagaaaguggacacgagaacccaagaaccgaaagaaggcacgaaaaaacuaaugaaaauuacugcagaauggcucuggaaagaacuaggaaagaaaaagacaccuaggaugugcaccagagaagaauucacaagaaaggugagaagcaaugcagccuuaggugcuauauucacugaugagaacaaguggaagucggcacgugaggcuguugaagacaguggauuuugggaauugguugacaaggaaaggaaucuccaucuugaaggaaagugugaaacauguguguauaacaugaugggaaagagagagaagaagcuaggggaguucggcaaagcaaaaggcagcagagccauaugguacauguggcuuggagcacgcuucuuagaguuugaagcucuaggauucuugaacgaagaucacugguuuuccagagagaacucccugaguggaguggaaggagaagggcuacacaagcuaggcuacauuuuaagagacgugaguaagaaagaaggaggagcaauguaugcugaugacaccgcaggaugggacacaagaaucacacuagaggacuuaaaaaaugaagaaauggugacaaaccacauggaaggagaacacaagaaacuugcugaagccauuuucaaauuaacguaccaaaacaagguggugcgugugcaaagaccaacaccaagaggcacaguaauggacauuauaucgagaagagaccaaagagguaguggacaaguugucaccuacggccucaauacuuucaccaauauggaagcccaacugaucagacagauggagggagaaggaguuuucaaaagcauccagcaacugacaguaaaagaagaaauugcagugaaaaacugguuaauaagaguggggcgugagagguuaucaagaauggccaucaguggagaugauuguguugugaaacccuuagaugacagguuugcaagugcucuaacagcucuaaaugacaugggaaagguuaggaaagacauacaacaaugggaaccuucaagaggauggaacgauuggacacaagugcccuuuuguucacaccauuuccaugaguuaaucaugaaggacggucgugugcucguaguuccaugcagaaaccaagaugaacugauugguagggcccgaauuucccagggagccgggugguccuugcgggaaacagccugucuggggaaguccuacgcccaaauguggagccugauguacuuccacagacgugaccuuaggcuggcggcaaaugccauuugcucggcagucccaucacauuggauuccaacaagucgaacaaccugguccauacacgccacacaugaguggaugacaacggaagacauguugacagucuggaacaggguguggauucaagaaaacccauggauggaagacaaaacuccaguagaaucaugggaggaaaucccguacuuggggaaaagagaagaccaauggugcggcucauugauugggcuaacaagcagggccaccugggcaaagaacauccagacagcaauaaaucaaguuagaucccuaauaggcaaugaggaauacacagacuacaugccaucuaugaaaagauucagaagagaagaggaagaggcaggagucuugugguag

SEQ ID NO: 6435 - RNA, 9876 nt, Artificial Sequence
  derived and/or modified CDS sequence (wt) from DENV-2__KM279518__SS-prME
acugcagguauaauuauuaugaugaucccaacagugauggcguuccauuuaaccacacgcaacggagaaccacacaugaucguuaguagacaagagaaagggaaaagucuccuguuuaaaacagagaacggugugaacauguguacccucauggccauggaccuuggugaacugugugaagacacaaucacuuauaauuguccucuucucaggcagaaugaaccagaagacauagacuguuggugcaacuccacgucuacauggguaacuuaugggacaugcaccgccacaggagaacacagaagggaaaaaagaucaguggcacucguuccacaugugggaaugggacuggagacacgaacugaaacauggaugucaucagaaggggccuggaagcaugcccagagaauugaaacuuggaucuugagacauccaggcuucaccauaauggcagcaauccuggcauacaccauaggaacaacauauuuccaaagaguccugauuuucauuuuacugacagcugucacuccuucaauggcaaugcguuguauaggaauaucaaauagagacuuuguggaagggguuucaggaggaagcuggguugauauagucuuggaacauggaagcugugugacgacgauggcgaaaaauaaaccaacguuggauuuugaacugauaaaaacagaagccaaacaucucgccacucuaaggaaguauuguguagaggcaaagcugaccaacacaacaacagcaucucgcugcccaacacaaggagaaccuagccuaaacgaagaacaggacaaaagauucgucugcaaacacuccaugguagacagaggauggggaaauggaugcggauuauuuggaaagggaggcaucgugaccugugcaauguucacaugcaaaaagaacauggaaggaaaagucgugcaaccagaaaacuuggaguacaccaucgugauaacaccucacucaggggaagagaaugcagucggaaaugacacaggaaaacauggcaaggaaauuaaaguaacaccacagaguuccaucacagaagcagaacuaacaggcuacggcacugucacgauggaaugcucuccgagaacgggccucgacuucaaugagaugguguugcugcaaauggaaaacaaggcuuggcuggugcacaggcaaugguucuuagaccugccguuaccauggcugcccggagcagacacacaaggaucaaauuggauacagaaggagacacuggucacuuucaaaaauccccaugcaaagaaacaggauguuguuguuuuagguucccaagaaggggccaugcacacggcacucacaggggccacggaaauccagaugucaucaggaaacuuacuguucacaggacaucuuaagugcaggcugagaauggacaaacuacagcucaaaggaaugucauauuccauguguacaggaaaguucaaaguugugaaggaaauagcagaaacacaacauggaacaauaguuauuagaguacaauaugaaggggacgguuccccgugcaagaucccuuuugaaauaauggacuuggaaaaaaggcaugucuuaggucgcuugauuaccgucaacccaauugucacagaaaaagacagcccagucaacauagaagcagaaccuccauuuggagacaguuacaucauuauaggaguagaaccaggacaacugaagcucagcugguuuaagaaaggaaguucuauuggccaaauguuugagacaacaaugagaggagcgaagagaauggccauucuaggugacacagcuugggauuuuggaucccugggaggaguguucacaucuauaggaaaggcccuccaccaagucuuuggagcuaucuauggggcugccuucagugggguuucauggacuaugaaaauccucauaggagucgucaucacauggauaggaaugaauucacgcagcaccucacugucugugucacuaguauuagugggggucgugacauuguauuugggaguuauggugcaggccgauagugggugcguugugaguuggaaaaacaaagaacugaaaugugguagugggauuuuuaucacagacaacgugcacacauggacagaacaauacaaauuccaaccagaauccccuucaaagcuggcuucagcuauccagaaggcucaugaagaaggcauuuguggaauccgcucaguaacaagacuggagaaucugauguggaaacaaauaacaccagaauugaaucacauucuaacagaaaaugaaguaaaguugacuaucaugacaggagacaucaaaggaaucaugcaggcaggaaaacgaucccugcggccucaacccacugagcugaaguacuccuggaaggcauggggcaaagcgaaaaugcuuuccacagagcuucauaaccacaccuuucucauugauggccccgaaacagcagaaugucccaacacaaacagagcuuggaacucacuagaaguugaagacuauggcuuuggaguauucaccacuaacauauggcugaaauugaaagaaaggcaggauguguuuugugacucaaaacucaugucagcagccauaaaggacaauagagccguccacgccgauauggguuauuggauagaaagcgcacucaaugacacauggaagauugagaaagccucuuuuauugaaguuaaaagcugccacuggccaaagucacacacucucuggaguaauggagugcuggaaagugagaugauaauuccaaagaauuuugcaggaccaguuucacaacacaauuacagaccaggcuaccacacacaaacggcaggacccuggcaucuagguaggcuugagauggacuuugauuucugcgaaggaaccacagugguggugacugaggacuguggaaauagaggacccuccuuaagaacaacuacugcuucuggaaaacucauaacagaguggugcugccgaucuugcacauuaccaccgcuaagguacagaggugaggauggaugcugguaugguauggaaaucaggccauugaaagagaaagaagagaaccuggucaacucuuuggucacagccggacauggacagauugacaacuucucacuaggagucuugggaauggcauuguuccuggaagagaugcucaggacucgaguaggaacgaaacaugcaauauuacuaguugcagucucuuucgugacauugaucacagggaacauguccuuucgagauuuggggagagugauggucauggugggcgcuacuaugacggaugacauaggcaugggcgugacuuaucuugcccuauuagcagccuuuaaagucagaccaaccuuugcggcuggacuacucuuaagaaagcugaccuccaaggaauugaugaugaccaccauaggaaucguacuccucucucagaguaccauaccagagagcauacuugaacugacugacgcguuggcuuuggggaugaugguucucaaaauagugagaaacauggaaaaguaucagcuagcagugacuaucauggcaaucuugugcgucccaaaugcagugauauugcaaaaugcauggaaagugagcugcacaacacuggcagugguguccguuuccccacugcuuuuaacauccucacagcagaaagcggauuggauaccacuggcguugacgaucaaaggccucaauccaacagccauuuucuuaacaacucucucaagaacuagcaagaaaaggagcuggccacuaaaugaggcuauuauggcagucgggauggugagcauucuagcuaguucucucuuaaagaaugauauucccaugacaggaccauuaguggcuggagggcuucucacuguguguuacgugcucacuggaaggucggcugacuuggaacuggaaagagcugcugacguaagaugggaagaacaggcagagauaucaggaaguaguccaauucugucgauaacaauaucggaagaugguagcaugucgauaaagaaugaagaagaagaacagacacugaccauacucaucagaacaggacuacuggugauaucaggacuuuuuccugugucaauaccaaucacggcagcugcaugguaccuuugggaagugaaaaaacaacgagcaggaguauugugggaugucccuucacccccaccugugggaaaggccgaacuggaagauggagccuauagaaucaagcagaaagggauccuaggauacucacagauuggagccggaguuuacaaagaaggaacauuccacacaauguggcaugucacacguggugcuguccuaaugcauaaagggaagagaauugaaccaucaugggcggacgucaagaaagaccuaauaucguauggaggaggcuggaagcuggaaggagaauggaaggaaggagaagaaguccagguccuggcauuagagccuggaaagaauccaagagccguccaaacaaaacccggucuuuuuaaaaccaacacuggaaccauaggcgccgugucucuggacuuuucuccuggaacgucaggaucuccaaucgucgauaaaaaaggaaaaguugugggccuuuauggcaacggugucgucacaaggaguggaacauaugugagugccauagcccagacugaaaaaagcaucgaagacaauccagagauugaagaugacaucuuuagaaagaaaagauugaccaucauggaccuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagcuaucagagcugagcacacugggcgggagauuguggaucuaaugugucaugccacauuuaccaugaggcuauuaucaccaauuagagugccaaauuacaaccugaucaucauggaugaagcccauuucacagacccagcaagcauagcagcuagaggauacauuucaacucgaguagagaugggugaagcagcugggauuuucaugacagccaccccuccuggaagcagagacccauuuccccagagcaacgcaccaaucauggaugaagaaagagaaaucccugagcguucguggaacucuggacaugaguggguuacggauuuuaaagggaagacuguuugguuuguuccaaguauaaaagcagggaaugauauagcagcuugccugagaaagaauggaaagaaagugauacaacucagcaggaaaacuuuugauucugaauauaucaagacuaggaccaaugauugggacuuuguggucacgacagacauuucagaaaugggugcuaacuucaaggcugagaggguuauagaccccagacgcugcaugaaaccagucauauuaacagacggugaagagcgggugaucuuggcaggacccaugccagugacccauucuagugcagcacaaagaagagggagaguaggaagaaauccaaaaaaugaaaaugaccaguacauauacaugggggaaccucuggaaaaugaugaagacugugcacacuggaaagaagcuaagaugcucuuggauaacaucaacacgccugaaggaaucauucccagcauguucgaaccagagcgugaaaagguggaugccauugauggugaauaccgcuugagaggagaagcgaggaaaacuuuuguggaccuaaugagaagaggagacuuaccagucuggcuagccuacagaguggcggcugaaggcaucaacuacgcagacagaagauggugcuuugauggagucaagaacaaccaaaucuuggaagaaaauguggaaguagaaauuuggacaaaagaaggagaaaggaagaaauuaaaacccagaugguuggaugcuaggaucuacucugacccauuggcgcucaaagaauucaaggaauucgcagcuggaagaaagucccugacccugaaucuaaucacagagauggguagacucccaaccuucaugacccagaaagcaaagaaugcacucgacaacuuagcaguccugcauacggcugaagcaggcggaagggcguacaaucaugcucuuagugaacugccggagacucuggagacauugcuuuuacugacacuuuuggccacagucacgggcggaaucuuccuguucuugaugagcggaaaggguauagggaagaugacccugggaaugugcugcauaaucacggcuaguauccucuuaugguaugcacaaauacagccacacuggauagcagcuucaauaauacuggaguuuuuucucauagucuugcucauuccagaaccagaaaaacagagaacaccccaagauaaccaguuaacuuauguugucauagccauccuuacaguaguggccgcaaccauggcaaacgagauggguuuccuggaaaaaacaaagaaagauuucggauugggaagcauuacaacccagcaaccugagaguaacauccuggacauagaucuacguccugcaucagcuuggacucuauaugccguggcaacaacuuucaucacaccaauguugaggcauagcauugaaaacuccucagugaaugugucccuaacagccauugccaaccaagccacaguguuaaugggucuugggaaaggauggccauugucaaaaauggacaucggaguuccccuucucgcuaucgggugcuauucacaagucaaccccauaacucucacugcagcccuucucuuauugguagcccauuaugccaucauagggccaggacuccaagcgaaagcaacuagagaggcucagaaaagagcagcagcgggcaucaugaaaaacccaacuguggauggaaugacagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcaaccgggcccaucucuacacugugggaaggaaauccagggagauuuuggaauacaacuauugcagugucaauggcuaacauuuuuagagggaguuaccuggccggagccggacuucucuuuucuaucaugaaaaacacggccaacacaagaaggggaacuggcaacacaggagagacgcuuggggagaaauggaaaaaccgguugaaugcauuagggaagagugaauuccagaucuacaagaaaaguggaauccaggaaguggacagaaccuuagcaaaagaaggcaucaaaagaggagaaacggaccaucacgcugugucgcgaggcucagcgaaacugagaugguucgucgagagaaaccuggucacaccagaagggaaaguaguggaccuuggcugcggcagggggggcuggucauacuauugugggggacuaaagaauguaaaagaagucaaaggccuaacaaaaggaggaccaggacacgaagaacccauucccaugucaacauaugguuggaaucuggugcgccuucaaaguggaguugauguuuuuuucacuccgccagaaaagugugacacacugcugugugacauaggggagucgucaccaaaccccacgguugaggcaggacgaacacucagaguucuaaacuuaguggaaaauuggcugaacaacaacacccaauuuugcauaaagguucuuaacccauacaugcccucaguuauagaaaaaauggaagcacuacaaaggaaauacggaggagcuuuggugaggaauccacucucacgaaauuccacacacgagauguacuggguauccaaugcuuccgggaauauagugucaucagugaacaugauuucaagaauguugauuaacagauucacaaugagacacaagaaagccacauacgagccagauguugaccucggaaguggaacccgcaacaucggaauugaaagugagacaccaaauuuagacauaauugggaaaagaauagaaaaaauaaaacaagagcaugaaacaucauggcacuaugaccaagaccacccauacaaaacgugggccuaccauggcagcuacgaaacaaaacagacuggaucagcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccgaaagaaggcacgaaaaaacuaaugaaaauuacugcagaauggcucuggaaagaacuaggaaagaaaaagacaccuaggaugugcaccagagaagaauucacaagaaaggugagaagcaaugcagccuuaggugccauauucacugaugagaacaaguggaagucggcacgugaggcuguugaagacaguggauuuugggaauugguugacaaggaaaggaaucuccaucuugaaggaaagugugaaacauguguguauaacaugaugggaaagagagagaagaagcuaggggaguucggcaaagcaaaaggcagcagagccauaugguacauguggcuuggagcacgcuucuuagaguuugaagcucuaggauucuugaacgaagaucacugguuuuccagagagaacucccugaguggaguggaaggagaagggcuacacaagcuaggcuacauuuuaagagacgugaguaagaaagaaggaggagcaauguaugcugaugacaccgcaggaugggacacaagaauuacacuagaggacuuaaaaaaugaagaaauggugacaaaccacauggaaggagaacacaagaaacuugcugaagccauuuucaaauuaacguaccaaaacaagguggugcgugugcaaagacaaacaccaagaggcacaguaauggacauuauaucgagaagagaccaaagagguaguggacaaguugucaccuacggccucaauacuuucaccaauauggaagcccaacugaucagacagauggagggagaaggaguuuucaaaagcauccagcaacugacaguaaaagaagaaauugcagugaaaaacugguuaauaagaguggggcgugagagguuaucaagaauggccaucaguggagaugauuguguugugaaacccuuagaugacagguuugcaagugcucuaacagcucuaaaugacaugggaaagguuaggaaagacauacaacaaugggaaccuucaagaggauggaacgauuggacacaagugcccuuuuguucacaccauuuccaugaguuaaucaugaaggacggucgugugcucguaguuccaugcagaaaccaagaugaacugauuggcagggcccgaauuucccagggagccgggugguccuugcgggaaacagccugucuggggaaguccuacgcccaaauguggagccugauguacuuccacagacgugaccuuaggcuggcggcaaaugccauuugcucggcagucccaucacauuggauuccaacaagucgaacaaccugguccauacacgccacacaugaguggaugacaacagaagacauguugacagucuggaacaggguguggauucaagaaaacccauggauggaagacaaaacuccaguagaaucaugggaggaaaucccguauuuggggaaaagagaagaccaauggugcggcucauugauugggcuaacaagcagggccaccugggcaaagaacauccaaacagcaauaaaucaaguuagaucccuaauaggcaaugaggaauacacagacuacaugccaucuaugaaaagauucagaagagaagaggaagaggcaggagucuugugguag

SEQ ID NO: 6436 - RNA, 9876 nt, Artificial Sequence
  derived and/or modified CDS sequence (wt) from DENV-2__KM279519__SS-prME
acugcagguauaauuauuaugaugaucccaacagugauggcguuccauuuaaccacacgcaacggagaaccacacaugaucguuaguagacaagagaaagggaaaagucuccuguuuaaaacagagaacggugugaacauguguacccucauggccauggaccuuggugaacugugugaagacacaaucacuuauaauuguccucuucucaggcagaaugaaccagaagacauagacuguuggugcaacuccacgucuacauggguaacuuaugggacaugcaccgccacaggagaacacagaagggaaaaaagaucaguggcacucguuccacaugugggaaugggacuggagacacgaacugaaacauggaugucaucagaaggggccuggaaacaugcccagagaauugaaacuuggaucuugagacauccaggcuucaccauaauggcagcaauccuggcauacaccauaggaacaacauauuuccaaagaguccugauuuucauuuuacugacagcugucacuccuucaauggcaaugcguuguauaggaauaucaaauagagacuuuguggaagggguuucaggaggaagcuggguugauauagucuuggaacauggaagcugugugacgacgauggcgaaaaauaaaccaacguuggauuuugaacugauaaaaacagaagccaaacaucucgccacucuaaggaaguauuguguagaggcaaagcugaccaacacaacaacagcaucucgcugcccaacacaaggagaaccuagccuaaacgaagaacaggacaaaagauucgucugcaaacacuccaugguagacagaggauggggaaauggaugcggauuauuugggaagggaggcaucgugaccugugcaauguucacaugcaaaaagaacauggaaggaaaagucgugcaaccagaaaacuuggaguacaccaucgugauaacaccucacucaggggaagagaaugcagucggaaaugacacaggaaaacauggcaaggaaauuaaaguaacaccacagaguuccaucacagaagcagaacuaacaggcuacggcacugucacgauggaaugcucuccgagaacgggccucgacuucaaugagaugguguugcugcaaauggaaaacaaggcuuggcuggugcacaggcaaugguucuuagaccugccguuaccauggcugcccggagcagacacacaaggaucaaauuggauacagaaggagacacuggucacuuucaaaaauccccaugcaaagaaacaggauguuguuguuuuagguucccaagaaggggccaugcacacggcacucacaggggccacggaaauccagaugucaucaggaaacuuacuguucacaggacaucuuaagugcaggcugagaauggacaaacuacagcucaaaggaaugucauauuccauguguacaggaaaguucaaaguugugaaggaaauagcagaaacacaacauggaacaauaguuauuagaguacaauaugaaggggacgguuccccgugcaagaucccuuuugaaauaauggacuuggaaaaaaggcaugucuuaggacgcuugauuaccgucaacccaauugucacagaaaaagacagcccagucaacauagaagcagaaccuccauuuggagacaguuacaucauuauaggaguagaaccaggacaacugaagcucagcugguuuaagaaaggaaguucuauuggccaaauguuugagacaacaaugagaggagcgaagagaauggccauucuaggugacacagcuugggauuuuggaucccugggaggaguguucacaucuauaggaaaggcccuccaccaagucuuuggagcuaucuauggggcugccuucagugggguuucauggacuaugaaaauccucauaggagucgucaucacauggauaggaaugaauucacgcagcaccucacugucugugucacuaguauuagugggggucgugacauuguauuugggaguuauggugcaggccgauagugggugcguugugaguuggaaaaacaaagaacugaaaugugguagugggauuuuuaucacagacaacgugcacacauggacagaacaauacaaauuccaaccagaauccccuucaaagcuggcuucagcuauccagaaggcucaugaagaaggcauuuguggaauccgcucaguaacaagacuggagaaucugauguggaaacaaauaacaccagaauugaaucacauucuaacagaaaaugaaguaaaguugacuaucaugacaggagacaucaaaggaaucaugcaggcaggaaaacgaucccugcggccucaacccacugagcugaaguacuccuggaaggcauggggcaaagcgaaaaugcuuuccacagagcuucauaaccacaccuuucucauugauggccccgaaacagcagaaugucccaacacaaacagagcuuggaacucacuagaaguugaagacuauggcuuuggaguauucaccacuaacauauggcugaaauugaaagaaaggcaggauguguuuugugacucaaaacucaugucagcagccauaaaggacaauagagccguccacgccgauauggguuauuggauagaaagcgcacucaaugacacauggaagauugagaaagccucuuuuauugaaguuaaaagcugccacuggccaaagucacacacucucuggaguaauggagugcuggaaagugagaugauaauuccaaagaauuuugcaggaccaguuucacaacacaauuacagaccaggcuaccacacacaaacggcaggacccuggcaucuagguaggcuugagauggacuuugauuucugcgaaggaaccacagugguggugacugaggacuguggaaauagaggacccuccuuaagaacaacuacugcuucuggaaaacucauaacagaguggugcugccgaucuugcacauuaccaccgcuaagguacagaggugaggauggaugcugguaugguauggaaaucaggccauugaaagagaaagaagagaaccuggucaacucuuuggucacagccggacauggacagauugacaacuucucacuaggagucuugggaauggcauuguuccuggaagagaugcucaggacucgaguaggaacgaaacaugcaauauuacuagucgcagucucuuucgugacauugaucacagggaacauguccuuucgagauuuagggagagugauggucauggugggcgcuacuaugacggaugacauaggcaugggcgugacuuaucuugcccuauuagcagccuuuaaagucagaccaaccuuugcggcuggacuacucuuaagaaagcugaccuccaaggaauugaugaugaccaccauaggaaucguacuccucucucagaguaccauaccagagagcauacuugaacugacugacgcguuggcuuuggggaugaugguucucaaaauagugagaaacauggaaaaguaucagcuagcagugacuaucauggcaaucuugugcgucccaaaugcagugauauugcaaaaugcauggaaagugagcugcacaacacuggcagugguguccguuuccccacugcuuuuaacauccucacagcagaaagcggauuggauaccacuggcguugacgaucaaaggccucaauccaacagccauuuucuuaacaacucucucaagaacuagcaagaaaaggagcuggccacuaaaugaggcuauuauggcagucgggauggugagcauucuagcuaguucucucuuaaagaaugauauucccaugacaggaccauuaguggcuggagggcuucucacuguguguuacgugcucaccggaaggucggcugacuuggaacuggaaagagcugcugacguaagaugggaagaacaggcagagauaucaggaaguaguccaauucugucgauaacaauaucggaagaugguagcaugucgauaaagaaugaagaagaagaacagacacugaccauacucaucagaacaggacuacuggugauaucaggacuuuuuccugugucaauaccaaucacggcagcugcaugguaccuuugggaagugaaaaaacaacgagcaggaguauugugggaugucccuucacccccaccugugggaaaggccgaacuggaagauggagccuauagaaucaagcagaaagggauccuaggauacucacagauuggagccggaguuuacaaagaaggaacauuccacacaauguggcaugucacacguggugcuguccuaaugcauaaagggaagagaauugaaccaucaugggcggacgucaagaaagaccuaauaucguauggaggaggcuggaagcuggaaggagaauggaaggaaggagaagaaguccagguccuggcauuagagccuggaaagaauccaagagccguccaaacaaaacccggucuuuuuaaaaccaacacuggaaccauaggcgccgugucucuggacuuuucuccuggaacgucaggaucuccaaucgucgauaaaaaaggaaaaguugugggccuuuauggcaacggugucgucacaaggaguggaacauaugugagugccauagcccagacugaaaaaagcaucgaagacaauccagagauugaagaugacaucuuuagaaagaaaagauugaccaucauggaccuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagcuaucagagcugagcacacugggcgggagauuguggaucuaaugugucaugccacauuuaccaugaggcuauuaucaccaauuagagugccaaauuacaaccugaucaucauggaugaagcccauuucacagacccagcaagcauagcagcuagaggauacauuucaacucgaguagagaugggugaagcagcugggauuuucaugacagccaccccuccuggaagcagagacccauuuccccagagcaacgcaccaaucauggaugaagaaaaagaaaucccugagcguucguggaacucuggacaugaguggguuacggauuuuaaagggaagacuguuugguuuguuccaaguauaaaagcagggaaugauauagcagcuugccugagaaagaauggaaagaaagugauacaacucagcaggaaaacuuuugauucugaauauaucaagacuaggaccaaugauugggacuuuguggucacgacagacauuucagaaaugggugcuaacuucaaggcugagaggguuauagaccccagacgcugcaugaaaccagucauauuaacagacggugaagagcgggugaucuuggcaggacccaugccagugacccauucuagugcagcacaaagaagagggagaguaggaagaaauccaaaaaaugaaaaugaccaguacauauacaugggggaaccucuggaaaaugaugaagacugugcacacuggaaagaagcuaagaugcucuuggauaacaucaacacgccugaaggaaucauucccagcauguucgaaccagagcgugaaaagguggaugccauugauggugaauaccgcuugagaggagaagcgaggaaaacuuuuguggaccuaaugagaagaggagauuuaccagucuggcuagccuacagaguggcggcugaaggcaucaacuacgcagacagaagauggugcuuugauggagucaagaacaaccaaaucuuggaagaaaauguggaaguagaaauuuggacaaaagaaggagaaaggaagaaauuaaaacccagaugguuggaugcuaggaucuacucugacccauuggcgcucaaagaauucaaggaauucgcagcuggaagaaagucccugacccugaaucuaaucacagagauggguagacucccaaccuucaugacccagaaagcaaagaaugcacucgacaacuuagcaguccugcauacggcugaagcaggcggaagggcguacaaucaugcucuuagugaacugccggagacucuggagacauugcuuuuacugacacuuuuggccacagucacgggcggaaucuuccuguucuugaugagcggaaaggguauagggaagaugacccugggaaugugcugcauaaucacggcuaguauccucuuaugguaugcacaaauacagccacacuggauagcagcuucaauaauacuggaguuuuuucucauagucuugcucauuccagaaccagaaaaacagagaacaccccaagauaaccaguuaacuuauguugucauagccauccuuacaguaguggccgcaaccauggcaaacgagauggguuuccuggaaaaaacaaagaaagauuucggauugggaagcauuacaacccagcaaccugagaguaacauccuggacauagaucuacguccugcaucagcuuggacucuauaugccguggcaacaacuuucaucacaccaauguugaggcauagcauugaaaacuccucagugaaugugucccuaacagccauugccaaccaagccacaguguuaaugggucuugggaaaggauggccauugucaaaaauggacaucggaguuccccuucucgcuaucgggugcuauucacaagucaaccccauaacucucacugcagcccuucucuuauugguagcccauuaugccaucauagggccaggacuccaagcgaaagcaacuagagaggcucagaaaagagcagcagcgggcaucaugaaaaacccaacuguggauggaaugacagugauugaccuagauccaauacccuaugauccaaaguuugaaaagcaguugggacaaguaaugcucuuaguccucugcgugacccaaguauugaugaugaggacuacaugggcuuuaugugaagcucuaaccuuagcaaccgggcccaucucuacacugugggaaggaaauccagggagauuuuggaauacaacuauugcagugucaauggcuaacauuuuuagagggaguuaccuggccggagccggacuucucuuuucuaucaugaaaaacacggccaacacaagaaggggaacuggcaacacaggagagacgcuuggggagaaauggaaaaaccgguugaaugcauuagggaagagugaauuccagaucuacaagaaaaguggaauccaggaaguggacagaaccuuagcaaaagaaggcaucaaaagaggagaaacggaccaucacgcugugucgcgaggcucagcgaaacugagaugguucgucgagagaaaccuggucacaccagaagggaaaguaguggaccuuggcugcggcagggggggcuggucauacuauugugggggacuaaagaauguaaaagaagucaaaggccuaacaaaaggaggaccaggacacgaagaacccauucccaugucaacauaugguuggaaucuggugcgccuucaaaguggaguugauguuuuuuucacuccgccagaaaagugugacacacugcugugugacauaggggagucgucaccaaaccccacgguugaggcaggacgaacacucagaguucuaaacuuaguggaaaauuggcugaacaacaacacccaauuuugcauaaagguucuuaacccauacaugcccucaguuauagaaaaaauggaagcacuacaaaggaaauacggaggagcuuuggugaggaauccacucucacgaaauuccacacacgagauguacuggguauccaaugcuuccgggaauauagugucaucagugaacaugauuucaagaauguugauuaacagauucacaaugagacacaagaaagccacauacgagccagauguugaccucggaaguggaacccgcaacaucggaauugaaagugagacaccaaauuuagacauaauugggaaaagaauagaaaaaauaaaacaagagcaugaaacaucauggcacuaugaccaagaccacccauacaaaacgugggccuaccauggcagcuacgaaacaaaacagacuggaucagcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccgaaagaaggcacgaaaaaacuaaugaaaauuacugcagaauggcucuggaaagaacuaggaaagaaaaagacaccuaggaugugcaccagagaagaauucacaagaaaggugagaagcaaugcagccuuaggugccauauucacugaugagaacaaguggaagucggcacgugaggcuguugaagacaguggauuuugggaauugguugacaaggaaaggaaucuccaucuugaaggaaagugugaaacauguguguauaacaugaugggaaagagagagaagaagcuaggggaguucggcaaagcaaaaggcagcagagccauaugguacauguggcuuggagcacgcuucuuagaguuugaagcucuaggauucuugaacgaagaucacugguuuuccagagagaacucccugaguggaguggaaggagaagggcuacacaagcuaggcuacauuuuaagagacgugaguaagaaagaaggaggagcaauguaugcugaugacaccgcaggaugggacacaagaaucacacuagaggacuugaaaaaugaagaaauggugacaaaccacauggaaggagaacacaagaaacuugcugaagccauuuucaaauuaacguaccaaaacaagguggugcgugugcaaagaccaacaccaagaggcacaguaauggacauuauaucgagaagagaccaaagagguaguggacaaguugucaccuacggccucaauacuuucaccaauauggaagcccaacugaucagacagauggagggagaaggaguuuucaaaagcauccagcaacugacaguaaaagaagaaauugcagugaaaaacugguuaauaagaguggggcgugagagguuaucaagaauggccaucaguggagaugauuguguugugaaacccuuagaugacagguuugcaagugcucuaacagcucuaaaugacaugggaaagguuaggaaagacauacaacaaugggaaccuucaagaggauggaacgauuggacacaagugcccuuuuguucacaccauuuccaugaguuaaucaugaaggacggucgugugcucgcaguuccaugcagaaaccaagaugaacugauuggcagggcccgaauuucccagggagccgggugguccuugcgggaaacagccugucuggggaaguccuacgcccaaauguggagccugauguacuuccacagacgugaccuuaggcuggcggcaaaugccauuugcucggcagucccaucacauuggauuccaacaagucgaacaaccugguccauacacgccacacaugaguggaugacaacagaagacauguugacagucuggaacaggguguggauucaagaaaacccauggauggaagacaaaacuccaguagaaucaugggaggaaaucccguauuuggggaaaagagaagaccaauggugcggcucauugauugggcuaacaagcagggccaccugggcaaagaacauccaaacagcaauaaaucaaguuagaucccuaauaggcaaugaggaauacacagacuacaugccaucuaugaaaagauucagaagagaagaggaagaggcaggagucuugugguag

SEQ ID NO: 6437 - RNA, 9876 nt, Artificial Sequence
  derived and/or modified CDS sequence (wt) from DENV-2__KM279520__SS-prME
acugcagguauaauuauuaugaugaucccaacagugauggcguuccauuuaaccacacgcaacggagaaccacacaugaucguuaguagacaagagaaagggaaaagucuccuguuuaaaacagagaacggugugaacauguguacccucauggccauggaccuuggugaacugugugaagacacaaucacuuauaauuguccucuucucaggcagaaugaaccagaagacauagacuguuggugcaacuccacgucuacauggguaacuuaugggacaugcaccgccacaggagaacacagaagggaaaaaagaucaguggcacucguuccacaugugggaaugggacuggagacacgaacugaaacauggaugucaucagaaggggccuggaaacaugcccagagaauugaaacuuggaucuugagacauccaggcuucaccauaauggcagcaauccuggcauacaccauaggaacaacauauuuccaaagaguccugauuuucauuuuacugacagcugucacuccuucaauggcaaugcguuguauaggaauaucaaauagagacuuuguggaagggguuucaggaggaagcuggguugauauagucuuggaacauggaagcugugugacgacgauggcgagaaauaaaccaacguuggauuuugaacugauaaaaacagaagccaaacaucucgccacucuaaggaaguauuguguagaggcaaagcugaccaacacaacaacagcaucucgcugcccaacacaaggagaaccuagccuaaacgaagaacaggacaaaagauucgucugcaaacacuccaugguagacagaggauggggaaauggaugcggauuauuuggaaagggaggcaucgugaccugugcaauguucacaugcaaaaagaacauggaaggaaaagucgugcaaccagaaaacuuggaguacaccaucgugauaacaccucacucaggggaagagaaugcagucggaaaugacacaggaaaacauggcaaggaaauuaaaguaacaccacagaguuccaucacagaagcagaacuaacaggcuacggcacugucacgauggaaugcucuccgagaacgggccucgacuucaaugagaugguguugcugcaaauggaaaacaaggcuuggcuggugcacaggcaaugguucuuagaccugccguuaccauggcugcccggagcagacacacaaggaucaaauuggauacagaaggagacacuggucacuuucaaaaauccccaugcaaagaaacaggauguuguuguuuuagguucccaagaaggggccaugcacacggcacucacaggggccacggaaauccagaugucaucaggaaacuuacuguucacaggacaucuuaagugcaggcugagaauggacaaacuacagcucaaaggaaugucauauuccauguguacaggaaaguucaaaguugugaaggaaauagcagaaacacaacauggaacaauaguuauuagaguacaauaugaaggggacgguuccccgugcaagaucccuuuugaaauaauggacuuggaaaaaaggcaugccuuaggucgcuugauuaccgucaacccaauugucacagaaaaagacagcccagucaacauagaagcagaaccuccauuuggagacaguuacaucauuauaggaguagaaccaggacaacugaagcucagcugguuuaagaaaggaaguucuauuggccaaauguuugagacaacaaugagaggagcgaagagaauggccauucuaggugacacagcuugggauuuuggaucccugggaggaguguucacaucuauaggaaaggcccuccaccaagucuuuggagcuaucuauggggcugccuucagugggguuucauggacuaugaaaauccucauaggagucgucaucacauggauaggaaugaauucacgcagcaccucacugucugugucacuaguauuagugggggucgugacauuguauuugggaguuauggugcaggccgauagugggugcguugugaguuggaaaaacaaagaacugaaaugugguagugggauuuuuaucacagacaacgugcacacauggacagaacaauacaaauuccaaccagaauccccuucaaagcuggcuucagcuauccagaaggcucaugaagaaggcauuuguggaauccgcucaguaacaagacuggagaaucugauguggaaacaaauaacaccagaauugaaucacauucuaacagaaaaugaaguaaaguugacuaucaugacaggagacaucaaaggaaucaugcaggcaggaaaacgaucccugcggccucaacccacugagcugaaguacuccuggaaggcauggggcaaagcgaaaaugcuuuccacagagcuucauaaccacaccuuucucauugauggccccgaaacagcagaaugucccaacacaaacagagcuuggaacucacuagaaguugaagacuauggcuuuggaguauucaccacuaacauauggcugaaauugaaagaaaggcaggauguguuuugugacucaaaacucaugucagcagccauaaaggacaauagagccguccacgccgauauggguuauuggauagaaagcgcacucaaugacacauggaagauugagaaagccucuuuuauugaaguuaaaagcugccacuggccaaagucacacacucucuggaguaauggagugcuggaaagugagaugauaauuccaaagaauuuugcaggaccaguuucacaacacaauuacagaccaggcuaccacacacaaacggcaggacccuggcaucuagguaggcuugagauggacuuugauuucugcgaaggaaccacagugguggugacugaggacuguggaaauagaggacccuccuuaagaacaacuacugcuucuggaaaacucauaacagaguggugcugccgaucuugcacauuaccaccgcuaagguacagaggugaggauggaugcugguaugguauggaaaucaggccauugaaagagaaagaagagaaccuggucaacucuuuggucacagccggacauggacagauugacaacuucucacuaggagucuugggaauggcauuguuccuggaagagaugcucaggacucgaguaggaacgaaacaugcaauauuacuaguugcagucucuuucgugacauugaucacagggaacauguccuuucgagauuuggggagagugauggucauggugggcgcuacuaugacggaugacauaggcaugggcgugacuuaucuugcccuauuagcagccuuuaaagucagaccaaccuuugcggcuggacuacucuuaagaaagcugaccuccaaggaauugaugaugaccaccauaggaaucguacuccucucucagaguaccauaccagagagcauacuugaacugacugacgcguuggcuuuggggaugaugguucucaaaauagugagaaacauggaaaaguaucagcuagcagugacuaucauggcaaucuugugcgucccaaaugcagugauauugcaaaaugcauggaaagugagcugcacaacacuggcagugguguccguuuccccacugcuuuuaacauccucacagcagaaagcggauuggauaccacuggcguugacgaucaaaggccucaauccaacagccauuuucuuaacaacucucucaagaacuagcaagaaaaggagcuggccacuaaaugaggcuauuauggcagucgggauggugagcauucuagcuaguucucucuuaaagaaugauauucccaugacaggaccauuaguggcuggagggcuucucacuguguguuacgugcucacuggaaggucggcugacuuggaacuggaaagagcugcugacguaagaugggaagaacaggcagagauaucaggaaguaguccaauucugucgauaacaauaucggaagaugguagcaugucgauaaagaaugaagaagaagaacagacacugaccauacucaucagaacaggacuacuggugauaucaggacuuuuuccugugucaauaccaaucacggcagcugcaugguaccuuugggaagugaaaaaacaacgagcaggaguauugugggaugucccuucacccccaccugugggaaaggccgaacuggaagauggagccuauagaaucaagcagaaagggauccuaggauacucacagauuggagccggaguuuacaaagaaggaacauuccacacaauguggcaugucacacguggugcuguccuaaugcauaaagggaagagaauugaaccaucaugggcggacgucaagaaagaccuaauaucguauggaggaggcuggaagcuggaaggagaauggaaggaaggagaagaaguccagguccuggcauuagagccuggaaagaauccaagagccguccaaacaaaacccggucuuuuuaaaaccaacacuggaaccauaggcgccgugucucuggacuuuucuccuggaacgucaggaucuccaaucgucgauaaaaaaggaaaaguugugggccuuuauggcaacggugucgucacaaggaguggaacauaugugagugccauagcccagacugaaaaaagcaucgaagacaauccagagauugaagaugacaucuuuagaaagaaaagauugaccaucauggaccuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagcuaucagagcugagcacacugggcgggagauuguggaucuaaugugucaugccacauuuaccaugaggcuauuaucaccaauuagagugccaaauuacaaccugaucaucauggaugaagcccauuucacagacccagcaagcauagcagcuagaggauacauuucaacucgaguagagaugggugaagcagcugggauuuucaugacagccaccccuccuggaagcagagacccauuuccccagagcaacgcaccaaucauggaugaagaaagagaaaucccugagcguucguggaacucuggacaugaguggguuacggauuuuaaagggaagacuguuugguuuguuccaaguauaaaagcagggaaugauauagcagcuugccugagaaagaauggaaagaaagugauacaacucagcaggaaaacuuuugauucugaauauaucaagacuaggaccaaugauugggacuuuguggucacgacagacauuucagaaaugggugcuaacuucaaggcugagaggguuauagaccccagacgcugcaugaaaccagucauauuaacagacggugaagagcgggugaucuuggcaggacccaugccagugacccauucuagugcagcacaaagaagagggagaguaggaagaaauccaaaaaaugaaaaugaccaguacauauacaugggggaaccucuggaaaaugaugaagacugugcacacuggaaagaagcuaagaugcucuuggauaacaucaacacgccugaaggaaucauucccagcauguucgaaccagagcgugaaaagguggaugccauugauggugaauaccgcuugagaggagaagcgaggaaaacuuuuguggaccuaaugagaagaggagauuuaccagucuggcuagccuacagaguggcggcugaaggcaucaacuacgcagacagaagauggugcuuugauggagucaagaacaaccaaaucuuggaagaaaauguggaaguagaaauuuggacaaaagaaggagaaaggaagaaauuaaaacccagaugguuggaugcuaggaucuacucugacccauuggcgcucaaagaauucaaggaauucgcagcuggaagaaagucccugacccugaaucuaaucacagagauggguagacucccaaccuucaugacccagaaagcaaagaaugcacucgacaacuuagcaguccugcauacggcugaagcaggcggaagggcguacaaucaugcucuuagugaacugccggagacucuggagacauugcuuuuacugacacuuuuggccacagucacgggcggaaucuuccuguucuugaugagcggaaaggguauagggaagaugacccugggaaugugcugcauaaucacggcuaguauccucuuaugguaugcacaaauacagccacacuggauagcagcuucaauaauacuggaguuuuuucucauagucuugcucauuccagaaccagaaaaacagagaacaccccaagauaaccaguuaacuuauguugucauagccauccuuacaguaguggccgcaaccauggcaaacgagauggguuuccuggaaaaaacaaagaaagauuucggauugggaagcauuacaacccagcaaccugagaguaacauccuggacauagaucuacguccugcaucagcuuggacucuauaugccguggcaacaacuuucauuacaccaauguugaggcauagcauugaaaacuccucagugaaugugucccuaacagccauugccaaccaagccacaguguuaaugggucuugggaaaggauggccauugucaaaaauggacaucggaguuccccuucucgcuaucgggugcuauucacaagucaaccccauaacucucacugcagcccuucucuuauugguagcccauuaugccaucauagggccaggacuccaagcgaaagcaacuagagaggcucagaaaagagcagcagcgggcaucaugaaaaacccaacuguggauggaaugacagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcaaccgggcccaucucuacacugugggaaggaaauccagggagauuuuggaauacaacuauugcagugucaauggcuaacauuuuuagagggaguuaccuggccggagccggacuucucuuuucuaucaugaaaaacacggccaacacaagaaggggaacuggcaacacaggagagacgcuuggggagaaauggaaaaaccgguugaaugcauuagggaagagugaauuccagaucuacaagaaaaguggaauccaggaaguggacagaaccuuagcaaaagaaggcaucaaaagaggagaaacggaccaucacgcugugucgcgaggcucagcgaaacugagaugguucgucgagagaaaccuggucacaccagaagggaaaguaguggaccuuggcugcggcagggggggcuggucauacuauugugggggacuaaagaauguaaaagaagucaaaggccuaacaaaaggaggaccaggacacgaagaacccauucccaugucaacauaugguuggaaucuggugcgccuucaaaguggaguugauguuuuuuucacuccgccagaaaagugugacacacugcugugugacauaggggagucgucaccaaaccccacgguugaggcaggacgaacacucagaguucuaaacuuaguggaaaauuggcugaacaacaacacccaauuuugcauaaagguucuuaacccauacaugcccucaguuauagaaaaaauggaagcacuacaaaggaaauacggaggagcuuuggugaggaauccacucucacgaaauuccacacacgagauguacuggguauccaaugcuuccgggaauauagugucaucagugaacaugauuucaagaauguugauuaacagauucacaaugagacacaagaaagccacauacgagccagauguugaccucggaaguggaacccgcaacaucggaauugaaagugagacaccaaauuuagacauaauugggaaaagaauagaaaaaauaaaacaagagcaugaaacaucauggcacuaugaccaagaccacccauacaaaacgugggccuaccauggcagcuacgaaacaaaacagacuggaucagcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccgaaagaaggcacgaaaaaacuaaugaaaauuacugcagaauggcucuggaaagaacuaggaaagaaaaagacaccuaggaugugcaccagagaagaauucacaagaaaggugagaagcaaugcagccuuaggugccauauucacugaugagaacaaguggaagucggcacgugaggcuguugaagacaguggauuuugggaauugguugacaaggaaaggaaucuccaucuugaaggaaagugugaaacauguguguauaacaugaugggaaagagagagaagaagcuaggggaguucggcaaagcaaaaggcagcagagccauaugguacauguggcuuggagcacgcuucuuagaguuugaagcucuaggauucuugaacgaagaucacugguuuuccagagagaacucccugaguggaguggaaggagaagggcuacacaagcuaggcuacauuuuaagagacgugaguaagaaagaaggaggagcaauguaugcugaugacaccgcaggaugggacacaagaaucacacuagaggacuuaaaaaaugaagaaauggugacaaaccacauggaaggagaacacaagaaacuugcugaagccauuuucaaauuaacguaccaaaacaagguggugcgugugcaaagaccaacaccaagaggcacaguaauggacauuauaucgagaagagaccaaagagguaguggacaaguugucaccuacggccucaauacuuucaccaauauggaagcccaacugaucagacagauggagggagaaggaguuuucaaaagcauccagcaacugacaguaaaagaagaaauugcagugaaaaacugguuaauaagaguggggcgugagagguuaucaagaauggccaucaguggagaugauuguguugugaaacccuuagaugacagguuugcaagugcucuaacagcucuaaaugacaugggaaagguuaggaaagacauacaacaaugggaaccuucaagaggauggaacgauuggacacaagugcccuuuuguucacaccauuuccaugaguuaaucaugaaggacggucgugugcucguaguuccaugcagaaaccaagaugaacugauuggcagggcccgaauuucccagggagccgggugguccuugcgggaaacagccugucuggggaaguccuacgcccaaauguggagccugauguacuuccacagacgugaccuuaggcuggcggcaaaugccauuugcucggcaguuccaucacauuggauuccaacaagucgaacaaccugguccauacacgccacacaugaguggaugacaacagaagacauguugacagucuggaacaggguguggauucaagaaaacccauggauggaagacaaaacuccaguagaaacaugggaggaaaucccguauuuggggaaaagagaagaccaauggugcggcucauugauugggcuaacaagcagggccaccugggcaaagaacauccaaacagcaauaaaucaaguuagaucccuaauaggcaaugaggaauacacagacuacaugccaucuaugaaaagauucagaagagaagaggaagaggcaggagucuugugguag

SEQ ID NO: 6438 - RNA, 9876 nt, Artificial Sequence
  derived and/or modified CDS sequence (wt) from DENV-2__KM279521__SS-prME
acugcagguauaauuauuaugaugaucccaacagugauggcguuccauuuaaccacacgcaacggagaaccacacaugaucguuaguagacaagagaaagggaaaagucuccuguuuaaaacagagaacggugugaacauguguacccucauggccauggaccuuggugaacugugugaagacacaaucacuuauaauuguccucuucucaggcagaaugaaccagaagacauagacuguuggugcaacuccacgucuacauggguaacuuaugggacaugcaccgccacaggagaacacagaagggaaaaaagaucaguggcacucguuccacaugugggaaugggacuggagacacgaacugaaacauggaugucaucagaaggggccuggaaacaugcccagagaauugaaacuuggaucuugagacauccaggcuucaccauaauggcagcaauccuggcauacaccauaggaacaacauauuuccaaagaguccugauuuucauuuuacugacagcugucacuccuucaauggcaaugcguugcauaggaauaucaaauagagacuuuguggaagggguuucaggaggaagcuggguugauauagucuuggaacauggaagcugugugacgacgauggcgaaaaauaaaccaacguuggauuuugaacugauaaaaacagaagccaaacaucucgccacucuaaggaaguauuguguagaggcaaagcugaccaacacaacaacagcaucucgcugcccaacacaaggagaaccuagccuaaacgaagaacaggacaaaagauucgucugcaaacacuccaugguagacagaggauggggaaauggaugcggauuauuuggaaagggaggcaucgugaccugugcaauguucacaugcaaaaagaacauggaaggaaaagucgugcaaccagaaaacuuggaguacaccaucgugauaacaccucacucaggggaagagaaugcagucggaaaugacacaggaaaacauggcaaggaaauuaaaguaacaccacagaguuccaucacagaagcagaacuaacaggcuacggcacugucacgauggaaugcucuccgagaacgggccucgacuucaaugagaugguguugcugcaaauggaaaacaaggcuuggcuggugcacaggcaaugguucuuagaccugccguuaccauggcugcccggagcagacacacaaggaucaaauuggauacagaaggagacacuggucacuuucaaaaauccccaugcaaagaaacaggauguuguuguuuuagguucccaagaaggggccaugcacacggcacucacaggggccacggaaauccagaugucaucaggaaacuuacuguucacaggacaucuuaagugcaggcugagaauggacaaacuacagcucaaaggaaugucauauuccauguguacaggaaaguucaaaguugugaaggaaauagcagaaacacaacauggaacaauaguuauuagaguacaauaugaaggggacgguuccccgugcaagaucccuuuugaaauaauggacuuggaaaaaaggcaugucuuaggucgcuugauuaccgucaacccaauugucacagaaaaagacagcacagucaacauagaagcagaaccuccauuuggagacaguuacaucauuauaggaguagaaccaggacaacugaagcucagcugguuuaagaaaggaaguucuauuggccaaauguuugagacaacaaugagaggagcgaagagaauggccauucuaggugacacagccugggauuuuggaucccugggaggaguguucacaucuauaggaaaggcccuccaccaagucuuuggagcuaucuauggggcugccuucagugggguuucauggacuaugaaaauccucauaggagucgucaucacauggauaggaaugaauucacgcagcaccucacugucugugucacuaguauuagugggggucgugacauuguauuugggaguuauggugcaggccgauagugggugcguugucaguuggaaaaacaaagaacugaaaugugguagugggauuuuuaucacagacaacgugcacacauggacagaacaauacaaauuccaaccagaauccccuucaaagcuggcuucagcuauccagaaggcucaugaagaaggcauuuguggaauccgcucaguaacaagacuggagaaucugauguggaaacaaauaacaccagaauugaaucacauucuaacagaaaaugaaguaaaguugacuaucaugacaggagacaucaaaggaaucaugcaggcaggaaaacgaucccugcggccucaacccacugagcugaaguacuccuggaaggcauggggcaaagcgaaaaugcuuuccacagagcuucauaaccacaccuuucucauugauggccccgaaacagcagaaugucccaacacaaacagagcuuggaacucacuagaaguugaagacuauggcuuuggaguauucaccacuaacauauggcugaaauugaaagaaaggcaggauguguuuugugacucaaaacucaugucagcagccauaaaggacaauagagccguccacgccgauauggguuauuggauagaaagcgcacucaaugacacauggaagauugagaaagccucuuuuauugaaguuaaaagcugccacuggccaaagucacacacucucuggaguaauggagugcuggaaagugagaugauaauuccaaagaauuuugcaggaccaguuucacaacacaauuacagaccaggcuaccacacacaaacggcaggacccuggcaucuagguaggcuugagauggacuuugauuucugcgaaggaaccacagugguggugacugaggacuguggaaauagaggacccuccuuaagaacaacuacugcuucuggaaaacucauaacagaguggugcugccgaucuugcacauuaccaccgcuaagguacagaggugaggauggaugcugguaugguauggaaaucaggccauugaaagagaaagaagagaaccuggucaacucuuuggucacagccggacauggacagauugacaacuucucacuaggagucuugggaauggcauuguuccuggaagagaugcucaggacucgaguaggaacgaaacaugcaauauuacuaguugcagucucuuucgugacauugaucacagggaacauguccuuucgagauuuggggagagugauggucauggugggcgcuacuaugacggaugacauaggcaugggcgugacuuaucuugcccuauuagcagccuuuaaagucagaccaaccuuugcggcuggacuacucuuaagaaagcugaccuccaaggaauugaugaugaccaccauaggaaucguacuccucucucagaguaccauaccagagagcauacuugaacugacugacgcguuggcuuuggggaugaugguucucaaaauagugagaaacauggaaaaguaucagcuagcagugacuaucauggcaaucuugugcgucccaaaugcagugauauugcaaaaugcauggaaagugagcugcacaacacuggcagugguguccguuuccccacugcuuuuaacauccucacagcagaaagcggauuggauaccacuggcguugacgaucaaaggccucaauccaacagccauuuucuuaacaacucucucaagaacuagcaagaaaaggagcuggccacuaaaugaggcuauuauggcagucgggauggugagcauucuagcuaguucucucuuaaagaaugauauucccaugacaggaccauuaguggcuggagggcuucucacuguguguuacgugcucacuggaaggucggcugacuuggaacuggaaagagcugcugacguaagaugggaagaacaggcagagauaucaggaaguaguccaauucugucgauaacaauaucggaagaugguagcaugucgauaaagaaugaagaagaagaacagacacugaccauacucaucagaacaggacuacuggugauaucaggacuuuuuccugugucaauaccaaucacggcagcugcaugguaccuuugggaagugaaaaaacaacgagcaggaguauugugggaugucccuucacccccaccugugggaaaggccgaacuggaagauggagccuauagaaucaagcagaaagggauccuaggauacucacagauuggagccggaguuuacaaagaaggaacauuccacacaauguggcaugucacacguggugcuguccuaaugcauaaagggaagagaauugaaccaucaugggcggacgucaagaaagaccuaauaucguauggaggaggcuggaagcuggaaggagaauggaaggaaggagaagaaguccagguccuggcauuagagccuggaaagaauccaagagccguccaaacaaaacccggucuuuuuaaaaccaacacuggaaccauaggcgccgugucucuggacuuuucuccuggaacgucaggaucuccaaucgucgauaaaaaaggaaaaguugugggccuuuauggcaacggugucgucacaaggaguggaacauaugugagugccauagcccagacugaaaaaagcaucgaagacaauccagagauugaagaugacaucuuuagaaagaaaagauugaccaucauggaccuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagcuaucagagcugagcacacugggcgggagauuguggaucuaaugugucaugccacauuuaccaugaggcuauuaucaccaauuagagugccaaauuacaaccugaucaucauggaugaagcccauuucacagacccagcaagcauagcagcuagaggauacauuucaacucgaguagagaugggugaagcagcugggauuuucaugacagccaccccuccuggaagcagagacccauuuccccagagcaacgcaccaaucauggaugaagaaagagaaaucccugagcguucguggaacucuggacaugaguggguuacggauuuuaaagggaagacuguuugguuuguuccaaguauaaaagcagggaaugauauagcagcuugccugagaaagaauggaaagaaagugauacaacucagcaggaaaacuuuugauucugaauauaucaagacuaggaccaaugauugggacuuuguggucacgacagacauuucagaaaugggugcuaacuucaaggcugagaggguuauagaccccagacgcugcaugaaaccagucauauuaacagacggugaagagcgggugaucuuggcaggacccaugccagugacccauucuagugcagcacaaagaagagggagaguaggaagaaauccaaaaaaugaaaaugaccaguacauauacaugggggaaccucuggaaaaugaugaagacugugcacacuggaaagaagcuaagaugcucuuggauaacaucaacacgccugaaggaaucauucccagcauguucgaaccagagcgugaaaagguggaugccauugauggugaauaccgcuugagaggagaagcgaggaaaacuuuuguggaccuaaugagaagaggagauuuaccagucuggcuagccuacagaguggcggcugaaggcaucaacuacgcagacagaagauggugcuuugauggagucaagaacaaccaaaucuuggaagaaaauguggaaguagaaauuuggacaaaagaaggagaaaggaagaaauuaaaacccagaugguuggaugcuaggaucuacucugacccauuggcgcucaaagaauucaaggaauucgcagcuggaagaaagucccugacccugaaucuaaucacagagauggguagacucccaaccuucaugacccagaaagcaaagaaugcacucgacaacuuagcaguccugcauacggcugaagcaggcggaagggcguacaaucaugcucuuagugaacugccggagacucuggagacauugcuuuuacugacacuuuuggccacagucacgggcggaaucuuccuguucuugaugagcggaaaggguauagggaagaugacccugggaaugugcugcauaaucacggcuaguauccucuuaugguaugcacaaauacagccacacuggauagcagcuucaauaauacuggaguuuuuucucauagucuugcucauuccagaaccagaaaaacagagaacaccccaagauaaccaguuaacuuauguugucauagccauccuuacaguaguggccgcaaccauggcaaacgagauggguuuccuggaaaaaacaaagaaagauuucggauugggaagcauuacaacccagcaaccugagaguaacauccuggacauagaucuacguccugcaucagcuuggacucuauaugccguggcaacaacuuucaucacaccaauguugaggcauagcauugaaaacuccucagugaaugugucccuaacagccauugccaaccaagccacaguguuaaugggucuugggaaaggauggccauugucaaaaauggacaucggaguuccccuucucgcuaucgggugcuauucacaagucaaccccauaacucucacugcagcccuucucuuauugguagcccauuaugccaucauagggccaggacuccaagcgaaagcaacuagagaggcucagaaaagagcagcagcgggcaucaugaaaaacccaacuguggauggaaugacagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcaaccgggcccaucucuacacugugggaaggaaauccagggagauuuuggaauacaacuauugcagugucaauggcuaacauuuuuagagggaguuaccuggccggagccggacuucucuuuucuaucaugaaaaacacggccaacacaagaaggggaacuggcaacacaggagagacgcuuggggagaaauggaaaaaccgguugaaugcauuagggaagagugaauuccagaucuacaagaaaaguggaauccaggaaguggacagaaccuuagcaaaagaaggcaucaaaagaggagaaacggaccaucacgcugugucgcgaggcucagcgaaacugagaugguucgucgagagaaaccuggucacaccagaagggaaaguaguggaccuuggcugcggcagggggggcuggucauacuauugugggggacuaaagaauguaaaagaagucaaaggccuaacaaaaggaggaccaggacacgaagaacccauucccaugucaacauaugguuggaaucuggugcgccuucaaaguggaguugauguuuuuuucacuccgccagaaaagugugacacacugcugugugacauaggggagucgucaccaaaccccacgguugaggcaggacgaacacucagaguucuaaacuuaguggaaaauuggcugaacaacaacacccaauuuugcauaaagguucuuaacccauacaugcccucaguuauagaaaaaauggaagcacuacaaaggaaauacggaggagcuuuggugaggaauccacucucacgaaauuccacacacgagauguacuggguauccaaugcuuccgggaauauagugucaucagugaacaugauuucaagaauguugauuaacagauucacaaugagacacaagaaagccacauacgagccagauguugaccucggaaguggaacccgcaacaucggaauugaaagugagacaccaaauuuagacauaauugggaaaagaauagaaaaaauaaaacaagagcaugaaacaucauggcacuaugaccaagaccacccauacaaaacgugggccuaccauggcagcuacgaaacaaaacagacuggaucagcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccgaaagaaggcacgaaaaaacuaaugaaaauuacugcagaauggcucuggaaagaacuaggaaagaaaaagacaccuaggaugugcaccagagaagaauucacaagaaaggugagaagcaaugcagcuuuaggugccauauucacugaugagaacaaguggaagucggcacgugaggcuguugaagacaguggauuuugggaauugguugacaaggaaaggaaucuccaucuugaaggaaagugugaaacauguguguauaacaugaugggaaagagagagaagaagcuaggggaguucggcaaagcaaaaggcagcagagccauaugguacauguggcuuggagcacgcuucuuagaguuugaagcucuaggauucuugaacgaagaucacugguuuuccagagagaacucccugaguggaguggaaggagaagggcuacacaagcuaggcuacaucuuaagagacgugaguaagaaagaaggaggagcaauguaugcugaugacaccgcaggaugggacacaagaaucacacuagaggacuuaaaaaaugaagaaauggugacaaaccacauggaaggagaacacaagaaacuugcugaagccauuuucaaauuaacguaccaaaacaagguggugcgugugcaaagaccaacaccaagaggcacaguaauggacauuauaucgagaagagaccaaagagguaguggacaaguugucaccuacggccucaauacuuucaccaauauggaagcccaacugaucagacagauggagggagaaggaguuuucaaaagcauccagcaacugacaguaaaagaagaaauugcagugaaaaacugguuaauaagaguggggcgugagagguuaucaagaauggccaucaguggagaugauuguguugugaaacccuuagacgacagguuugcaagugcucuaacagcucuaaaugacaugggaaagguuaggaaagacauacaacaaugggaaccuucaagaggauggaacgauuggacacaagugcccuuuuguucacaccauuuccaugaguuaaucaugaaggacggucgcgugcucguaguuccaugcagaaaccaagaugaacugauuggcagggcccgaauuucccagggagccgggugguccuugcgggaaacagccugucuggggaaguccuacgcccaaauguggagccugauguacuuccacagacgugaccuuaggcuggcggcaaaugccauuugcucggcagucccaucacauuggauuccaacaagucgaacaaccugguccauacacgccacacaugaguggaugacaacagaagacauguugacagucuggaacaggguguggauucaagaaaacccauggauggaagacaaaacuccaguagaaucaugggaggaaaucccguauuuggggaaaagagaagaccaauggugcggcucauugauugggcuaacaagcagggccaccugggcaaagaacauccaaacagcaauaaaucaaguuagaucccuaauaggcaaugaggaauacacagacuacaugccaucuaugaaaagauucagaagagaagaggaagaggcaggagucuugugguag

SEQ ID NO: 6439 - RNA, 9876 nt, Artificial Sequence
  derived and/or modified CDS sequence (wt) from DENV-2__KM279583__SS-prME
acugcagguauaauuauuaugaugaucccaacagugauggcguuccauuuaaccacacgcaacggagaaccacacaugauuguuaguagacaagagaaagggaaaagucuccuguuuaaaacagagaacggugugaacauguguacccucauggccauggaccuuggugaacugugugaagacacaaucacuuauaauuguccucuucucaggcagaaugaaccagaagacauagacuguuggugcaacuccacgucuacauggguaacuuaugggacaugcaccgccacaggagaacacagaagggaaaaaagaucaguggcacucguuccacaugugggaaugggacuggagacacgaacugaaacauggaugucaucagaaggggccuggaaacaugcccagagaauugaaacuuggaucuugagacauccaggcuucaccauaauggcagcaauccuggcauacaccauaggaacaacauauuuccaaagaguccugauuuucauuuuacugacagcugucacuccuucaauggcaaugcguugcauaggaauaucaaauagagacuuuguggaagggguuucaggaggaagcuggguugauauagucuuggaacauggaagcugugugacgacgauggcgaaaaauaaaccaacguuggauuuugaacugauaaaaacagaagccaaacaucucgccacucuaaggaaguauuguguagaggcaaagcugaccaacacaacaacagcaucucgcugcccaacacaaggagaaccuagccuaaacgaagaacaggacaaaagauucgucugcaaacacuccaugguagacagaggauggggaaauggaugcggauuauuuggaaagggaggcaucgugaccugugcaauguucacaugcaaaaagaacauggaaggaaaagucgugcaaccagaaaacuuggaguacaccaucgugauaacaccucacucaggggaagagaaugcagucggaaaugacacaggaaaacauggcaaggaaauuaaaguaacaccacagaguuccaucacagaagcagaacuaacaggcuacggcacugucacgauggaaugcucuccgagaacgggccucgacuucaaugagauggcguugcugcaaauggaaaacaaggcuuggcuggugcacaggcaaugguucuuagaccugccguuaccauggcugcccggagcagacacacaaggaucaaauuggauacagaaggagacacuggucacuuucaaaaauccccaugcaaagaaacaggauguuguuguuuuagguucccaagaaggggccaugcacacggcacucacaggggccacggaaauccagaugucaucaggaaacuuacuguucacaggacaucuuaagugcaggcugagaauggacaaacuacagcucaaaggaaugucauauuccauguguacaggaaaguucaaaguugugaaggaaauagcagaaacacaacauggaacaauaguuauuagaguacaauaugaaggggacgguuccccgugcaagaucccuuuugaaauaauggacuuggaaaaaaggcaugucuuaggucgcuugauuaccgucaacccaauugucacagaaaaagacagcccagucaacauagaagcagaaccuccauuuggagacaguuacaucauuauaggaguagaaccaggacaacugaagcucagcugguuuaagaaaggaaguucuauuggccaaauguuugagacaacaaugagaggagcgaagagaauggccauucuaggugacacagcuugggauuuuggaucccugggaggaguguucacaucuauaggaaaggcccuccaccaagucuuuggagcuaucuauggggcugccuucagugggguuucauggacuaugaaaauccucauaggagucgucaucacauggauaggaaugaauucacgcagcaccucacugucugugucacuaguauuagugggggucgugacauuguauuugggaguuauggugcaggccgauagugggugcguugucaguuggaaaaacaaagaacugaaaugugguagugggauuuuuaucacagacaacgugcacacauggacagaacaauacaaauuccaaccagaauccccuucaaagcuggcuucagcuauccagaaggcucaugaagaaggcauuuguggaauccgcucaguaacaagacuggagaaucugauguggaaacaaauaacaccagaauugaaucacauucuaacagaaaaugaaguaaaguugacuaucaugacaggagacaucaaaggaaucaugcaggcaggaaaacgaucccugcggccucaacccacugagcugaaguacuccuggaaggcauggggcaaagcgaaaaugcuuuccacagagcuucauaaccacaccuuucucauugauggccccgaaacagcagaaugucccaacacaaacagagcuuggaacucacuagaaguugaagacuauggcuuuggaguauucaccacuaacauauggcugaaauugaaagaaaggcaggauguguuuugugacucaaaacucaugucagcagccauaaaggacaauagagccguccacgccgauauggguuauuggauagaaagcgcacucaaugacacauggaagauugagaaagccucuuuuauugaaguuaaaagcugccacuggccaaagucacacacucucuggaguaauggagugcuggaaagugagaugauaauuccaaagaauuuugcaggaccaguuucacaacacaauuacagaccaggcuaccacacacaaacggcaggacccuggcaucuagguaggcuugagauggacuuugauuucugcgaaggaaccacagugguggugacugaggacuguggaaauagaggacccuccuuaagaacaacuacugcuucuggaaaacucauaacagaguggugcugccgaucuugcacauuaccaccgcuaagguacagaggugaggauggaugcugguaugguauggaaaucaggccauugaaagagaaagaagagaaccuggucaacucuuuggucacagccggacauggacagauugacaacuucucacuaggagucuugggaauggcauuguuccuggaagagaugcucaggacucgaguaggaacgaaacaugcaauauuacuaguugcagucucuuucgugacauugaucacagggaacauguccuuucgagauuuggggagagugauggucauggugggcgcuacuaugacggaugacauaggcaugggcgugacuuaucuugcccuauuagcagccuuuaaagucagaccaaccuuugcggcuggacuacucuuaagaaagcugaccuccaaggaauugaugaugaccaccauaggaaucguacuccucucucagaguaccauaccagagagcauacuugaacugacugacgcguuggccuuggggaugaugguucucaaaauagugagaaacauggaaaaguaucagcuagcagugacuaucauggcaaucuugugcgucccaaaugcagugauauugcaaaaugcauggaaagugagcugcacaacacuggcagugguguccguuuccccacugcuuuuaacauccucacagcagaaagcggauuggauaccacuggcguugacgaucaaaggccucaauccaacagccauuuucuuaacaacucucucaagaacuagcaagaaaaggagcuggccacuaaaugaggcuauuauggcagucgggauggugagcauucuagcuaguucucucuuaaagaaugauauucccaugacaggaccauuaguggcuggagggcuucucacuguguguuacgugcucacuggaaggucggcugacuuggaacuggaaagagcugcugacguaagaugggaagaacaggcagagauaucaggaaguaguccaauucugucgauaacaauaucggaagaugguagcaugucgauaaagaaugaagaagaagaacagacacugaccauacucaucagaacaggacuacuggugauaucaggacuuuuuccugugucaauaccaaucacggcagcugcaugguaccuuugggaagugaaaaaacaacgagcaggaguauugugggaugucccuucacccccaccugugggaaaggccgaacuggaagauggagccuauagaaucaagcagaaagggauccuaggauacucacagauuggagccggaguuuacaaagaaggaacauuccacacaauguggcaugucacacguggugcuguccuaaugcauaaagggaagagaauugaaccaucaugggcggacgucaaaaaagaccuaauaucguauggaggaggcuggaagcuggaaggagaauggaaggaaggagaagaaguccagguccuggcauuagagccuggaaagaauccaagagccguccaaacaaaacccggucuuuuuaaaaccaacacuggaaccauaggcgccgugucucuggacuuuucuccuggaacgucaggaucuccaaucgucgauaaaaaaggaaaaguugugggccuuuauggcaacggugucgucacaaggaguggaacauaugugagugccauagcccagacugaaaaaagcaucgaagacaauccagagauugaagaugacaucuuuagaaagaaaagauugaccaucauggaccuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagcuaucagagcugagcacacugggcgggagauuguggaucuaaugugucaugccacauuuaccaugaggcuauuaucaccaauuagagugccaaauuacaaccugaucaucauggaugaagcccauuucacagacccagcaagcauagcagcuagaggauacauuucaacucgaguagagaugggugaagcagcugggauuuucaugacagccaccccuccuggaagcagagacccauuuccccagagcaacgcaccaaucauggaugaagaaagagaaaucccugagcguucguggaacucuggacaugaguggguuacggauuuuaaagggaagacuguuugguuuguuccaaguauaaaagcagggaaugauauagcagcuugccugagaaagaauggaaagaaagugauacaacucagcaggaaaacuuuugauucugaauauaucaagacuaggaccaaugauugggacuuuguggucacgacagacauuucagaaaugggugcuaacuucaaggcugagaggguuauagaccccagacgcugcaugaaaccagucauauuaacagacggugaagagcgggugaucuuggcaggacccaugccagugacccauucuagugcagcacaaagaagagggagaguaggaagaaauccaaaaaaugaaaaugaccaguacauauacaugggggaaccucuggaaaaugaugaagacugugcacacuggaaagaagcuaagaugcucuuggauaacaucaacacgccugaaggaaucauucccagcauguucgaaccagagcgugaaaagguggaugccauugauggugaauaccgcuugagaggagaagcgaggaaaacuuuuguggaccuaaugagaagaggagauuuaccagucuggcuagccuacagaguggcggcugaaggcaucaacuacgcagacagaagauggugcuuugauggagucaagaacaaccaaaucuuggaagaaaauguggaaguagaaauuuggacaaaagaaggagaaaggaagaaauuaaaacccagaugguuggaugcuaggaucuacucugacccauuggcgcucaaagaauucaaggaauucgcagcuggaagaaagucccugacccugaaucuaaucacagagauggguagacucccaaccuucaugacccagaaagcaaagaaugcacucgacaacuuagcaguccugcauacggcugaagcaggcggaagggcguacaaucaugcucuuagugaacugccggagacucuggagacauugcuuuuacugacacuuuuggccacagucacgggcggaaucuuccuguucuugaugagcggaaaggguauagggaagaugacccugggaaugugcugcauaaucacggcuaguauccucuuaugguaugcacaaauacagccacacuggauagcagcuucaauaauacuggaguuuuuucucauagucuugcucauuccagaaccagaaaaacagagaacaccccaagauaaccaguuaacuuauguugucauagccauccuuacaguaguggccgcaaccauggcaaacgagauggguuuccuggaaaaaacaaagaaagauuucggauugggaagcauuacaacccagcaaccugagaguaacauccuggacauagaucuacguccugcaucagcuuggacucuauaugccguggcaacaacuuucaucacaccaauguugaggcauagcauugaaaacuccucagugaaugugucccuaacagccauugccaaccaagccacaguguuaaugggucuugggaaaggauggccauugucaaaaauggacaucggaguuccccuucucgcuaucgggugcuauucacaagucaaccccauaacucucacugcagcccuucucuuauugguagcccauuaugccaucauagggccaggacuccaagcgaaagcaacuagagaggcucagaaaagagcagcagcgggcaucaugaaaaacccaacuguggauggaaugacagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcaaccgggcccaucucuacacugugggaaggaaauccagggagauuuuggaauacaacuauugcagugucaauggcuaacauuuuuagagggaguuaccuggccggagccggacuucucuuuucuaucaugaaaaacacggccaacacaagaaggggaacuggcaacacaggagagacgcuuggggagaaauggaaaaaccgguugaaugcauuagggaagagugaauuccagaucuacaagaaaagcggaauccaggaaguggacagaaccuuagcaaaagaaggcaucaaaagaggagaaacggaccaucacgcugugucgcgaggcucagcgaaacugagaugguucgucgagagaaaccuggucacaccagaagggaaaguaguggaccuuggcugcggcagggggggcuggucauacuauugugggggacuaaagaauguaaaagaagucaaaggccuaacaaaaggaggaccaggacacgaagaacccauucccaugucaacauaugguuggaaucuggugcgccuucaaaguggaguugauguuuuuuucacuccgccagaaaagugugacacacugcugugugacauaggggagucgucaccaaaccccacgguugaggcaggacgaacacucagaguucuaaacuuaguggaaaauuggcugaacaacaacacccaauuuugcauaaagguucuuaacccauacaugcccucaguuauagaaaaaauggaagcacuacaaaggaaauacggaggagcuuuggugaggaauccacucucacgaaauuccacacacgagauguacuggguauccaaugcuuccgggaauauagugucaucagugaacaugauuucaagaauguugauuaacagauucacaaugagacacaagaaagccacauacgagccagauguugaccucggaaguggaacccgcaacaucggaauugaaagugagacaccaaauuuagacauaauugggaaaagaauagaaaaaauaaaacaagagcaugaaacaucauggcacuaugaccaagaccacccauacaaaacgugggccuaccauggcagcuacgaaacaaaacagacuggaucagcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccgaaagaaggcacgaaaaaacuaaugaaaauuacugcagaauggcucuggaaagaacuaggaaagaaaaagacaccuaggaugugcaccagagaagaauucacaagaaaggugagaagcaaugcagcuuuaggugccauauucacugaugagaacaaguggaagucggcacgugaggcuguugaagacaguggauuuugggaauugguugacaaggaaaggaaucuccaucuugaaggaaagugugaaacauguguguauaacaugaugggaaagagagagaagaagcuaggggaguucggcaaagcaaaaggcagcagagccauaugguacauguggcuuggagcacgcuucuuagaguuugaagcucuaggauucuugaacgaagaucacugguuuuccagagagaacucccugaguggaguggaaggagaagggcuacacaagcuaggcuacauuuuaagagacgugaguaagaaagaaggaggagcaauguaugcugaugacaccgcaggaugggacacaagaaucacacuagaggacuuaaaaaaugaagaaauggugacaaaccacauggaaggagaacacaagaaacuugcugaagccauuuucaaauuaacguaccaaaacaagguggugcgugugcaaagaccaacaccaagaggcacaguaauggacauuauaucgagaagagaccaaagagguaguggacaaguugucaccuacggccucaauacuuucaccaauauggaagcccaacugaucagacagauggagggagaaggaguuuucaaaagcauccagcaacugacaguaaaagaagaaauugcagugaaaaacugguuaauaagaguggggcgugagagguuaucaagaauggccaucaguggagaugauuguguugugaaacccuuagaugacagguuugcaagugcucuaacagcucuaaaugacaugggaaagguuaggaaagacauacaacaaugggaaccuucaagaggauggaacgauuggacacaagugcccuuuuguucacaccauuuccaugaguuaaucaugaaggacggucgugugcucguaguuccaugcagaaaccaagaugaacugauuggcagggcccgaauuucccagggagccgggugguccuugcgggaaacagccugucuggggaaguccuacgcccaaauguggagccugauguacuuccacagacgugaccuuaggcuggcggcaaaugccauuugcucggcagucccaucacauuggauuccaacaagucgaacaaccugguccauacacgccacacaugaguggaugacaacagaagacauguugacagucuggaacaggguguggauucaagaaaacccauggauggaagacaaaacuccaguagaaucaugggaggaaaucccguauuuggggaaaagagaagaccaauggugcggcucauugauugggcuaacaagcagggccaccugggcaaagaacauccaaacagcaauaaaucaaguuagaucccuaauaggcaaugaggaauacacagacuacaugccaucuaugaaaagauucagaagagaagaggaagaggcaggagucuugugguag

SEQ ID NO: 6440 - RNA, 9876 nt, Artificial Sequence
  derived and/or modified CDS sequence (wt) from DENV-2__KM279585__SS-prME
acugcagguauaauuauuaugaugaucccaacagugauggcguuccauuuaaccacacgcaacggagaaccacacaugaucguuaguagacaagagaaagggaaaagucuccuguuuaaaacagagaacggugugaacauguguacccucauggccauggaccuuggugaacugugugaagacacaaucacuuauaauuguccucuucucaggcagaaugaaccagaagacauagacuguuggugcaacuccacgucuacauggguaacuuaugggacaugcaccgccacaggagaacacagaagggaaaaaagaucaguggcacucguuccacaugugggaaugggacuggagacacgaacugaaacauggaugucaucagaaggggccuggaaacaugcccagagaauugaaacuuggaucuugagacauccaggcuucaccauaauggcagcaauccuggcauacaccauaggaacaacauauuuccaaagaguccugauuuucauuuuacugacagcugucacuccuucaauggcaaugcguuguauaggaauaucaaauagagacuuuguggaagggguuucaggaggaagcuggguugauauagucuuggaacauggaagcugugugacgacgauggcgaaaaauaaaccaacguuggauuuugaacugauaaaaacagaagccaaacaucucgccacucuaaggaaguauuguguagaggcaaagcugaccaacacaacaacagcaucucgcugcccaacacaaggagaaccuagccuaaacgaagaacaggacaaaagauucgucugcaaacacuccaugguagacagaggauggggaaauggaugcggauuauuuggaaagggaggcaucgugaccugugcaauguucacaugcaaaaagaacauggaaggaaaagucgugcaaccagaaaacuuggaguacaccaucgugauaacaccucacucaggggaagagaaugcagucggaaaugacacaggaaaacauggcaaggaaauuaaaguaacaccacagaguuccaucacagaagcagaacuaacaggcuacggcacugucacgauggaaugcucuccgagaacgggccucgacuucaaugagaugguguugcugcaaauggaaaacaaggcuuggcuggugcacaggcaaugguucuuagaccugccguuaccauggcugcccggagcagacacacaaggaucaaauuggauacagaaggagacacuggucacuuucaaaaauccccaugcaaagaaacaggauguuguuguuuuagguucccaagaaggggccaugcacacggcacucacaggggccacggaaauccagaugucaucaggaaacuuacuguucacaggacaucuuaagugcaggcugagaauggacaaacuacagcucaaaggaaugucauauuccauguguacaggaaaguucaaaguugugaaggaaauagcagaaacacaacauggaacaauaguuguuagaguacaauaugaaggggacgguuccccgugcaagaucccuuuugaaauaauggacuuggaaaaaaggcaugucuuaggucgcuugauuaccgucaacccaauugucacagaaaaagacagcccagucaacauagaagcagaaccuccauuuggagacaguuacaucauuauaggaguagaaccaggacaacugaagcucagcugguuuaagaaaggaaguucuauuggccaaauguuugagacaacaaugagaggagcgaagagaauggccauucuaggugacacagcuugggauuuuggaucccugggaggaguguucacaucuauaggaaaggcccuccaccaagucuuuggagcuaucuauggggcugccuucagugggguuucauggacuaugaaaauccucauaggagucgucaucacauggauaggaaugaauucacgcagcaccucacugucugugucacuaguauuagugggggucgugacauuguauuugggaguuauggugcaggccgauagugggugcguugugaguuggaaaaacaaagaacugaaaugugguagugggauuuuuaucacagacaacgugcacacauggacagaacaauacaaauuccaaccagaauccccuucaaagcuggcuucagcuauccagaaggcucaugaagaaggcauuuguggaauccgcucaguaacaagacuggagaaucugauguggaaacaaauaacaccagaauugaaucacauucuaacagaaaaugaaguaaaguugacuaucaugacaggagacaucaaaggaaucaugcaggcaggaaaacgaucccugcggccucaacccacugagcugaaguacuccuggaaggcauggggcaaagcgaaaaugcuuuccacagagcuucauaaccacaccuuucucauugauggccccgaaacagcagaaugucccaacacaaacagagcuuggaacucacuagaaguugaagacuauggcuuuggaguauucaccacuaacauauggcugaaauugaaagaaaggcaggauguguuuugugacucaaaacucaugucagcagccauaaaggacaauagagccguccacgccgauauggguuauuggauagaaagcgcacucaaugacacauggaagauugagaaagccucuuuuauugaaguuaaaagcugccacuggccaaagucacacacucucuggaguaauggagugcuggaaagugagaugauaauuccaaagaauuuugcaggaccaguuucacaacacaauuacagaccaggcuaccacacacaaacggcaggacccuggcaucuagguaggcuugagauggacuuugauuucugcgaaggaaccacagugguggugacugaggacuguggaaauagaggacccuccuuaagaacaacuacugcuucuggaaaacucauaacagaguggugcugccgaucuugcacauuaccaccgcuaagguacagaggugaagauggaugcugguaugguauggaaaucaggccauugaaagagaaagaagagaaccuggucaacucuuuggucacagccggacauggacagauugacaacuucucacuaggagucuugggaauggcauuguuccuggaagagaugcucaggacucgaguaggaacgaaacaugcaauauuacuaguugcagucucuuucgugacauugaucacagggaacauguccuuucgagauuuggggagagugauggucauggugggcgcuacuaugacggaugacauaggcaugggcgugacuuaucuugcccuauuagcagccuuuaaagucagaccaaccuuugcggcuggacuacucuuaagaaagcugaccuccaaggaauugaugaugaccaccauaggaaucguacuccucucucagaguaccauaccagagagcauacuugaacugacugacgcguuggcuuuggggaugaugguucucaaaauagugagaaacauggaaaaguaucagcuagcagugacuaucauggcaaucuugugcgucccaaaugcagugauauugcaaaaugcauggaaagugagcugcacaacacuggcagugguguccguuuccccacugcuuuuaacauccucacagcagaaagcggauuggauaccacuggcguugacgaucaaaggccucaauccaacagccauuuucuuaacaacucucucaagaacuagcaagaaaaggagcuggccacuaaaugaggcuauuauggcagucgggauggugagcauucuagcuaguucucucuuaaagaaugauauucccaugacaggaccauuaguggcuggagggcuucucacuguguguuacgugcucacuggaaggucggcugacuuggaacuggaaagagcugcugacguaagaugggaagaacaggcagagauaucaggaaguaguccaauucugucgauaacaauaucggaagaugguagcaugucgauaaagaaugaagaagaagaacagacacugaccauacucaucagaacaggacuacuggugauaucaggacuuuuuccugugucaauaccaaucacggcagcugcaugguaccuuugggaagugaaaaaacaacgagcaggaguauugugggaugucccuucacccccaccugugggaaaggccgaacuggaagauggagccuauagaaucaagcagaaagggauccuaggauacucacagauuggagccggaguuuacaaagaaggaacauuccacacaauguggcaugucacacguggugcuguccuaaugcauaaagggaagagaauugaaccaucaugggcggacgucaagaaagaccuaauaucguauggaggaggcuggaagcuggaaggagaauggaaggaaggagaagaaguccagguccuggcauuagagccuggaaagaauccaagagccguccaaacaaaacccggucuuuuuaaaaccaacacuggaaccauaggcgccgugucucuggacuuuucuccuggaacgucaggaucuccaaucgucgauaaaaaaggaaaaguugugggccuuuauggcaacggugucgucacaaggaguggaacauaugugagugccauagcccagacugaaaaaagcaucgaagacaauccagagauugaagaugacaucuuuagaaagaaaagauugaccaucauggaccuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagcuaucagagcugagcacacugggcgggagauuguggaucuaaugugucaugccacauuuaccaugaggcuauuaucaccaauuagagugccaaauuacaaccugaucaucauggaugaagcccauuucacagacccagcaagcauagcagcuagaggauacauuucaacucgaguagagaugggugaagcagcugggauuuucaugacagccaccccuccuggaagcagagacccauuuccccagagcaacgcaccaaucauggaugaagaaagagaaaucccugagcguucguggaacucuggacaugaguggguuacggauuuuaaagggaagacuguuugguuuguuccaaguauaaaagcagggaaugauauagcagcuugccugagaaagaauggaaagaaagugauacaacucagcaggaaaacuuuugauucugaauauaucaagacuaggaccaaugauugggacuuuguggucacgacagacauuucagaaaugggugcuaacuucaaggcugagaggguuauagaccccagacgcugcaugaaaccagucauauuaacagacggugaagagcgggugaucuuggcaggacccaugccagugacccauucuagugcagcacaaagaagagggagaguaggaagaaauccaaaaaaugaaaaugaccaguacauauacaugggggaaccucuggaaaaugaugaagacugugcacacuggaaagaagcuaagaugcucuuggauaacaucaacacgccugaaggaaucauucccagcauguucgaaccagagcgugaaaagguggaugccauugauggugaauaccgcuugagaggagaagcgaggaaaacuuuuguggaccuaaugagaagaggagauuuaccagucuggcuagccuacagaguggcggcugaaggcaucaacuacgcagacagaagauggugcuuugauggagucaagaacaaccaaaucuuggaagaaaauguggaaguagaaauuuggacaaaagaaggagaaaggaagaaauuaaaacccagaugguuggaugcuaggaucuacucugacccauuggcgcucaaagaauucaaggaauucgcagcuggaagaaagucccugacccugaaucuaaucacagagauggguagacucccaaccuucaugacccagaaagcaaagaaugcacucgacaacuuagcaguccugcauacggcugaagcaggcggaagggcguacaaucaugcucuuagugaacugccggagacucuggagacauugcuuuuacugacacuuuuggccacagucacgggcggaaucuuccuguucuugaugagcggaaaggguauagggaagaugacccugggaaugugcugcauaaucacggcuaguauccucuuaugguaugcacaaauacagccacacuggauagcagcuucaauaauacuggaguuuuuucucauagucuugcucauuccagaaccagaaaaacagagaacaccccaagauaaccaguuaacuuauguugucauagccauccucacaguaguggccgcaaccauggcaaacgagauggguuuccuggaaaaaacaaagaaagauuucggauugggaagcauuacaacccagcaaccugagaguaacauccuggacauagaucuacguccugcaucagcuuggacucuauaugccguggcaacaacuuucaucacaccaauguugaggcauagcauugaaaacuccucagugaaugugucccuaacagccauugccaaccaagccacaguguuaaugggucuugggaaaggauggccauugucaaaaauggacaucggaguuccccuucucgcuaucgggugcuauucacaagucaaccccauaacucucacugcagcccuucucuuauugguagcccauuaugccaucauagggccaggacuccaagcgaaagcaacuagagaggcucagaaaagagcagcagcgggcaucaugaaaaacccaacuguggauggaaugacagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcaaccgggcccaucucuacacugugggaaggaaauccagggagauuuuggaauacaacuauugcagugucaauggcuaacauuuuuagagggaguuaccuggccggagccggacuucucuuuucuaucaugaaaaacacggccaacacaagaaggggaacuggcaacacaggagagacgcuuggggagaaauggaaaaaccgguugaaugcauuagggaagagugaauuccagaucuacaagaaaaguggaauccaggaaguggacagaaccuuagcaaaagaaggcaucaaaagaggagaaacggaccaucacgcugugucgcgaggcucagcgaaacugagaugguucgucgagagaaaccuggucacaccagaagggaaaguaguggaccuuggcugcggcagggggggcuggucauacuauugugggggacuaaagaauguaaaagaagucaaaggccuaacaaaaggaggaccaggacacgaagaacccauucccaugucaacauaugguuggaaucuggugcgccuucaaaguggaguugauguuuuuuucacuccgccagaaaagugugacacacugcugugugacauaggggagucgucaccaaaccccacgguugaggcaggacgaacacucagaguucuaaacuuaguggauaauuggcugaacaacaacacccaauuuugcauaaagguucuuaacccauacaugcccucaguuauagaaaaaauggaagcacuacaaaggaaauacggaggagcuuuggugaggaauccacucucacgaaauuccacacacgagauguacuggguauccaaugcuuccgggaauauagugucaucagugaacaugauuucaagaauguugauuaacagauucacaaugagacacaagaaagccacauacgagccagauguugaccucggaaguggaacccgcaacaucggaauugaaagugagacaccaaauuuagacauaauugggaaaagaauagaaaaaauaaaacaagagcaugaaacaucauggcacuaugaccaagaccacccauacaaaacgugggccuaccauggcagcuacgaaacaaaacagacuggaucagcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccgaaagaaggcacgaaaaaacuaaugaaaauuacugcagaauggcucuggaaagaacuaggaaagaaaaagacaccuaggaugugcaccagagaagaauucacaagaaaggugagaagcaaugcagccuuaggugccauauucacugaugagaacaaguggaagucggcacgugaggcuguugaagacaguggauuuugggaauugguugacaaggaaaggaaucuccaucuugaaggaaagugugaaacauguguguauaacaugaugggaaagagagagaagaagcuaggggaguucggcaaagcaaaaggcagcagagccauaugguacauguggcuuggagcacgcuucuuagaguuugaagcucuaggauucuugaacgaagaucacugguuuuccagagagaacucccugaguggaguggaaggagaagggcuacacaagcuaggcuacauuuuaagagacgugaguaagaaagaaggaggagcaauguaugcugaugacaccgcaggaugggacacaagaaucacacuagaggacuuaaaaaaugaagaaauggugacaaaccacauggaaggagaacacaagaaacuugcugaagccauuuucaaauuaacguaccaaaacaagguggugcgugugcaaagaccaacaccaagaggcacaguaauggacauuauaucgagaagagaccaaagagguaguggacaaguugucaccuacggccucaauacuuucaccaauauggaagcccaacugaucagacagauggagggagaaggaguuuucaaaagcauccagcaacugacaguaaaagaagaaauugcagugaaaaacugguuaauaagaguggggcgugagagguuaucaagaauggccaucaguggagaugauuguguugugaaacccuuagaugacagguuugcaagugcucuaacagcucuaaaugacaugggaaagguuaggaaagacauacaacaaugggaaccuucaagaggauggaacgauuggacacaagugcccuuuuguucacaccauuuccaugaguuaaucaugaaggacggucgugugcucguaguuccaugcagaaaccaagaugaacugauuggcagggcccgaauuucccagggagccgggugguccuugcgggaaacagccugccuggggaaguccuacgcccaaauguggaaccugauguacuuccacagacgugaccuuaggcuggcggcaaaugccauuugcucggcagucccaucacauuggauuccaacaagucgaacaaccugguccauacacgccacacaugaguggaugacaacagaagacauguugacagucuggaacaggguguggauucaagaaaacccauggauggaagacaaaacuccaguagaaucaugggaggaaaucccguauuuggggaaaagagaagaccaauggugcggcucauugauugggcuaacaagcagggccaccugggcaaagaacauccaaacagcaauaaaucaaguuagaucccuaauaggcaaugaggaauacacagacuacaugccaucuaugaaaagauucagaagagaagaggaagaggcaggagucuugugguag

SEQ ID NO: 6441 - RNA, 9876 nt, Artificial Sequence
  derived and/or modified CDS sequence (wt) from DENV-2__KM279525__SS-prME
acugcagguauaauuauuaugaugaucccaacagugauggcguuccauuuaaccacacgcaacggagaaccacacaugaucguuaguagacaagagaaagggaaaagucuccuguuuaaaacagagaacggugugaacauguguacccucauggccauggaccuuggugaacugugugaagacacaaucacuuauaauuguccucuucucaggcagaaugaaccagaagacauagacuguuggugcaacuccacgucuacauggguaacuuaugggacaugcaccgccacaggagaacacagaagggaaaaaagaucaguggcacucguuccacaugugggaaugggacuggagacacgaacugaaacauggaugucaucagaaggggccuggaaacaugcccagagaauugaaacuuggaucuugagacauccaggcuucaccauaauggcagcaauccuggcauacaccauaggaacaacauauuuccaaagaguccugauuuucauuuuacugacagcugucacuccuucaauggcaaugcguugcauaggaauaucaaauagagacuuuguggaagggguuucaggaggaagcuggguugauauagucuuggaacauggaagcugugugacgacgauggcgaaaaauaaaccaacguuggauuuugaacugauaaaaacagaagccaaacaucucgccacucuaaggaaguauuguguagaggcaaagcugaccaacacaacaacagcaucucgcugcccaacacaaggagaaccuagccuaaacgaagaacaggacaaaagauucgucugcaaacacuccaugguagacagaggauggggaaauggaugcggauuauuuggaaagggaggcaucgugaccugugcaauguucacaugcaaaaagaacauggaaggaaaagucgugcaaccagaaaacuuggaguacaccaucgugauaacaccucacucaggggaagagaaugcagucggaaaugacacaggaaaacauggcaaggaaauuaaaguaacaccacagaguuccaucacagaagcagaacuaacgggcuacggcacugucacgauggaaugcucuccgagaacgggccucgacuucaaugagaugguguugcugcaaauggaaaacaaggcuuggcuggugcacaggcaaugguucuuagaccugccguuaccauggcugcccggagcagacacacaaggaucaaauuggauacagaaggagacacuggucacuuucaaaaauccccaugcaaagaaacaggauguuguuguuuuagguucccaagaaggggccaugcacacggcacucacaggggccacggaaauccagaugucaucaggaaacuuacuguucacaggacaucuuaagugcaggcugagaauggacaaacuacagcucaaaggaaugucauauuccauguguacaggaaaguucaaaguugugaaggaaauagcagaaacacaacauggaacaauaguuauuagaguacaauaugaaggggacgguuccccgugcaagaucccuuuugaaauaauggacuuggaaaaaaggcaugucuuaggucgcuugauuaccgucaacccaauugucacagaaaaagacagcccagucaacauagaagcagaaccuccauuuggagacaguuacaucauuauaggaguagaaccaggacaacugaagcucagcugguuuaagaaaggaaguucuauuggccaaauguuugagacaacaaugagaggagcgaagagaauggccauucuaggugacacagcuugggauuuuggaucccugggaggaguguucacaucuauaggaaaggcccuccaccaagucuuuggagcuaucuauggggcugccuucagugggguuucauggacuaugaaaauccucauaggagucgucaucacauggauaggaaugaauucacgcagcaccucacugucugugucacuaguauuagugggggucgugacauuguauuugggaguuauggugcaggccgauagugggugcguugucaguuggaaaaacaaagaacugaaaugugguagugggauuuuuaucacagacaacgugcacacauggacagaacaauacaaauuccaaccagaauccccuucaaagcuggcuucagcuauccagaaggcucaugaagaaggcauuuguggaauccgcucaguaacaagacuggagaaucugauguggaaacaaauaacaccagaauugaaucacauucuaacagaaaaugaaguaaaguugacuaucaugacaggagacaucaaaggaaucaugcaggcaggaaaacgaucccugcggccucaacccacugagcugaaguacuccuggaaggcauggggcaaagcgaaaaugcuuuccacagagcuucauaaccacaccuuucucauugauggccccgaaacagcagaaugucccaacacaaacagagcuuggaacucacuagaaguugaagacuauggcuuuggaguauucaccacuaacauauggcugaaauugaaagaaaggcaggauguguuuugugacucaaaacucaugucagcagccauaaaggacaauagagccguccacgccgauauggguuauuggauagaaagcgcacucaaugacacauggaagauugagaaagccucuuuuauugaaguuaaaagcugccacuggccaaagucacacacucucuggaguaauggagugcuggaaagugagaugauaauuccaaagaauuuugcaggaccaguuucacaacacaauuacagaccaggcuaccacacacaaacggcaggacccuggcaucuagguaggcuugagauggacuuugauuucugcgaaggaaccacagugguggugacugaggacuguggaaauagaggacccuccuuaagaacaacuacugcuucuggaaaacucauaacagaguggugcugccgaucuugcacauuaccaccgcuaagguacagaggugaggauggaugcugguaugguauggaaaucaggccauugaaagagaaagaagagaaccuggucaacucuuuggucacagccggacauggacagauugacaacuucucacuaggagucuugggaauggcauuguuccuggaagagaugcucaggacucgaguaggaacgaaacaugcaauauuacuaguugcagucucuuucgugauauugaucacagggaacauguccuuucgagauuuggggagagugauggucauggugggcgcuacuaugacggaugacauaggcaugggcgugacuuaucuugcccuauuagcagccuuuaaagucagaccaaccuuugcggcuggacuacucuuaagaaagcugaccuccaaggaauugaugaugaccaccauaggaaucguacuccucucucagaguaccauaccagagaacauacuugaacugacugacgcguuggcuuuggggaugaugguucucaaaauagugagaaacauggaaaaguaucagcuagcagugacuaucauggcaaucuugugcgucccaaaugcagugauauugcaaaaugcauggaaagugagcugcacaacacuggcagugguguccguuuccccacugcuuuuaacauccucacagcagaaagcggauuggauaccacuggcguugacgaucaaaggccucaauccaacagccauuuucuuaacaacucucucaagaacuagcaagaaaaggagcuggccacuaaaugaggcuauuauggcagucgggauggugagcauucuagcuaguucucucuuaaagaaugauauucccaugacaggaccauuaguggcuggagggcuucucacuguguguuacgugcucacuggaaggucggcugacuuggaacuggaaagagcugcugacguaagaugggaagaacaggcagagauaucaggaaguaguccaauucugucgauaacaauaucggaagaugguagcaugucgauaaagaaugaagaagaagaacagacacugaccauacucaucagaacaggacuacuggugauaucaggacuuuuuccugugucaauaccaaucacggcagcugcaugguaccuuugggaagugaaaaaacaacgagcaggaguauugugggaugucccuucacccccaccugugggaaaggccgaacuggaagauggagccuauagaaucaagcagaaagggauccuaggauacucacagauuggagccggaguuuacaaagaaggaacauuccacacaauguggcaugucacacguggugcuguccuaaugcauaaagggaagagaauugaaccaucaugggcggacgucaagaaagaccuaauaucguauggaggaggcuggaagcuggaaggagaauggaaggaaggagaagaaguccagguccuggcauuagagccuggaaagaauccaagagccguccaaacaaaacccggucuuuuuaaaaccaacacuggaaccauaggcgccgugucucuggacuuuucuccuggaacgucaggaucuccaaucgucgauaaaaaaggaaaaguugugggccuuuauggcaacggugucgucacaaggaguggaacauaugugagugccauagcccagacugaaaaaagcaucgaagacaauccagagauugaagaugacaucuuuagaaagaaaagauugaccaucauggaccuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagcuaucagagcugagcacacugggcgggagauuguggaucuaaugugucaugccacauuuaccaugaggcuauuaucaccaauuagagugccaaauuacaaccugaucaucauggaugaagcccauuucacagacccagcaagcauagcagcuagaggauacauuucaacucgaguagagaugggugaagcagcugggauuuucaugacagccaccccuccuggaagcagagacccauuuccccagagcaacgcaccaaucauggaugaagaaagagaaaucccugagcguucguggaacucuggacaugaguggguuacggauuuuaaagggaagacuguuugguuuguuccaaguauaaaagcagggaaugauauagcagcuugccugagaaagaauggaaagaaagugauacaacucagcaggaaaacuuuugauucugaauauaucaagacuaggaccaaugauugggacuuuguggucacgacagacauuucagaaaugggugcuaacuucaaggcugagaggguuauagaccccagacgcugcaugaaaccagucauauuaacagacggugaagagcgggugaucuuggcaggacccaugccagugacccauucuagugcagcacaaagaagagggagaguaggaagaaauccaaaaaaugaaaaugaccaguacauauacaugggggaaccucuggaaaacgaugaagacugugcacacuggaaagaagcuaagaugcucuuggauaacaucaacacgccugaaggaaucauucccagcauguucgaaccagagcgugaaaagguggaugccauugauggugaauaccgcuugagaggagaagcgaggaaaacuuuuguggaccuaaugagaagaggagauuuaccagucuggcuagccuacagaguggcggcugaaggcaucaacuacgcagacagaagauggugcuuugauggagucaagaacaaccaaaucuuggaagaaaauguggaaguagaaauuuggacaaaagaaggagaaaggaagaaauuaaaacccagaugguuggaugcuaggaucuacucugacccauuggcgcucaaagaauucaaggaauucgcagcuggaagaaagucccugacccugaaucuaaucacagagauggguagacucccaaccuucaugacccagaaagcaaagaaugcacucgacaacuuagcaguccugcauacggcugaagcaggcggaagggcguacaaucaugcucuuagugaacugccggagacucuggagacauugcuuuuacugacacuuuuggccacagucacgggcggaaucuuccuguucuugaugagcggaaaggguauagggaagaugacccugggaaugugcugcauaaucacggcuaguauccucuuaugguaugcacaaauacagccacacuggauagcagcuucaauaauacuggaguuuuuucucauagucuugcucauuccagaaccagaaaaacagagaacaccccaagauaaccaguuaacuuauguugucauagccauccuuacaguaguggccgcaaccauggcaaacgagauggguuuccuggaaaaaacaaagaaagauuucggauugggaagcauuacaacccagcaaccugagaguaacauccuggacauagaucuacguccugcaucagcuuggacucuauaugccguggcaacaacuuucaucacaccaauguugaggcauagcauugaaaacuccucagugaaugugucccuaacagccauugccaaccaagccacaguguuaaugggucuugggaaaggauggccauugucaaaaauggacaucggaguuccccuucucgcuaucgggugcuauucacaagucaaccccauaacucucacugcagcccuucucuuauugguagcccauuaugccaucauagggccaggacuccaagcgaaagcaacuagagaggcucagaaaagagcagcagcgggcaucaugaaaaacccaacuguggauggaaugacagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcaaccgggcccaucucuacacugugggaaggaaauccagggagauuuuggaauacaacuauugcagugucaauggcuaacauuuuuagagggaguuaccuggccggagccggacuucucuuuucuaucaugaaaaacacggccaacacaagaaggggaacuggcaacacaggagagacgcuuggggagaaauggaaaaaccgguugaaugcauuagggaagagugaauuccagaucuacaagaaaaguggaauccaggaaguggacagaaccuuagcaaaagaaggcaucaaaagaggagaaacggaccaucacgcugugucgcgaggcucagcgaaacugagaugguucgucgagagaaaccuggucacaccagaagggaaaguaguggaccuuggcugcggcagggggggcuggucauacuauugugggggacuaaagaauguaaaagaagucaaaggccuaacaaaaggaggaccaggacacgaagaacccauucccaugucaacauaugguuggaaucuggugcgccuucaaaguggaguugauguuuuuuucacuccgccagaaaagugugacacacugcugugugacauaggggagucgucaccaaaccccacgguugaggcaggacgaacacucagaguucuaaacuuaguggaaaauuggcugaacaacaacacccaauuuugcauaaagguucuuaacccauacaugcccucaguuauagaaaaaauggaagcacuacaaaggaaauacggaggagcuuuggugaggaauccacucucacgaaauuccacacacgagauguacuggguauccaaugcuuccgggaauauagugucaucagugaacaugauuucaagaauguugauuaacagauucacaaugagacacaagaaagccacauacgagccagauguugaccucggaaguggaacccgcaacaucggaauugaaagugagacaccaaauuuagacauaauugggaaaagaauagaaaaaauaaaacaagagcaugaaacaucauggcacuaugaccaagaccacccauacaaaacgugggccuaccauggcagcuacgaaacaaaacagacuggaucagcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccgaaagaaggcacgaaaaaacuaaugaaaauuacugcagaauggcucuggaaagaacuaggaaagaaaaagacaccuaggaugugcaccagagaagaauucacaagaaaggugagaagcaaugcagcuuuaggugccauauucacugaugagaacaaguggaagucggcacgugaggcuguugaagacaguggauuuugggaauugguugacaaggaaaggaaucuccaucuugaaggaaagugugaaacauguguguauaacaugaugggaaagagagagaagaagcuaggggaguucggcaaagcaaaaggcagcagagccauaugguacauguggcuuggagcacgcuucuuagaguuugaagcucuaggauucuugaacgaagaucacugguuuuccagagagaacucccugaguggaguggaaggagaagggcuacacaagcuaggcuacauuuuaagagacgugaguaagaaagaaggaggagcaauguaugcugaugacaccgcaggaugggacacaagaaucacacuagaggacuuaaaaaaugaagaaauggugacaaaccacauggaaggagaacacaagaaacuugcugaagccauuuucaaauuaacguaccaaaacaagguggugcgugugcaaagaccaacaccaagaggcacaguaauggacauuauaucgagaagagaccaaagagguaguggacaaguugucaccuacggccucaauacuuucaccaauauggaagcccaacugaucagacagauggagggagaaggaguuuucaaaagcauccagcaacugacaguaaaagaagaaauugcagugaaaaacugguuaauaagaguggggcgugagagguuaucaagaauggccaucaguggagaugauuguguugugaaacccuuagaugacagguuugcaagugcucuaacagcucuaaaugacaugggaaagguuaggaaagacauacaacaaugggaaccuucaagaggauggaacgauuggacacaagugcccuuuuguucacaccauuuccaugaguuaaucaugaaggacggucgugugcucguaguuccaugcagaaaccaagaugaacugauuggcagggcccgaauuucccagggagccgggugguccuugcgggaaacagccugucuggggaaguccuacgcccaaauguggagccugauguacuuccacagacgugaccuuaggcuggcggcaaaugccauuugcucggcagucccaucacauuggauuccaacaagucgaacaaccugguccauacacgccacacaugaguggaugacaacagaagacauguugacagucuggaacaggguguggauucaagaaaacccauggauggaagacaaaacuccaguagaaucaugggaggaaaucccguauuuggggaaaagagaagaccaauggugcggcucauugauugggcuaacaagcagggccaccugggcaaagaacauccaaacagcaauaaaucaaguuagaucccuaauaggcaaugaggaauacacagacuacaugccaucuaugaaaagauucagaagagaagaggaagaggcaggagucuugugguag

SEQ ID NO: 6442 - RNA, 9876 nt, Artificial Sequence
  derived and/or modified CDS sequence (wt) from DENV-2__KM279528__SS-prME
acugcagguauaauuauuaugaugaucccaacagugauggcguuccauuuaaccacacgcaacggagaaccacacaugaucguuaguagacaagagaaagggaaaagucucuuguuuaaaacagagaacggugugaacauguguacccucauggccauggaccuuggugaacugugugaagacacaaucacuuauaauuguccucuucucaggcagaaugaaccagaagacauagacuguuggugcaacuccacgucuacauggguaacuuaugggacaugcaccgccacaggagaacacagaagggaaaaaagaucaguggcacucguuccacaugugggaaugggacuggagacacgaacugaaacauggaugucaucagaaggggccuggaaacaugcccagagaauugaaacuuggaucuugagacauccaggcuucaccauaauggcagcaauccuggcauacaccauaggaacaacauauuuccaaagaguccugauuuucauuuuacugacagcugucacuccuucaauggcaaugcguuguauaggaauaucaaauagagacuuuguggaagggguuucaggaggaagcuggguugauauagucuuggaacauggaagcugugugacgacgauggcgaaaaauaaaccaacguuggauuuugaacugauaaaaacagaagccaaacaucucgccacucuaaggaaguauuguguagaggcaaagcugaccaacacaacaacagcaucucgcugcccaacacaaggagaaccuagccuaaacgaagaacaggacaaaagauucgucugcaaacacuccaugguagacagaggauggggaaauggaugcggauuauuuggaaagggaggcaucgugaccugugcaauguucacaugcaaaaagaacauggaaggaaaagucgugcaaccagaaaacuuggaguacaccaucgugauaacaccucacucaggggaagagaaugcagucggaaaugacacaggaaaacauggcaaggaaauuaaaguaacaccacagaguuccaucacagaagcagaacuaacaggcuacggcacugucacgauggaaugcucuccgagaacgggccucgacuucaaugagaugguguugcugcaaauggaaaacaaggcuuggcuggugcacaggcaaugguucuuagaccugccguuaccauggcugcccggagcagacacacaaggaucaaauuggauacagaaggagacacuggucacuuucaaaaauccccaugcaaagaaacaggauguuguuguuuuagguucccaagaaggggccaugcacacggcacucacaggggccacggaaauccagaugucaucaggaaacuuacuguucacaggacaucuuaagugcaggcugagaauggacaaacuacagcucaaaggaaugucauauuccauguguacaggaaaguucaaaguugugaaggaaauagcagaaacacaacauggaacaauaguuauuagaguacaauaugaaggggacgguuccccgugcaagaucccuuuugaaauaauggacuuggaaaaaaggcaugucuuaggucgcuugauuaccgucaacccaauugucacagaaaaagacagcccagucaacauagaagcagaaccuccauuuggagacaguuacaucauuauaggaguagaaccaggacaacugaagcucagcugguuuaagaaaggaaguucuauuggccaaauguuugagacaacaaugagaggagcgaagagaauggccauucuaggugacacagcuugggauuuuggaucccugggaggaguguucacaucuauaggaaaggcccuccaccaagucuuuggagcuaucuauggggcugccuucagugggguuucauggacuaugaaaauccucauaggagucgucaucacauggauaggaaugaauucacgcagcaccucacugucugugucacuaguauuagugggggucgugacauuguauuugggaguuauggugcaggccgauagugggugcguugugaguuggaaaaacaaagaacugaaaugugguagugggauuuuuaucacagacaacgugcacacauggacagaacaauacaaauuccaaccagaauccccuucaaagcuggcuucagcuauccagaaggcucaugaagaaggcauuuguggaauccgcucaguaacaagacuggagaaucugauguggaaacaaauaacaccagaauugaaucacauucuaacagaaaaugaaguaaaguugacuaucaugacaggagacaucaaaggaaucaugcaggcaggaaaacgaucccugcggccucaacccacugagcugaaguacuccuggaaggcauggggcaaagcgaaaaugcuuuccacagagcuucauaaccauaccuuucucauugauggccccgaaacagcagaaugucccaacacaaacagagcuuggaacucacuagaaguugaagacuauggcuuuggaguauucaccacuaacauauggcugaaauugaaagaaaggcaggauguguuuugugacucaaaacucaugucagcagccauaaaggacaauagagccguccacgccgauauggguuauuggauagaaagcgcacucaaugacacauggaagauugagaaagccucuuuuauugaaguuaaaagcugccacuggccaaagucacacacucucuggaguaauggagugcuggaaagugagaugauaauuccaaagaauuuugcaggaccaguuucacaacacaauuacagaccaggcuaccacacacaaacggcaggacccuggcaucuagguaggcuugagauggacuuugauuucugcgaaggaaccacagugguggugacugaggacuguggaaauagaggacccuccuuaagaacaacuacugcuucuggaaaacucauaacagaguggugcugccgaucuugcacauuaccaccgcuaagguacagaggugaggauggaugcugguaugguauggaaaucaggccauugaaagagaaagaagagaaccuggucaacucuuuggucacagccggacauggacagauugacaacuucucacuaggagucuugggaauggcauuguuccuggaagagaugcucaggacucgaguaggaacgaaacaugcaauauuacuaguugcagucucuuucgugacauugaucacagggaacauguccuuucgagauuuggggagagugauggucauggugggcgcuacuaugacggaugacauaggcaugggcgugacuuaucuugcccuauuagcagccuuuaaagucagaccaaccuuugcggcuggacuacucuuaagaaagcugaccuccaaggaauugaugaugaccaccauaggaaucguacuccucucucagaguaccauaccaaagagcauacuugaacugacugacgcguuggcuuuggggaugaugguucucaaaauagugagaaacauggaaaaguaucagcuagcagugacuaucauggcaaucuugugcgucccaaaugcagugauauugcaaaaugcauggaaagugagcugcacaacacuggcagugguguccguuuccccacugcuuuuaacauccucacagcagaaagcggauuggauaccacuggcguugacgaucaaaggccucaauccaacagccauuuucuuaacaacucucucaagaacuagcaagaaaaggagcuggccacuaaaugaggcuauuauggcagucgggauggugagcauucuagcuaguucucucuuaaagaaugauauucccaugacaggaccauuaguggcuggagggcuucucacuguguguuacgugcucacuggaaggucggcugacuuggaacuggaaagagcugcugacguaagaugggaagaacaggcagagauaucaggaaguaguccaauucugucgauaacaauaucggaagaugguagcaugucgauaaagaaugaagaagaagaacagacacugaccauacucaucagaacaggacuacuggugauaucaggacuuuuuccugugucaauaccaaucacggcagcugcaugguaccuuugggaagugaaaaaacaacgagcaggaguauugugggaugucccuucacccccaccugugggaaaggccgaacuggaagauggagccuauagaaucaagcagaaagggauccuaggauacucacagauuggagccggaguuuacaaagaaggaacauuccacacaauguggcaugucacacguggugcuguccuaaugcauaaagggaagagaauugaaccaucaugggcggacgucaagaaagaccuaauaucguauggaggaggcuggaagcuggaaggagaauggaaggaaggagaagaaguccagguccuggcauuagagccuggaaagaauccaagagccguccaaacaaaacccggucuuuuuaaaaccaacacuggaaccauaggcgccgugucucuggacuuuucuccuggaacgucaggaucuccaaucgucgauaaaaaaggaaaaguugugggccuuuauggcaacggugucgucacaaggaguggaacauaugugagugccauagcccagacugaaaaaagcaucgaagacaauccagagauugaagaugacaucuuuagaaagaaaagauugaccaucauggaccuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaccaaacuccagcuaucagagcugagcacacugggcgggagauuguggaucuaaugugucaugccacauuuaccaugaggcuauuaucaccaauuagagugccaaauuacaaccugaucaucauggaugaagcccauuucacagacccagcaagcauagcagcuagaggauacauuucaacucgaguagagaugggugaagcagcugggauuuucaugacagccaccccuccuggaagcagagacccauuuccccagagcaacgcaccaaucauggaugaagaaagagaaaucccugagcguucguggaacucuggacaugaguggguuacggauuuuaaagggaagacuguuugguuuguuccaaguauaaaagcagggaaugauauagcagcuugccugagaaagaauggaaagaaagugauacaacucagcaggaaaacuuuugauucugaauauaucaagacuaggaccaaugauugggacuuuguggucacgacagacauuucagaaaugggugcuaacuucaaggcugagaggguuauagaccccagacgcugcaugaaaccagucauauuaacagacggugaagagcgggugaucuuggcaggacccaugccagugacccauucuagugcagcacaaagaagagggagaguaggaagaaauccaaaaaaugaaaaugaccaguacauauacaugggggaaccucuggaaaaugaugaagacugugcacacuggaaagaagcuaagaugcucuuggauaacaucaacacgccugaaggaaucauucccagcauguucgaaccagagcgugaaaagguggaugccauugauggugaauaccgcuugagaggagaagcgaggaaaacuuuuguggaccuaaugagaagaggagacuuaccagucuggcuagccuacagaguggcggcugaaggcaucaacuacgcagacagaagauggugcuuugauggagucaagaacaaccaaaucuuggaagaaaauguggaaguagaaauuuggacaaaagaaggagaaaggaagaaauuaaaacccagaugguuggaugcuaggaucuacucugacccauuggcgcucaaagaauucaaggaauucgcagcuggaagaaagucccugacccugaaucuaaucacagagauggguagacucccaaccuucaugacccagaaagcaaagaaugcacucgacaacuuagcaguccugcauacggcugaagcaggcggaagggcguacaaucaugcucuuagugaacugccggagacucuggagacauugcuuuuacugacacuuuuggccacagucacgggcggaaucuuccuguucuugaugagcggaaaggguauagggaagaugacccugggaaugugcugcauaaucacggcuaguauccucuuaugguaugcacaaauacagccacacuggauagcagcuucaauaauacuggaguuuuuucucauagucuugcucauuccagaaccagaaaaacagagaacaccccaagauaaccaguuaacuuauguugucauagccauccuuacaguaguggccgcaaccauggcaaacgagauggguuuccuggaaaaaacaaagaaagauuucggauugggaagcauuacaacccagcaaccugagaguaacauccuggacauagaucuacguccugcaucagcuuggacucuauaugccguggcaacaacuuucaucacaccaauguugaggcauagcauugaaaacuccucagugaaugugucccuaacagccauugccaaccaagccacaguguuaaugggucuugggaaaggauggccauugucaaaaauggacaucggaguuccccuucucgcuaucgggugcuauucacaagucaaccccauaacucucacugcagcccuucucuuauugguagcccauuaugccaucauagggccaggacuccaagcgaaagcaacuagagaggcucagaaaagagcagcagcgggcaucaugaaaaacccaacuguggauggaaugacagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcaaccgggcccaucucuacacugugggaaggaaauccagggagauuuuggaauacaacuauugcagugucaauggcuaacauuuuuagagggaguuaccuggccggagccggacuucucuuuucuaucaugaaaaacacggccaacacaagaaggggaacuggcaacacaggagagacgcuuggggagaaauggaaaaaccgguugaaugcauuagggaagagugaauuccagaucuacaagaaaaguggaauccaggaaguggacagaaccuuagcaaaagaaggcaucaaaagaggagaaacggaccaucacgcugugucgcgaggcucagcgaaacugagaugguucgucgagagaaaccuggucacaccagaagggaaaguaguggaccuuggcugcggcagggggggcuggucauacuauugugggggacuaaagaauguaaaagaagucaaaggccuaacaaaaggaggaccaggacacgaagaacccauucccaugucaacauaugguuggaaucuggugcgccuucaaaguggaguugauguuuuuuuuacuccgccagaaaagugugacacacugcugugugacauaggggagucgucaccaaaccccacgguugaggcaggacgaacacucagaguucuaaacuuaguggaaaauuggcugaacaacaacacccaauuuugcauaaagguucuuaacccauacaugcccucaguuauagaaaaaauggaagcacuacaaaggaaauacggaggagcuuuggugaggaauccacucucacgaaauuccacacacgagauguacuggguauccaaugcuuccgggaauauagugucaucagugaacaugauuucaagaauguugauuaacagauucacaaugagacacaagaaagccacauacgagccagauguugaccucggaaguggaacccgcaacaucggaauugaaagugagacaccaaauuuagacauaauugggaaaagaauagaaaaaauaaaacaagagcaugaaacaucauggcacuaugaccaagaccacccauacaaaacgugggccuaccauggcagcuacgaaacaaaacagacuggaucagcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccgaaagaaggcacgaaaaaacuaaugaaaauuacugcagaauggcucuggaaagaacuaggaaagaaaaagacaccuaggaugugcaccagagaagaauucacaagaaaggugagaagcaaugcagccuuaggugccauauucacugaugagaacaaguggaagucggcacgugaggcuguugaagacaguggauuuugggaauugguugacaaggaaaggaaucuccaucuugaaggaaagugugaaacauguguguauaacaugaugggaaagagagagaagaagcuaggggaguucggcaaagcaaaaggcagcagagccauaugguacauguggcuuggagcacgcuucuuagaguuugaagcucuaggauucuugaacgaagaucacugguuuuccagagagaacucccugaguggaguggaaggagaagggcuacacaagcuaggcuacauuuuaagagacgugaguaagaaagaaggaggagcaauguaugcugaugacaccgcaggaugggacacaagaauuacacuagaggacuuaaaaaaugaagaaauggugacaaaccacauggaaggagaacacaagaaacuugcugaagccauuuucaaauuaacguaccaaaacaagguggugcgugugcaaagaccaacaccaagaggcacaguaauggacauuauaucgagaagagaccaaagaggcaguggacaaguugucaccuacggccucaauacuuucaccaauauggaagcccaacugaucagacagauggagggagaaggaguuuucaaaagcauccagcaacugacaguaaaagaagaaauugcagugaaaaacugguuaauaagaguggggcgugagagguuaucaagaauggccaucaguggagaugauuguguugugaagcccuuagaugacagguuugcaagugcucuaacagcucuaaaugacaugggaaagguuaggaaagacauacaacaaugggaaccuucaagaggauggaacgauuggacacaagugcccuuuuguucacaccauuuccaugaguuaaucaugaaggacggucgugugcucguaguuccaugcagaaaccaagaugaacugauuggcagggcccgaauuucccagggagccgggugguccuugcgggaaacagccugucuggggaaguccuacgcccaaauguggagccugauguacuuccacagacgugaccuuaggcuggcggcaaaugccauuugcucggcagucccaucacauuggauuccaacaagucgaacaaccugguccauacacgccacacaugaguggaugacaacagaagacauguugacagucuggaacaggguguggauucaagaaaacccauggauggaagacaaaacuccaguagaaucaugggaggaaaucccguauuuggggaaaagagaagaccaauggugcggcucauugauugggcuaacaagcagggccaccugggcaaagaacauccaaacagcaauaaaucaaguuagaucccuaauaggcaaugaggaauacacagacuacaugccaucuaugaaaagauucagaagagaagaggaagaggcaggagucuugugguag

SEQ ID NO: 6443 - RNA, 9876 nt, Artificial Sequence
  derived and/or modified CDS sequence (wt) from DENV-2__KM279533__SS-prME
acugcagguauaauuauuaugaugaucccaacagugauggcguuccauuuaaccacacgcaacggagaaccacacaugauuguuaguagacaagagaaagggaaaagucuccuguuuaaaacagagaacggugugaacauguguacccucauggccauggaccuuggugaacugugugaagacacaaucacuuauaauuguccucuucucaggcagaaugaaccagaagacauagacuguuggugcaacuccacgucuacauggguaacuuaugggacaugcaccgccacaggagaacacagaagggaaaaaagaucaguggcacucguuccacaugugggaaugggacuggagacacgaacugaaacauggaugucaucagaaggggccuggaaacaugcccagagaauugaaacuuggaucuugagacauccgggcuucaccauaauggcagcaauccuggcauacaccauaggaacaacauauuuccaaagaguccugauuuucauuuuacugacagcugucacuccuucaauggcaaugcguugcauaggaauaucaaauagagacuuuguggaagggguuucaggaggaagcuggguugauauagucuuggaacauggaagcugugugacgacgauggcgaaaaauaaaccaacguuggauuuugaauugauaaaaacagaagccaaacaucucgccacucuaaggaaguauuguguagaggcaaagcugaccaacacaacaacagcaucucgcugcccaacacaaggagaaccuagccuaaacgaagaacaggacaaaagauucgucugcaaacacuccaugguagacagaggauggggaaauggaugcggauuauuuggaaagggaggcaucgugaccugugcaauguucacaugcaaaaagaacauggaaggaaaagucgugcaaccagaaaacuuggaguacaccaucgugauaacaccucacucaggggaagagaaugcagucggaaaugacacaggaaaacauggcaaggaaauuaaaguaacaccacagaguuccaucacagaagcagaacuaacaggcuacggcacugucacgauggaaugcucuccgagaacgggccucgacuucaaugagaugguguugcugcaaauggaaaacaaggcuuggcuggugcacaggcaaugguucuuagaccugccguuaccauggcugcccggagcagacacacaaggaucaaauuggauacagaaggagacacuggucacuuucaaaaauccccaugcaaagaaacaggauguuguuguuuuagguucccaagaaggggccaugcacacggcacucacaggggccacggaaauccagaugucaucaggaaacuuacuguucacgggacaucuuaagugcaggcugagaauggacaaacuacagcucaaaggaaugucauauuccauguguacaggaaaguucaaaguugugaaggaaauagcagaaacacaacauggaacaauaguuauuagaguacaauaugaaggggacgguuccccgugcaagaucccuuuugaaauaauggacuuggaaaaaaggcaugucuuaggucgcuugauuaccgucaacccaauugucacagaaaaagacagcccagucaacauagaagcagaaccuccauuuggagacaguuacaucauuauaggaguagaaccaggacaacugaagcucagcugguuuaagaaaggaaguucuauuggccaaauguuugagacaacaaugagaggagcgaagagaauggccauucuaggugacacagcuugggauuuuggaucccugggaggaguguucacaucuauaggaaaggcccuccaccaagucuuuggagcuaucuauggggcugccuucagugggguuucauggacuaugaaaauccucauaggagucgucaucacauggauaggaaugaauucacgcagcaccucacugucugugucacuaguauuagugggggucgugacauuguauuugggaguuauggugcaggccgauagugggugcguugucaguuggaaaaacaaagaacugaaaugugguagugggauuuuuaucacagacaacgugcacacauggacagaacaauacaaauuccaaccagaauccccuucaaagcuggcuucagcuauccagaaggcucaugaagaaggcauuuguggaauccgcucaguaacaagacuggagaaucugauguggaaacaaauaacaccagaauugaaucacauucuaacagaaaaugaaguaaaguugacuaucaugacaggagacaucaaaggaaucaugcaggcaggaaaacgaucccugcggccucaacccacugagcugaaguacuccuggaaggcauggggcaaagcgaaaaugcuuuccacagagcuucauaaccacaccuuucucauugauggccccgaaacagcagaaugucccaacacaaacagagcuuggaacucacuagaaguugaagacuauggcuuuggaguauucaccacuaacauauggcugaaauugaaagaaaggcaggauguguuuugugacucaaaacucaugucagcagccauaaaggacaauagagccguccacgccgauauggguuauuggauagaaagcgcacucaaugacacauggaagauugagaaagccucuuuuauugaaguuaaaagcugccacuggccaaagucacacacucucuggaguaauggagugcuggaaagugagaugauaauuccaaagaauuuugcaggaccaguuucacaacacaauuacagaccaggcuaccacacacaaacggcaggacccuggcaucuagguaggcuugagauggacuuugauuucugcgaaggaaccacagugguggugacugaggacuguggaaauagaggacccuccuuaagaacaacuacugcuucuggaaaacucauaacagaguggugcugccgaucuugcacauuaccaccgcuaagguacagaggugaggauggaugcugguaugguauggaaaucaggccauugaaagagaaagaagagaaccuggucaacucuuuggucacagccggacauggacagauugacaacuucucacuaggagucuugggaauggcauuguuccuggaagagaugcucaggacucgaguaggaacgaaacaugcaauauuacuaguugcagucucuuucgugacauugaucacagggaacauguccuuucgagauuuggggagagugauggucauggugggcgcuacuaugacggaugacauaggcaugggcgugacuuaucuugcccuauuagcagccuuuaaagucagaccaaccuuugcggcuggacuacucuuaagaaagcugaccuccaaggaauugaugaugaccaccauaggaaucguacuccucucucagaguaccauaccagagagcauacuugaacugacugacgcguuggcuuuggggaugaugguucucaaaauagugagaaacauggaaaaguaucagcuagcagugacuaucauggcaaucuugugcgucccaaaugcagugauauugcaaaaugcauggaaagugagcugcacaacacuggcagugguguccguuuccccacugcuuuuaacauccucacagcagaaagcggauuggauaccacuggcguugacgaucaaaggccucaauccaacagccauuuucuuaacaacucucucaagaacuagcaagaaaaggagcuggccacuaaaugaggcuauuauggcagucgggauggugagcauucuagcuaguucucucuuaaagaaugauauucccaugacaggaccauuaguggcuggagggcuucucacuguguguuacgugcucacuggaaggucggcugacuuggaacuggaaagagcugcugacguaagaugggaagaacaggcagagauaucaggaaguaguccaauucugucgauaacaauaucggaagaugguagcaugucgauaaagaaugaagaagaagaacagacacugaccauacucaucagaacaggacuacuggugauaucaggacuuuuuccugugucaauaccaaucacggcagcugcaugguaccuuugggaagugaaaaaacaacgagcaggaguauugugggaugucccuucacccccaccugugggaaaggccgaacuggaagauggagccuauagaaucaagcagaaagggauccuaggauacucacagauuggagccggaguuuacaaagaaggaacauuccacacaauguggcaugucacacguggugcuguccuaaugcauaaagggaagagaauugaaccaucaugggcggacgucaagaaagaccuaauaucguauggaggaggcuggaagcuggaaggagaauggaaggaaggagaagaaguccagguccuggcauuagagccuggaaagaauccaagagccguccaaacaaaacccggucuuuuuaaaaccaacacuggaaccauaggcgccgugucucuggacuuuucuccuggaacgucaggaucuccaaucgucgauaaaaaaggaaaaguugugggccuuuauggcaacggugucgucacaaggaguggaacauaugugagugccauagcccagacugaaaaaagcaucgaagacaauccagagauugaagaugacaucuuuagaaagaaaagauugaccaucauggaccuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagcuaucagagcugagcacacugggcgggagauuguggaucuaaugugucaugccacauuuaccaugaggcuauuaucaccaauuagagugccaaauuacaaccugaucaucauggaugaagcccauuucacagacccagcaagcauagcagcuagaggauacauuucaacucgaguagagaugggugaagcagcugggauuuucaugacagccaccccuccuggaagcagagacccauuuccccagagcaacgcaccaaucauggaugaagaaagagaaaucccugagcguucguggaacucuggacaugaguggguuacggauuuuaaagggaagacuguuugguuugucccaaguauaaaagcagggaaugauauagcagcuugccugagaaagaauggaaagaaagugauacaacucagcaggaaaacuuuugauucugaauauaucaagacuaggaccaaugauugggacuuuguggucacgacagacauuucagaaaugggugcuaacuucaaggcugagaggguuauagaccccagacgcugcaugaaaccagucauauuaacagacggugaagagcgggugaucuuggcaggacccaugccagugacccauucuagugcagcacaaagaagagggagaguaggaagaaauccaaaaaaugaaaaugaccaguacauauacaugggggaaccucuggaaaaugaugaagacugugcacacuggaaagaagcuaagaugcucuuggauaacaucaacacgccugaaggaaucauucccagcauguucgaaccagagcgugaaaagguggaugccauugauggugaauaccgcuugagaggagaagcgaggaaaacuuuuguggaccuaaugagaagaggagauuuaccagucuggcuagccuacagaguggcggcugaaggcaucaacuacgcagacagaagauggugcuuugauggagucaagaacaaccaaaucuuggaagaaaauguggaaguagaaauuuggacaaaagaaggagaaaggaagaaauuaaaacccagaugguuggaugcuaggaucuacucugacccauuggcgcucaaagaauucaaggaauucgcagcuggaagaaagucccugacccugaaucuaaucacagagauggguagacucccaaccuucaugacccagaaagcaaagaaugcacucgacaacuuagcaguccugcauacggcugaagcaggcggaagggcguacaaucaugcucuuagugaacugccggagacucuggagacauugcuuuuacugacacuuuuggccacagucacgggcggaaucuuccuguucuugaugagcggaaaggguauagggaagaugacccugggaaugugcugcauaaucacggcuaguauccucuuaugguaugcacaaauacagccacacuggauagcagcuucaauaauacuggaguuuuuucucauagucuugcucauuccagaaccagaaaaacagagaacaccccaagauaaccaguuaacuuauguugucauagccauccuuacaguaguggccgcaaccauggcaaacgagauggguuuccuggaaaaaacaaagaaagauuucggauugggaagcauuacaacccagcaaccugagaguaacauccuggacauagaucuacguccugcaucagcuuggacucuauaugccguggcaacaacuuucaucacaccaauguugaggcauagcauugaaaacuccucagugaaugugucccuaacagccauugccaaccaagccacaguguuaaugggucuugggaaaggauggccauugucaaaaauggacaucggaguuccccuucucgcuaucgggugcuauucacaagucaaccccauaacucucacugcagcccuucucuuauugguagcccauuaugccaucauagggccaggacuccaagcgaaagcaacuagagaggcucagaaaagagcagcagcggguaucaugaaaaacccaacuguggauggaaugacagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcaaccgggcccaucucuacacugugggagggaaauccagggagauuuuggaauacaacuauugcagugucaauggcuaacauuuuuagagggaguuaccuggccggagccggacuucucuuuucuaucaugaaaaacacggccaacacaagaaggggaacuggcaacacaggagagacgcuuggggagaaauggaaaaaccgguugaaugcauuagggaagagugaauuccagaucuacaagaaaaguggaauccaggaaguggacagaaccuuagcaaaagaaggcaucaaaagaggagaaacggaccaucacgcugugucgcgaggcucagcgaaacugagaugguucgucgagagaaaccuggucacaccagaagggaaaguaguggaccuuggcugcggcagggggggcuggucauacuauugugggggacuaaagaauguaaaagaagucaaaggccuaacaaaaggaggaccaggacacgaagaacccauucccaugucaacauaugguuggaaucuggugcgccuucaaaguggaguugauguuuuuuuuacuccgccagaaaagugugacacacugcugugugacauaggggagucgucaccaaaccccacgguugaggcaggacgaacacucagaguucuaaacuuaguggaaaauuggcugaacaacaacacccaauuuugcauaaagguucuuaacccauacaugcccucaguuauagaaaaaauggaagcacuacaaaggaaauacggaggagcuuuggugaggaauccacucucacgaaauuccacacacgagauguacuggguauccaaugcuuccgggaauauagugucaucagugaacaugauuucaagaauguugauuaacagauucacaaugagacacaagaaagccacauacgagccagauguugaccucggaaguggaacccgcaacaucggaauugaaagugagacaccaaauuuagacauaauugggaaaagaauagaaaaaauaaaacaagagcaugaaacaucauggcacuaugaccaagaccacccauacaaaacaugggccuaccauggcagcuacgaaacaaaacagacuggaucagcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccgaaagaaggcacgaaaaaacuaaugaaaauuacugcagaauggcucuggaaagaacuaggaaagaaaaagacaccuaggaugugcaccagagaagaauucacaagaaaggugagaagcaaugcagcuuuaggugccauauucacugaugagaacaaguggaagucggcacgugaggcuguugaagacaguggauuuugggaauugguugacaaggaaaggaaucuccaucuugagggaaagugugaaacauguguguauaacaugaugggaaagagagagaagaagcuaggggaguucggcaaagcaaaaggcagcagagccauaugguacauguggcuuggagcacgcuucuuagaguuugaagcucuaggauucuugaacgaagaucacugguuuuccagagagaacucccugaguggaguggaaggagaagggcuacacaagcuaggcuacauuuuaagagacgugaguaagaaagaaggaggagcaauguaugcugaugacacugcaggaugggacacaagaaucacacuagaggacuuaaaaaaugaagaaauggugacaaaccacauggaaggagaacacaagaaacuugcugaagccauuuucaaauuaacguaccaaaacaagguggugcgugugcaaagaccaacaccaagaggcacaguaauggacauuauaucgagaagagaccaaagagguaguggacaaguugucaccuacggccucaauacuuucaccaauauggaagcccaacugaucagacagauggagggagaaggaguuuucaaaagcauccagcaacugacaguaaaagaagaaauugcagugaaaaacugguuaauaagaguggggcgugagagguuaucaagaauggccaucaguggagaugauuguguugugaaacccuuagaugacagguuugcaagugcucuaacagcucuaaaugacaugggaaagguuaggaaagacauacaacaaugggaaccuucaagaggauggaacgauuggacacaagugcccuuuuguucacaccauuuccaugaguuaaucaugaaggacggucgugugcucguaguuccaugcagaaaccaagaugaacugauuggcagggcccgaauuucccagggagccgggugguccuugcgggaaacagccugucuggggaaguccuacgcccaaauguggagccugauguacuuccacagacgugaccuuaggcuggcggcaaaugccauuugcucggcagucccaucacauuggauuccaacaagucgaacaaccugguccauacacgccacacaugaguggaugacaacagaaaacauguugacagucuggaacaggguguggauucaagaaaacccauggauggaagacaaaacuccaguagaaucaugggaggaaaucccguauuuggggaaaagagaagaccaauggugcggcucauugauugggcuaacaagcagggccaccugggcaaagaacauccaaacagcaauaaaucaaguuagaucccuaauaggcaaugaggaauacacagacuacaugccaucuaugaaaagauucagaagagaagaggaagaggcaggagucuugugguag

SEQ ID NO: 6444 - RNA, 9876 nt, Artificial Sequence
  derived and/or modified CDS sequence (wt) from DENV-2__KM279535__SS-prME
acugcagguauaauuauuaugaugaucccaacagugauggcguuccauuuaaccacacgcaacggagaaccacacaugauuguuaguagacaagagaaagggaaaagucuccuguuuaaaacagagaacggugugaacauguguacccucauggccauggaccuuggugaacugugugaagacacaaucacuuauaauuguccucuucucaggcagaaugaaccagaagacauagacuguuggugcaacuccacgucuacauggguaacuuaugggacaugcaccgccacaggagaacacagaagggaaaaaagaucaguggcacucguuccacaugugggaaugggacuggagacacgaacugaaacauggaugucaucagaaggggccuggaaacaugcccagagaauugaaacuuggaucuugagacauccaggcuucaccauaauggcagcaauccuggcauacaccauaggaacaacauauuuccaaagaguccugauuuucauuuuacugacagcugucacuccuucaauggcaaugcguugcauaggaauaucaaauagagacuuuguggaagggguuucaggaggaagcuggguugauauagucuuggaacauggaagcugugugacgacgauggcgaaaaauaaaccaacguuggauuuugaacugauaaaaacagaagccaaacaucucgccacucuaaggaaguauuguguagaggcaaagcugaccaacacaacaacagcaucucgcugcccaacacaaggagaaccuagccuaaacgaagaacaggacaaaagauucgucugcaaacacuccaugguagacagaggauggggaaauggaugcggauuauuuggaaagggaggcaucgugaccugugcaauguucacaugcaaaaagaacauggaaggaaaagucgugcaaccagaaaacuuggaguacaccaucgugauaacaccucacucaggggaagagaaugcagucggaaaugacacaggaaaacauggcaaggaaauuaaaguaacaccacagaguuccaucacagaagcagaacuaacaggcuacggcacugucacgauggaaugcucuccgagaacgggccucgacuucaaugagaugguguugcugcaaauggaaaacaaggcuuggcuggugcacaggcaaugguucuuagaccugccguuaccauggcugcccggagcagacacacaaggaucaaauuggauacagaaggagacacuggucacuuucaaaaauccccaugcaaagaaacaggauguuguuguuuuagguucccaagaaggggccaugcacacggcacucacaggggccacggaaauccagaugucaucaggaaacuuacuguucacaggacaucuuaagugcaggcugagaauggacaaacuacagcucaaaggaaugucauauuccauguguacaggaaaguucaaaguugugaaggaaauagcagaaacacaacauggaacaauaguuauuagaguacaauaugaaggggacgguuccccgugcaagaucccuuuugaaauaauggacuuggaaaaaaggcaugucuuaggucgcuugauuaccgucaacccaauugucacagaaaaagacagcccagucaacauagaagcagaaccuccauuuggagacaguuacaucauuauaggaguagaaccaggacaacugaagcucagcugguuuaagaaaggaaguucuauuggccaaauguuugagacaacaaugagaggagcgaagagaauggccauucuaggugacacagcuugggauuuuggaucccugggaggaguguucacaucuauaggaaaggcccuccaccaagucuuuggagcuaucuauggggcugccuucagugggguuucauggacuaugaaaauccucauaggagucgucaucacauggauaggaaugaauucacgcagcaccucacugucugugucacuaguauuagugggggucgugacauuguauuugggaguuauggugcaggccgauagugggugcguugucaguuggaaaaacaaagaacugaaaugugguagugggauuuuuaucacagacaacgugcacacauggacagaacaauacaaauuccaaccagaauccccuucaaagcuggcuucagcuauccagaaggcucaugaagaaggcauuuguggaauccgcucaguaacaagacuggagaaucugauguggaaacaaauaacaccagaauugaaucacauucuaacagaaaaugaaguaaaguugacuaucaugacaggagacaucaaaggaaucaugcaggcaggaaaacgaucccugcggccucaacccacugagcugaaguacuccuggaaggcauggggcaaagcgaaaaugcuuuccacagagcuucauaaccacaccuuucucauugauggccccgaaacagcagaaugucccaacacaaacagagcuuggaacucacuagaaguugaagacuauggcuuuggaguauucaccacuaacauauggcugaaauugaaagaaagacaggauguguuuugugacucaaaacucaugucggcagccauaaaggacaauagagccguccacgccgauauggguuauuggauagaaagcgcacucaaugacacauggaagauugagaaagccucuuuuauugaaguuaaaagcugccacuggccaaagucacacacucucuggaguaauggagugcuggaaagugagaugauaauuccaaagaauuuugcaggaccaguuucacaacacaauuacagaccaggcuaccacacacaaacggcaggacccuggcaucuagguaggcuugagauggacuuugauuucugcgaaggaaccacagugguggugacugaggacuguggaaauagaggacccuccuuaagaacaacuacugcuucuggaaaacucauaacagaguggugcugccgaucuugcacauuaccaccgcuaagguacagaggugaggauggaugcugguaugguauggaaaucaggccauugaaagagaaagaagagaaccuggucaacucuuuggucacagccggacauggacagauugacaacuucucacuaggagucuugggaauggcauuguuccuggaagaaaugcucaggacucgaguaggaacgaaacaugcaauauuacuaguugcagucucuuucgugacauugaucacagggaacauguccuuucgagauuuggggagagugauggucauggugggcgcuacuaugacggaugacauaggcaugggcgugacuuaucuugcccuauuagcagccuuuaaagucagaccaaccuuugcggcuggacuacucuuaagaaagcugaccuccaaggaauugaugaugaccaccauaggaaucguacuccucucucagaguaccauaccagagagcauacuugaacugacugacgcguuggcuuuggggaugaugguucucaaaauagugagaaacauggaaaaguaucagcuagcagugacuaucauggcaaucucgugcguuccaaaugcagugauauugcaaaaugcauggaaagugagcugcacaacacuggcagugguguccguuuccccacugcuuuuaacauccucacagcagaaagcggauuggauaccacuggcguugacgaucaaaggccucaauccaacagccauuuucuuaacaacucucucaagaacuagcaagaaaaggagcuggccacuaaaugaggcuauuauggcagucgggauggugagcauucuagcuaguucucucuuaaagaaugauauucccaugacaggaccauuaguggcuggagggcuucucacuguguguuacgugcucacuggaaggucggcugacuuggaacuggaaagagcugcugacguaagaugggaagaacaggcagagauaucaggaaguaguccaauucugucgauaacaauaucggaagaugguagcaugucgauaaagaaugaagaagaagaacagacacugaccauacucaucagaacaggacuacuggugauaucaggacuuuuuccugugucaauaccaaucacggcagcugcaugguaccuuugggaagugaaaaaacaacgagcaggaguauugugggaugucccuucacccccaccugugggaaaggccgaacuggaagauggagccuauagaaucaagcagaaagggauccuaggauacucacagauuggagccggaguuuacaaagaaggaacauuccacacaauguggcaugucacacguggugcuguccuaaugcauaaagggaagagaauugaaccaucaugggcggacgucaagaaagaccuaauaucguauggaggaggcuggaagcuggaaggagaauggaaggaaggagaagaaguccagguccuggcauuagagccuggaaagaauccaagagccguccaaacaaaacccggucuuuuuaaaaccaacacuggaaccauaggcgccgugucucuggacuuuucuccuggaacgucaggaucuccaaucgucgauaaaaaaggaaaaguugugggccuuuauggcaacggugucgucacaaggaguggaacauaugugagugccauagcccagacugaaaaaagcaucgaagacaauccagagauugaagaugacaucuuuagaaagaaaagauugaccaucauggaccuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagcuaucagagcugagcacacugggcgggagauuguggaucuaaugugucaugccacauuuaccaugaggcuauuaucaccaauuagagugccaaauuacaaccugaucaucauggaugaagcccauuucacagacccagcaagcauagcagcuagaggauacauuucaacucgaguagagaugggugaagcagcugggauuuucaugacagccaccccuccuggaagcagagacccauuuccccagagcaacgcaccaaucauggaugaagaaagagaaaucccugagcguucguggaacucuggacaugaguggguuacggauuuuaaagggaagacuguuugguuuguuccaaguauaaaagcagggaaugauauagcagcuugccugagaaagaauggaaagaaagugauacaacucagcaggaaaacuuuugauucugaauauaucaagacuaggaccaaugauugggacuuuguggucacgacagacauuucagaaaugggugcuaacuucaaggcugagaggguuauagaccccagacgcugcaugaaaccagucauauuaacagacggugaagagcgggugaucuuggcaggacccaugccagugacccauucuagugcagcacaaagaagagggagaguaggaagaaauccaaaaaaugaaaaugaccaguacauauacaugggggaaccucuggaaaaugaugaagacugugcacacuggaaagaagcuaagaugcucuuggauaacaucaacacgccugaaggaaucauucccagcauguucgaaccagagcgugaaaagguggaugccauugauggugaauaccgcuugagaggagaagcgaggaaaacuuuuguggaccuaaugagaagaggagauuuaccagucuggcuagccuacagaguggcggcugaaggcaucaacuacgcagacagaagauggugcuuugauggagucaagaacaaccaaaucuuggaagaaaauguggaaguagaaauuuggacaaaagaaggagaaaggaagaaauuaaaacccagaugguuggaugcuaggaucuacucugacccauuggcgcucaaagaauucaaggaauucgcagcuggaagaaagucccugacccugaaucuaaucacagagauggguagacucccaaccuucaugacccagaaagcaaagaaugcacucgacaacuuagcaguccugcauacggcugaagcaggcggaagggcguacaaucaugcucuuagugaacugccggagacucuggagacauugcuuuuacugacacuuuuggccacagucacgggcggaaucuuccuguucuugaugagcggaaaggguauagggaagaugacccugggaaugugcugcauaaucacggcuaguauccucuuaugguaugcacaaauacagccacacuggauagcagcuucaauaauacuggaguuuuuucucauagucuugcucauuccagaaccagaaaaacagagaacaccccaagauaaccaguuaacuuauguugucauagccauccuuacaguaguggccgcaaccauggcaaacgagauggguuuccuggaaaaaacaaagaaagauuucggauugggaagcauuacaacccagcaaccugagaguaacauccuggacauagaucuacguccugcaucagcuuggacucuauaugccguggcaacaacuuucaucacaccaauguugaggcauagcauugaaaacuccucagugaaugugucccuaacagccauugccaaccaagccacaguguuaaugggucuugggaaaggauggccauugucaaaaauggacaucggaguuccccuucucgcuaucgggugcuauucacaagucaaccccauaacucucacugcagcccuucucuuauugguagcccauuaugccaucauagggccaggacuccaagcgaaagcaacuagagaggcucagaaaagagcagcagcgggcaucaugaaaaacccaacuguggauggaaugacagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcaaccgggcccaucucuacacugugggaaggaaauccagggagauuuuggaauacaacuauugcagugucaauggcuaacauuuuuagagggaguuaccuggccggagccggacuucucuuuucuaucaugaaaaacacggccaacacaagaaggggaacuggcaacacaggagagacgcuuggggagaaauggaaaaaccgguugaaugcauuagggaagagugaauuccagaucuacaagaaaaguggaauccaggaaguggacagaaccuuagcaaaagaaggcaucaaaagaggagaaacggaccaucacgcugugucgcgaggcucagcgaaacugagaugguucgucgagagaaaccuggucacaccagaagggaaaguaguggaccuuggcugcggcagggggggcuggucauacuauugugggggacuaaagaauguaaaagaagucaaaggccuaacaaaaggaggaccaggacacgaagaacccauucccaugucaacauaugguuggaaucuggugcgccuucaaaguggaguugauguuuuuuucacuccgccagaaaagugugacacacugcugugugacauaggggagucgucaccaaaccccacgguugaggcaggacgaacacucagaguucuaaacuuaguggaaaauuggcugaacaacaacacccaauuuugcauaaagguucuuaacccauacaugcccucaguuauagaaaaaauggaagcacuacaaaggaaauacggaggagcuuuggugaggaauccacucucacgaaauuccacacacgagauguacuggguauccaaugcuuccgggaauauagugucaucagugaacaugauuucaagaauguugauuaacagauucacaaugagacacaagaaagccacauacgagccagauguugaccucggaaguggaacccgcaacaucggaauugaaagugagacaccaaauuuagacauaauugggaaaagaauagaaaaaauaaaacaagagcaugaaacaucauggcacuaugaccaagaccacccauacaaaacgugggccuaccauggcagcuacgaaacaaaacagacuggaucagcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccgaaagaaggcacgaaaaaacuaaugaaaauuacugcagaauggcucuggaaagaacuaggaaagaaaaagacaccuaggaugugcaccagagaagaauucacaagaaaggugagaagcaaugcagcuuuaggugccauauucacugaugagaacaaguggaagucggcacgugaggcuguugaagacaguggauuuugggaauugguugacaaggaaaggaaucuccaucuugaaggaaagugugaaacauguguguauaacaugaugggaaagagagagaagaagcuaggggaguucggcaaagcaaaaggcagcagagccauaugguacauguggcuuggagcacgcuucuuagaguuugaagcucuaggauucuugaacgaagaucacugguuuuccagagagaacucccugaguggaguggaaggagaagggcuacacaagcuaggcuacauuuuaagagacgugaguaagaaagaaggaggagcaauguaugcugaugacaccgcaggaugggacacaagaaucacacuagaggacuuaaaaaaugaagaaauggugacaaaccacauggaaggagaacacaagaaacuugcugaagccauuuucaaauuaacguaccaaaacaagguggugcgugugcaaagaccaacaccaagaggcacaguaauggacauuauaucgagaagagaccaaagagguaguggacaaguugucaccuacggccucaauacuuucaccaauauggaagcccaacugaucagacagauggagggagaaggaguuuucaaaagcauccagcaacugacaguaaaagaagaaauugcagugaaaaacugguuaauaagaguggggcgugagagguuaucaagaauggccaucaguggagaugauuguguugugaaacccuuagaugacagguuugcaagugcucuaacagcucuaaaugacaugggaaagguuaggaaagacauacaacaaugggaaccuucaagaggauggaacgauuggacacaagugcccuuuuguucacaccauuuccaugaguuaaucaugaaggacggucgugugcucguaguuccaugcagaaaccaagaugaacugauuggcagggcccgaauuucccagggagccgggugguccuugcgggaaacagccugucuggggaaguccuacgcccaaauguggagccugauguacuuccacagacgugaccuuaggcuggcggcaaaugccauuugcucggcagucccaucacauuggauuccaacaagucgaacaaccugguccauacacgccacacaugaguggaugacaacagaagacauguugacagucuggaacaggguguggauucaagaaaacccauggauggaagacaaaacuccaguagaaucaugggaggaaaucccguauuuggggaaaagagaagaccaauggugcggcucauugauugggcuaacaagcagggccaccugggcaaagaacauucaaacagcaauaaaucaaguuagaucccuaauaggcaaugaggaauacacagacuacaugccaucuaugaaaagauucagaagagaagaggaagaggcaggagucuugugguag

SEQ ID NO: 6445 - RNA, 9876 nt, Artificial Sequence
  derived and/or modified CDS sequence (wt) from DENV-2__KM279539__SS-prME
acugcagguauaauuauuaugaugaucccaacagugauggcguuccauuuaaccacacgcaacggagaaccacacaugauuguuaguagacaagagaaagggaaaagucuccuguuuaaaacagagaacggugugaacauguguacccucauggccauggaccuuggugaacugugugaagacacaaucacuuauaauuguccucuucucaggcagaaugaaccagaagacauagacuguuggugcaacuccacgucuacauggguaacuuaugggacaugcaccgccacaggagaacacagaagggaaaaaagaucaguggcacucguuccacaugugggaaugggacuggagacacgaacugaaacauggaugucaucagaaggggccuggaaacaugcccagagaauugaaacuuggaucuugagacauccgggcuucaccauaauggcagcaauccuggcauacaccauaggaacaacauauuuccaaagaguccugauuuucauuuuacugacagcugucacuccuucaauggcaaugcguugcauaggaauaucaaauagagacuuuguggaagggguuucaggaggaagcuggguugauauagucuuggaacauggaagcugugugacgacgauggcgaaaaauaaaccaacguuggauuuugaauugauaaaaacagaagccaaacaucucgccacucuaaggaaguauuguguagaggcaaagcugaccaacacaacaacagcaucucgcugcccaacacaaggagaaccuagccuaaacgaagaacaggacaaaagauucgucugcaaacacuccaugguagacagaggauggggaaauggaugcggauuauuuggaaagggaggcaucgugaccugugcaauguucacaugcaaaaagaacauggaaggaaaagucgugcaaccagaaaacuuggaguacaccaucgugauaacaccucacucaggggaagagaaugcagucggaaaugacacaggaaaacauggcaaggaaauuaaaguaacaccacagaguuccaucacagaagcagaacuaacaggcuacggcacugucacgauggaaugcucuccgagaacgggccucgacuucaaugagaugguguugcugcaaauggaaaacaaggcuuggcuggugcacaggcaaugguucuuagaccugccguuaccauggcugcccggagcagacacacaaggaucaaauuggauacagaaggagacacuggucacuuucaaaaauccccaugcaaagaaacaggauguuguuguuuuagguucccaagaaggggccaugcacacggcacucacaggggccacggaaauccagaugucaucaggaaacuuacuguucacgggacaucuuaagugcaggcugagaauggacaaacuacagcucaaaggaaugucauauuccauguguacaggaaaguucaaaguugugaaggaaauagcagaaacacaacauggaacaauaguuauuagaguacaauaugaaggggacgguuccccgugcaagaucccuuuugaaauaauggacuuggaaaaaaggcaugucuuaggucgcuugauuaccgucaacccaauugucacagaaaaagacagcccagucaacauagaagcagaaccuccauuuggagacaguuacaucauuauaggaguagaaccaggacaacugaagcucagcugguuuaagaaaggaaguucuauuggccaaauguuugagacaacaaugagaggagcgaagagaauggccauucuaggugacacagcuugggauuuuggaucccugggaggaguguucacaucuauaggaaaggcccuccaccaagucuuuggagcuaucuauggggcugccuucagugggguuucauggacuaugaaaauccucauaggagucgucaucacauggauaggaaugaauucacgcagcaccucacugucugugucacuaguauuagugggggucgugacauuguauuugggaguuauggugcaggccgauagugggugcguugucaguuggaaaaacaaagaacugaaaugugguagugggauuuuuaucacagacaacgugcacacauggacagaacaauacaaauuccaaccagaauccccuucaaagcuggcuucagcuauccagaaggcucaugaagaaggcauuuguggaauccgcucaguaacaagacuggagaaucugauguggaaacaaauaacaccagaauugaaucacauucuaacagaaaaugaaguaaaguugacuaucaugacaggagacaucaaaggaaucaugcaggcaggaaaacgaucucugcggccucaacccacugagcugaaguacuccuggaaggcauggggcaaagcgaaaaugcuuuccacagagcuucauaaccacaccuuucucauugauggccccgaaacagcagaaugucccaacacaaacagagcuuggaacucacuagaaguugaagacuauggcuuuggaguauucaccacuaacauauggcugaaauugaaagaaaggcaggauguguuuugugacucaaaacucaugucagcagccauaaaggacaauagagccguccacgccgauauggguuauuggauagaaagcgcacucaaugacacauggaagauugagaaagccucuuuuauugaaguuaaaagcugccacuggccaaagucacacacucucuggaguaauggagugcuggaaagugagaugauaauuccaaagaauuuugcaggaccaguuucacaacacaauuacagaccaggcuaccacacacaaacggcaggacccuggcaucuagguaggcuugagauggacuuugauuucugcgaaggaaccacagugguggugacugaggacuguggaaauagaggacccuccuuaagaacaacuacugcuucuggaaaacucauaacagaguggugcugccgaucuugcacauuaccaccgcuaagguacagaggugaggauggaugcugguaugguauggaaaucaggccauugaaagagaaagaagagaaccuggucaacucuuuggucacagccggacauggacagauugacaacuucucacuaggagucuugggaauggcauuguuccuggaagagaugcucaggacucgaguaggaacgaaacaugcaauauuacuaguugcagucucuuucgugacauugaucacagggaacauguccuuucgagauuuggggagagugauggucauggugggcgcuacuaugacggaugacauaggcaugggcgugacuuaucuugcccuauuagcagccuuuaaagucagaccaaccuuugcggcuggacuacucuuaagaaagcugaccuccaaggaauugaugaugaccaccauaggaaucguacuccucucucagaguaccauaccagagagcauacuugaacugacugacgcguuggcuuuggggaugaugguucucaaaauagugagaaacauggaaaaguaucagcuagcagugacuaucauggcaaucuugugcgucccaaaugcagugauauugcaaaaugcauggaaagugagcugcacaacacuggcagugguguccguuuccccacugcuuuuaacauccucacagcagaaagcggauuggauaccacuggcguugacgaucaaaggccucaauccaacagccauuuucuuaacaacucucucaagaacuagcaagaaaaggagcuggccacuaaaugaggcuauuauggcagucgggauggugagcauucuagcuaguucucucuuaaagaaugauauucccaugacaggaccauuaguggcuggagggcuucucacuguguguuacgugcucacuggaaggucggcugacuuggaacuggaaagagcugcugacguaagaugggaagaacaggcagagauaucaggaaguaguccaauucugucgauaacaauaucggaagaugguagcaugucgauaaagaaugaagaagaagaacagacacugaccauacucaucagaacaggacuacuggugauaucaggacuuuuuccugugucaauaccaaucacggcagcugcaugguaccuuugggaagugaaaaaacaacgagcaggaguauugugggaugucccuucacccccaccugugggaaaggccgaacuggaagauggagccuauagaaucaagcagaaagggauccuaggauacucacagauuggagccggaguuuacaaagaaggaacauuccacacaauguggcaugucacacguggugcuguccuaaugcauaaagggaagagaauugaaccaucaugggcggacgucaagaaagaccuaauaucguauggaggaggcuggaagcuggaaggagaauggaaggaaggagaagaaguccagguccuggcauuagagccuggaaagaauccaagagccguccaaacaaaacccggucuuuuuaaaaccaacacuggaaccauaggcgccgugucucuggacuuuucuccuggaacgucaggaucuccaaucgucgauaaaaaaggaaaaguugugggccuuuauggcaacggugucgucacaaggaguggaacauaugugagugccauagcccagacugaagaaagcaucgaagacaauccagagauugaagaugacaucuuuagaaagaaaagauugaccaucauggaccuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagcuaucagagcugagcacacugggcgggagauuguggaucuaaugugucaugccacauuuaccaugaggcuauuaucaccaauuagagugccaaauuacaaccugaucaucauggaugaagcccauuucacagacccagcaagcauagcagcuagaggauacauuucaacucgaguagagaugggugaagcagcugggauuuucaugacagccaccccuccuggaagcagagacccauuuccccagagcaacgcaccaaucauggaugaagaaagagaaaucccugagcguucguggaacucuggacaugaguggguuacggauuuuaaagggaagacuguuugguuugucccaaguauaaaagcagggaaugauauagcagcuugccugagaaagaauggaaagaaagugauacaacucagcaggaaaacuuuugauucugaauauaucaagacuaggaccaaugauugggacuuuguggucacgacagacauuucagaaaugggugcuaacuucaaggcugagaggguuauagaccccagacgcugcaugaaaccagucauauuaacagacggugaagagcgggugaucuuggcaggacccaugccagugacccauucuagugcagcacaaagaagagggagaguaggaagaaauccaaaaaaugaaaaugaccaguacauauacaugggggaaccucuggaaaaugaugaggacugugcacacuggaaagaagcuaagaugcucuuggauaacaucaacacgccugaaggaaucauucccagcauguucgaaccagagcgugaaaagguggaugccauugauggugaauaccgcuugagaggagaagcgaggaaaacuuuuguggaccuaaugagaagaggagauuuaccagucuggcuagccuacagaguggcggcugaaggcaucaacuacgcagacagaagauggugcuuugauggagucaagaacaaccaaaucuuggaagaaaauguggaaguagaaauuuggacaaaagaaggagaaaggaagaaauuaaaacccagaugguuggaugcuaggaucuacucugacccauuggcgcucaaagaauucaaggaauucgcagcuggaagaaagucccugacccugaaucuaaucacagagauggguagacucccaaccuucaugacccagaaagcaaagaaugcacucgacaacuuagcaguccugcauacggcugaagcaggcggaagggcguacaaucaugcucuuagugaacugccggagacucuggagacauugcuuuuacugacacuuuuggccacagucacgggcggaaucuuccuguucuugaugagcggaaaggguauagggaagaugacccugggaaugugcugcauaaucacggcuaguauccucuuaugguaugcacaaauacagccacacuggauagcagcuucaauaauacuggaguuuuuucucauagucuugcucauuccagaaccagaaaaacagagaacaccccaagauaaccaguuaacuuauguugucauagccauccuuacaguaguggccgcaaccauggcaaacgagauggguuuccuggaaaaaacaaagaaagauuucggauugggaagcauuacaacccagcaaccugagaguaacauccuggacauagaucuacguccugcaucagcuuggacucuauaugccguggcaacaacuuucaucacaccaauguugaggcauagcauugaaaacuccucagugaaugugucccuaacagccauugccaaccaagccacaguguuaaugggucuugggaaaggauggccauugucaaaaauggacaucggaguuccccuucucgcuaucgggugcuauucacaagucaaccccauaacucucacugcagcccuucucuuauugguagcccauuaugccaucauagggccaggacuccaagcgaaagcaacuagagaggcucagaaaagagcagcagcgggcaucaugaaaaacccaacuguggauggaaugacagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcaaccgggcccaucucuacacugugggaaggaaauccagggagauuuuggaauacaacuauugcagugucaauggcuaacauuuuuagagggaguuaccuggccggagccggacuucucuuuucuaucaugaaaaacacggccaacacaagaaggggaacuggcaacacaggagagacgcuuggggagaaauggaaaaaccgguugaaugcauuagggaagagugaauuccagaucuacaagaaaaguggaauccaggaaguggacagaaccuuagcaaaagaaggcaucaaaagaggagaaacggaccaucacgcugugucgcgaggcucagcgaaacugagaugguucgucgagagaaaccuggucacaccagaagggaaaguaguggaccuuggcugcggcagggggggcuggucauacuauugugggggacuaaagaauguaaaagaagucaaaggccuaacaaaaggaggaccaggacacgaagaacccauucccaugucaacauaugguuggaaucuggugcgccuucaaaguggaguugauguuuuuuuuacuccgccagaaaagugugacacacugcugugugacauaggggagucgucaccaaaccccacgguugaggcaggacgaacacucagaguucuaaacuuaguggaaaauuggcugaacaacaacacccaauuuugcauaaagguucuuaacccauacaugcccucaguuauagaaaaaauggaagcacuacaaaggaaauacggaggagcuuuggugaggaauccacucucacgaaauuccacacacgagauguacuggguauccaaugcuuccgggaauauagugucaucagugaacaugauuucaagaauguugauuaacagauucacaaugagacacaagaaagccacauacgagccagauguugaccucggaaguggaacccgcaacaucggaauugaaagugagacaccaaauuuagacauaauugggaaaagaauagaaaaaauaaaacaagagcaugaaacaucauggcacuaugaccaagaccacccauacaaaacaugggccuaccauggcagcuacgaaacaaaacagacuggaucagcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccgaaagaaggcacgaaaaaacuaaugaaaauuacugcagaauggcucuggaaagaacuaggaaagaaaaagacaccuaggaugugcaccagagaagaauucacaagaaaggugagaagcaaugcagcuuuaggugccauauucacugaugagaacaaguggaagucggcacgugaggcuguugaagacaguggauuuugggaauugguugacaaggaaaggaaucuccaucuugaaggaaagugugaaacauguguguauaacaugaugggaaagagagagaagaagcuaggggaguucggcaaagcaaaaggcagcagagccauaugguacauguggcuuggagcacgcuucuuagaguuugaagcucuaggauucuugaacgaagaucacugguuuuccagagagaacucccugaguggaguggaaggagaagggcuacacaagcuaggcuacauuuuaagagacgugaguaagaaagaaggaggagcaauguaugcugaugacacugcaggaugggacacaagaaucacacuagaggacuuaaaaaaugaagaaauggugacaaaccacauggaaggagaacacaagaaacuugcugaagccauuuucaaauuaacguaccaaaacaagguggugcgugugcaaagaccaacaccaagaggcacaguaauggacauuauaucgagaagagaccaaagagguaguggacaaguugucaccuacggccucaauacuuucaccaauauggaagcccaacugaucagacagauggagggagaaggaguuuucaaaagcauccagcaacugacaguaaaagaagaaauugcagugaaaaacugguuaauaagaguggggcgugagagguuaucaagaauggccaucaguggagaugauuguguugugaaacccuuagaugacagguuugcaagugcucuaacagcucuaaaugacaugggaaagguuaggaaagacauacaacaaugggaaccuucaagaggauggaacgauuggacacaagugcccuuuuguucacaccauuuccaugaguuaaucaugaaggacggucgugugcucguaguuccaugcagaaaccaagaugaacugauuggcagggcccgaauuucccagggagccgggugguccuugcgggaaacagccugucuggggaaguccuacgcccaaauguggagccugauguacuuccacagacgugaccuuaggcuggcggcaaaugccauuugcucggcagucccaucacauuggauuccaacaagucgaacaaccugguccauacacgccacacaugaguggaugacaacagaagacauguugacagucuggaacaggguguggauucaagaaaacccauggauggaagacaaaacuccaguagaaucaugggaggaaaucccguauuuggggaaaagagaagaccaauggugcggcucauugauugggcuaacaagcagggccaccugggcaaagaacauccaaacagcaauaaaucaaguuagaucccuaauaggcaaugaggaauacacagacuacaugccaucuaugaaaagauucagaagagaagaggaagaggcaggagucuugugguag

SEQ ID NO: 6446 - RNA, 9876 nt, Artificial Sequence
  derived and/or modified CDS sequence (wt) from DENV-2__KM279543__SS-prME
acugcagguauaauuauuaugaugaucccaacagugauggcguuccauuuaaccacacgcaacggagaaccacacaugauuguuaguagacaagagaaagggaaaagucuccuguuuaaaacagagaacggugugaacauguguacccucauggccauggaccuuggugaacugugugaagacacaaucacuuauaauuguccucuucucaggcagaaugaaccagaagacauagacuguuggugcaacuccacgucuacauggguaacuuaugggacaugcaccgccacaggagaacacagaagggaaaaaagaucaguggcacucguuccacaugugggaaugggacuggagacacgaacugaaacauggaugucaucagaaggggccuggaaacaugcccagagaauugaaacuuggaucuugagacauccgggcuucaccauaauggcagcaauccuggcauacaccauaggaacaacauauuuccaaagaguccugauuuucauuuuacugacagcugucacuccuucaauggcaaugcguugcauaggaauaucaaauagagacuuuguggaagggguuucaggaggaagcuggguugauauagucuuggaacauggaagcugugugacgacgauggcgaaaaauaaaccaacguuggauuuugaauugauaaaaacagaagccaaacaucucgccacucuaaggaaguauuguguagaggcaaagcugaccaacacaacaacagcaucucgcugcccaacacaaggagaaccuagccuaaacgaagaacaggacaaaagauucgucugcaaacacuccaugguagacagaggauggggaaauggaugcggauuauuuggaaagggaggcaucgugaccugugcaauguucacaugcaaaaagaacauggaaggaaaagucgugcaaccagaaaacuuggaguacaccaucgugauaacaccucacucaggggaagagaaugcagucggaaaugacacaggaaaacauggcaaggaaauuaaaguaacaccacagaguuccaucacagaagcagaacuaacaggcuacggcacugucacgauggaaugcucuccgagaacgggccucgacuucaaugagaugguguugcugcaaauggaaaacaaggcuuggcuggugcacaggcaaugguucuuagaccugccguuaccauggcugcccggagcagacacacaaggaucaaauuggauacagaaggagacacuggucacuuucaaaaauccccaugcaaagaaacaggauguuguuguuuuagguucccaagaaggggccaugcacacggcacucacaggggccacggaaauccagaugucaucaggaaacuuacuguucacgggacaucuuaagugcaggcugagaauggacaaacuacagcucaaaggaaugucauauuccauguguacaggaaaguucaaaguugugaaggaaauagcagaaacacaacauggaacaauaguuauuagaguacaauaugaaggggacgguuccccgugcaagaucccuuuugaaauaauggacuuggaaaaaaggcaugucuuaggucgcuugauuaccgucaacccaauugucacagaaaaagacagcccagucaacauagaagcagaaccuccauuuggagacaguuacaucauuauaggaguagaaccaggacaacugaagcucagcugguuuaagaaaggaaguucuauuggccaaauguuugagacaacaaugagaggagcgaagagaauggccauucuaggugacacagcuugggauuuuggaucccugggaggaauguucacaucuauaggaaaggcccuccaccaagucuuuggagcuaucuauggggcugccuucagugggguuucauggacuaugaaaauccucauaggagucgucaucacauggauaggaaugaauucacgcagcaccucacugucugugucacuaguauuagugggggucgugacauuguauuugggaguuauggugcaggccgauagugggugcguugucaguuggaaaaacaaagaacugaaaugugguagugggauuuuuaucacagacaacgugcacacauggacagaacaauacaaauuccaaccagaauccccuucaaagcuggcuucagcuauccagaaggcucaugaagaaggcauuuguggaauccgcucaguaacaagacuggagaaucugauguggaaacaaauaacaccagaauugaaucacauucuaacagaaaaugaaguaaaguugacuaucaugacaggagacaucaaaggaaucaugcaggcaggaaaacgaucccugcggccucaacccacugagcugaaguacuccuggaaggcauggggcaaagcgaaaaugcuuuccacagagcuucauaaccacaccuuucucauugauggccccgaaacagcagaaugucccaacacaaacagagcuuggaacucacuagaaguugaagacuauggcuuuggaguauucaccacuaacauauggcugaaauugaaagaaaggcaggauguguuuugugacucaaaacucaugucagcagccauaaaggacaauagagccguccacgccgauauggguuauuggauagaaagcgcacucaaugacacauggaagauugagaaagccucuuuuauugaaguuaaaagcugccacuggccaaagucacacacucucuggaguaauggagugcuggaaagugagaugauaauuccaaagaauuuugcaggaccaguuucacaacacaauuacagaccaggcuaccacacacaaacggcaggacccuggcaucuagguaggcuugagauggacuuugauuucugcgaaggaaccacagugguggugacugaggacuguggaaauagaggacccuccuuaagaacaacuacugcuucuggaaaacucauaacagaguggugcugccgaucuugcacauuaccaccgcuaagguacagaggugaggauggaugcugguaugguauggaaaucaggccauugaaagagaaagaagagaaccuggucaacucuuuggucacagccggacauggacagauugacaacuucucacuaggagucuugggaauggcauuguuccuggaagagaugcucaggacucgaguaggaacgaaacaugcaauauuacuaguugcagucucuuucgugacauugaucacagggaacauguccuuucgagauuuggggagagugauggucauggugggcgcuacuaugacggaugacauaggcaugggcgugacuuaucuugcccuauuagcagccuuuaaagucagaccaaccuuugcggcuggacuacucuuaagaaagcugaccuccaaggaauugaugaugaccaccauaggaaucguacuccucucucagaguaccauaccagagagcauacuugaacugacugacgcguuggcuuuggggaugaugguucucaaaauagugagaaacauggaaaaguaucagcuagcagugacuaucauggcaaucuugugcgucccaaaugcagugauauugcaaaaugcauggaaagugagcugcacaacacuggcagugguguccguuuccccacugcuuuuaacauccucacagcagaaagcggauuggauaccacuggcguugacgaucaaaggccucaauccaacagccauuuucuuaacaacucucucaagaacuagcaagaaaaggagcuggccacuaaaugaggcuauuauggcagucgggauggugagcauucuagcuaguucucucuuaaagaaugauauucccaugacaggaccauuaguggcuggagggcuucucacuguguguuacgugcucacuggaaggucggcugacuuggaacuggaaagagcugcugacguaagaugggaagaacaggcagagauaucaggaaguaguccaauucugucgauaacaauaucggaagaugguagcaugucgauaaagaaugaagaagaagaacagacacugaccauacucaucagaacaggacuacuggugauaucaggacuuuuuccugugucaauaccaaucacggcagcugcaugguaccuuugggaagugaaaaaacaacgagcaggaguacugugggaugucccuucacccccaccugugggaaaggccgaacuggaagauggagccuauagaaucaagcagaaagggauccuaggauacucacagauuggagccggaguuuacaaagaaggaacauuccacacaauguggcaugucacacguggugcuguccuaaugcauaaagggaagagaauugaaccaucaugggcggacgucaagaaagaccuaauaucguauggaggaggcuggaagcuggaaggagaauggaaggaaggagaagaaguccagguccuggcauuagagccuggaaagaauccaagagccguccaaacaaaacccggucuuuuuaaaaccaacacuggaaccauaggcgccgugucucuggacuuuucuccuggaacgucaggaucuccaaucgucgauaaaaaaggaaaaguugugggccuuuauggcaacggugucgucacaaggaguggaacauaugugagugccauagcccagacugaaaaaagcaucgaagacaauccagagauugaagaugacaucuuuagaaagaaaagauugaccaucauggaccuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagcuaucagagcugagcacacugggcgggagauuguggaucuaaugugucaugccacauuuaccaugaggcuauuaucaccaauuagagugccaaauuacaaccugaucaucauggaugaagcccauuucacagacccagcaagcauagcagcuagaggauacauuucaacucgaguagagaugggugaagcagcugggauuuucaugacagccaccccuccuggaagcagagacccauuuccccagagcaacgcaccaaucauggaugaagaaagagaaaucccugagcguucguggaacucuggacaugaguggguuacggauuuuaaagggaagacuguuugguuugucccaaguauaaaagcagggaaugauauagcagcuugccugagaaagaauggaaagaaagugauacaacucagcaggaaaacuuuugauucugaauauaucaagacuaggaccaaugauugggacuuuguggucacgacagacauuucagaaaugggugcuaacuucaaggcugagaggguuauagaccccagacgcugcaugaaaccagucauauuaacagacggugaagagcgggugaucuuggcaggacccaugccagugacccauucuagugcagcacaaagaagagggagaguaggaagaaauccaaaaaaugaaaaugaccaguacauauacaugggggaaccucuggaaaaugaugaagacugugcacacuggaaagaagcuaagaugcucuuggauaacaucaacacgccugaaggaaucauucccagcauguucgaaccagagcgugaaaagguggaugccauugauggugaauaccgcuugagaggagaagcgaggaaaacuuuuguggaccuaaugagaagaggagauuuaccagucuggcuagccuacagaguggcggcugaaggcaucaacuacgcagacagaagauggugcuuugauggagucaagaacaaccaaaucuuggaagaaaauguggaaguagaaauuuggacaaaagaaggagaaaggaagaaauuaaaacccagaugguuggaugcuaggaucuacucugacccauuggcgcucaaagaauucaaggaauucgcagcuggaagaaagucccugacccugaaucuaaucacagagauggguagacucccaaccuucaugacccagaaagcaaagaaugcacucgacaacuuagcaguccugcauacggcugaagcaggcggaagggcguacaaucaugcucuuagugaacugccggagacucuggagacauugcuuuuacugacacuuuuggccacagucacgggcggaaucuuccuguucuugaugagcggaaaggguauagggaagaugacccugggaaugugcugcauaaucacggcuaguauccucuuaugguaugcacaaauacagccacacuggauagcagcuucaauaauacuggaguuuuuucucauagucuugcucauuccagaaccagaaaaacagagaacaccccaagauaaccaguuaacuuauguugucauagccauccuuacaguaguggccgcaaccauggcaaacgagauggguuuccuggaaaaaacaaagaaagauuucggauugggaagcauuacaacccagcaaccugagaguaacauccuggacauagaucuacguccugcaucagcuuggacucuauaugccguggcaacaacuuucaucacaccaauguugaggcauagcauugaaaacuccucagugaaugugucccuaacagccauugccaaccaagccacaguguuaaugggucuugggaaaggauggccauugucaaaaauggacaucggaguuccccuucucgcuaucgggugcuauucacaagucaaccccauaacucucacugcagcccuucucuuauugguagcccauuaugccaucauagggccaggacuccaagcgaaagcaacuagagaggcucagaaaagagcagcagcgggcaucaugaaaaacccaacuguggauggaaugacagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcaaccgggcccaucucuacacugugggaaggaaauccagggagauuuuggaauacaacuauugcagugucaauggcuaacauuuuuagagggaguuaccuggccggagccggacuucucuuuucuaucaugaaaaacacggccaacacaagaaggggaacuggcaacacaggagagacgcuuggggagaaauggaaaaaccgguugaaugcauuagggaagagugaauuccagaucuacaagaaaaguggaauccaggaaguggacagaaccuuagcaaaagaaggcaucaaaagaggagaaacggaccaucacgcugugucgcgaggcucagcgaaacugagaugguucgucgagagaaaccuggucacaccagaagggaaaguaguggaccuuggcugcggcagggggggcuggucauacuauugugggggacuaaagaauguaaaagaagucaaaggccuaacaaaaggaggaccaggacacgaagaacccauucccaugucaacauaugguuggaaucuggugcgccuucaaaguggaguugauguuuuuuuuacuccgccagaaaagugugacacacugcugugugacauaggggagucgucaccaaaccccacgguugaggcaggacgaacacucagaguucuaaacuuaguggaaaauuggcugaacaacaacacccaauuuugcauaaagguucuuaacccauacaugcccucaguuauagagaaaauggaagcacuacaaaggaaauacggaggagcuuuggugaggaauccacucucacgaaauuccacacacgagauguacuggguauccaaugcuuccgggaauauagugucaucagugaacaugauuucaagaauguugauuaacagauucacaaugagacacaagaaagccacauacgagccagauguugaccucggaaguggaacccgcaacaucggaauugaaagugagacaccaaauuuagacauaauugggaaaagaauagaaaaaauaaaacaagagcaugaaacaucauggcacuaugaccaagaccacccauacaaaacaugggccuaccauggcagcuacgaaacaaaacagacuggaucagcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccgaaagaaggcacgaaaaaacuaaugaaaauuacugcagaauggcucuggaaagaacuaggaaagaaaaagacaccuaggaugugcaccagagaagaauucacaagaaaggugagaagcaaugcagcuuuaggugccauauucacugaugagaacaaguggaagucggcacgugaggcuguugaagacaguggauuuugggaauugguugacaaggaaaggaaucuccaucuugaaggaaagugugaaacauguguguauaacaugaugggaaagagagagaagaagcuaggggaguucggcaaagcaaaaggcagcagagccauaugguacauguggcuuggagcacgcuucuuagaguuugaagcucuaggauucuugaacgaagaucacugguuuuccagagagaacucccugaguggaguggaaggagaagggcuacacaagcuaggcuacauuuuaagagacgugaguaagaaagaaggaggagcaauguaugcugaugacacugcaggaugggacacaagaaucacacuagaggacuuaaaaaaugaagaaauggugacaaaccacauggaaggagaacacaagaaacuugcugaagccauuuucaaauuaacguaccaaaacaagguggugcgugugcaaagaccaacaccaagaggcacaguaauggacauuauaucgagaagagaccaaagagguaguggacaaguugucaccuacggccucaauacuuucaccaauauggaagcccaacugaucagacagauggagggagaaggaguuuucaaaagcauccagcaacugacaguaaaagaagaaauugcagugaaaaacugguuaauaagaguggggcgugagagguuaucaagaauggccaucaguggagaugauuguguugugaaacccuuagaugacagguuugcaagugcucuaacagcucuaaaugacaugggaaagguuaggaaagacauacaacaaugggaaccuucaagaggauggaacgauuggacacaagugcccuuuuguucacaccauuuccaugaguuaaucaugaaggacggucgugugcucguaguuccaugcagaaaccaagaugaacugauuggcagggcccgaauuucccagggagccgggugguccuugcgggaaacagccugucuggggaaguccuacgcccaaauguggagccugauguacuuccacagacgugaccuuaggcuggcggcaaaugccauuugcucggcagucccaucacauuggauuccaacaagucgaacaaccugguccauacacgccacacaugaguggaugacaacagaagacauguugacagucuggaacaggguguggauucaagaaaacccauggauggaagacaaaacuccaguagaaucaugggaggaaaucccguauuuggggaaaagagaagaccaauggugcggcucauugauugggcuaacaagcagggccaccugggcaaagaacauccaaacagcaauaaaucaaguuagaucccuaauaggcaaugaggaauacacagacuacaugccaucuaugaaaagauucagaagagaagaggaagaggcaggagucuugugguag

SEQ ID NO: 6447 - RNA, 9876 nt, Artificial Sequence
  derived and/or modified CDS sequence (wt) from DENV-2__KM279571__SS-prME
acugcagguauaauuauuaugaugaucccaacagugauggcguuccauuuaaccacacgcaacggagaaccacacaugaucguuaguagacaagagaaagggaaaagucuccuguuuaaaacagagaacggugugaacauguguacccucauggccauggaccuuggugaacugugugaagacacaaucacuuauaauuguccucuucucaggcagaaugaaccagaagacauagacuguuggugcaacuccacgucuacauggguaacuuaugggacaugcaccgccacaggagaacacagaagggaaaaaagaucaguggcacucguuccacaugugggaaugggacuggagacacgaacugaaacauggaugucaucagaaggggccuggaaacaugcccagagaauugaaacuuggaucuugagacauccaggcuucaccauaauggcagcuauccuggcauacaccauaggaacaacauauuuccaaagaguccugauuuucauuuuacugacagcugucacuccuucaauggcaaugcguuguauaggaauaucaaauagagacuuuguggaagggguuucaggaggaagcuggguugauauagucuuggaacauggaagcugugugacgacgauggcgaaaaauaaaccaacgcuggauuuugaacugauaaaaacagaagccaaacaucucgccacucuaaggaaguauuguguagaggcaaagcugaccaacacaacaacagcaucucgcugcccaacacaaggagaaccuagccuaaaugaagaacaggacaaaagauucgucugcaaacacuccaugguagacagaggauggggaaauggaugcggauuauuuggaaagggaggcaucgugaccugugcaauguucacaugcaaaaagaacauggaaggaaaagucgugcaaccagaaaacuuggaguacaccaucgugauaacaccucacucaggggaagagaaugcagucggaaaugacacaggaaaacauggcaaggaaauuaaaguaacaccacagaguuccaucacagaagcagaacuaacaggcuacggcacugucacgauggaaugcucuccgagaacgggccucgacuucaaugagaugguguugcugcaaauggaaaacaaggcuuggcuggugcacaggcaaugguucuuagaccugccguuaccauggcugcccggagcagacacacaaggaucaaauuggauacagaaggagacacuggucacuuucaaaaauccccaugcaaagaaacaggauguaguuguuuuagguucccaagaaggggccaugcacacggcacucacaggggccacggaaauccagaugucaucaggaaacuuacuguucacaggacaucuuaagugcaggcugagaauggacaaacuacagcucaaaggaaugucauauuccauguguacaggaaaguucaaaguugugaaggaaauagcagaaacacaacauggaacaauaguuauuagaguacaauaugaaggggacgguuccccgugcaagaucccuuuugaaauaauggacuuggaaaaaaggcaugucuuaggacgcuugauuaccgucaacccaauugucacagaaaaagacagcccagucaacauagaagcagaaccuccauuuggagacaguuacaucauuauaggaguagaaccaggacaacugaagcucagcugguuuaagaaaggaaguucuauuggccaaauguuugagacaacaaugagaggagcgaagagaauggccauucuaggugacacagcuugggauuuuggaucccugggaggaguguucacaucuauaggaaaggcccuccaccaagucuuuggagcuaucuauggggcugccuucagugggguuucauggacuaugaaaauccucauaggagucgucaucacauggauaggaaugaauucacgcagcaccucacugucugugucacuaguauuagugggggucgugacauuguauuugggaguuauggugcaggccgauagugggugcguugugaguuggaaaaacaaagaacugaaaugugguagugggauuuuuaucacagacaacgugcacacauggacagaacaauacaaauuccaaccagaauccccuucaaagcuggcuucagcuauccagaaggcucaugaagaaggcauuuguggaauccgcucaguaacaagacuggagaaucugauguggaaacaaauaacaccagaauugaaucacauucuaacagaaaaugaaguaaaguugacuaucaugacaggagacaucaaaggaaucaugcaggcaggaaaacgaacccugcggccucaacccacugagcugaaguacuccuggaaggcauggggcaaagcgaaaaugcuuuccacagagcuucauaaccacaccuuucucauugauggccccgaaacagcagaaugucccaacacaaacagagcuuggaacucacuagaaguugaagacuauggcuuuggaguauucaccacuaacauauggcugaaauugaaagaaaggcaggauguguuuugugacucaaaacucaugucagcagccauaaaggacaauagagccguccacgccgauauggguuauuggauagaaagcgcacucaaugacacauggaagauugagaaagccucuuuuauugaaguuaaaagcugccacuggccaaagucacacacucucuggaguaauggagugcuggaaagugagaugauaauuccaaagaauuuugcaggaccaguuucacaacacaauuacagaccaggcuaccacacacaaacggcaggacccuggcaucuagguaggcuugagauggacuuugauuucugcgaaggaaccacagugguggugacugaggacuguggaaauagaggacccuccuuaagaacaacuacugcuucuggaaaacucauaacagaguggugcugccgaucuugcacauuaccaccgcuaagguacagaggugaggauggaugcugguaugguauggaaaucaggccauugaaagagaaagaagagaaccuggucaacucuuuggucacagccggacauggacagauugacaacuucucacuaggagucuugggaauggcauuguuccuggaagagaugcucaggacucgaguaggaacgaaacaugcaauauuacuaguugcagucucuuucgugacauugaucacagggaacauguccuuucgagauuuggggagagugauggucauggugggcgcuacuaugacggaugacauaggcaugggcgugacuuaucuugcccuauuagcagccuuuaaaaucagaccaaccuuugcggcuggacuacucuuaagaaagcugaccuccaaggaauugaugaugaccaccauaggaaucguacuccucucucagaguaccauaccagagagcauacuugaacugacugacgcguuggcuuuggggaugaugguucuuaaaauagugagaaacauggaaaaguaucagcuagcagugacuaucauggcaaucuugugcgucccaaaugcagugauauugcaaaaugcauggaaagugagcugcacaacacuggcagugguguccguuuccccacugcuuuuaacauccucacagcagaaagcggauuggauaccacuggcguugacgaucaaaggccucaauccaacagccauuuucuuaacaacucucucaagaacuagcaagaaaaggagcuggccacuaaaugaggcuauuauggcagucgggauggugagcauucuagcuaguucucucuuaaagaaugauauucccaugacaggaccauuaguggcuggagggcuucucacuguguguuacgugcucaccggaaggucggcugacuuggaacuggaaagagcugcugacguaagaugggaagaacaggcagagauaucaggaaguaguccaauucugucgauaacaauaucggaagaugguagcaugucgauaaagaaugaagaagaagaacagacacugaccauacucaucagaacaggacuacuggugauaucaggacuuuuuccugugucaauaccaaucacggcagcugcaugguaccuuugggaagugaaaaaacaacgagcaggaguauugugggaugucccuucacccccaccugugggaaaggccgaacuggaagauggagccuauagaaucaagcagaaagggauccuaggauacucacagauuggagccggaguuuacaaagaaggaacauuccacacaauguggcaugucacacguggugcuguccuaaugcauaaagggaagagaauugaaccaucaugggcggacgucaagaaagaccuaauaucguauggaggaggcuggaagcuggaaggagaauggaaggaaggagaagaaguccagguccuggcauuagagcccggaaagaauccaagagccguccaaacaaaacccggucuuuuuaaaaccaacacuggaaccauaggcgccgugucucuggacuuuucuccuggaacgucaggaucuccaaucgucgauaaaaaaggaaaaguugugggccuuuauggcaacggugucgucacaaggaguggaacauaugugagugccauagcccagacugaaaaaagcaucgaagacaauccagagauugaagaugacaucuuuagaaagaaaagauugaccaucauggaccuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagcuauuagagcugagcacacugggcgggagauuguggaucuaaugugucaugccacauuuaccaugaggcuauuaucaccaauuagagugccaaauuacaaccugaucaucauggaugaagcccauuucacagacccagcaagcauagcagcuagaggauacauuucaacucgaguagagaugggugaagcagcugggauuuucaugacagccaccccuccuggaagcagagacccauuuccccagagcaacgcaccaaucauggaugaagaaaaagaaaucccugagcguucguggaacucuggacaugaguggguuacggauuuuaaagggaagacuguuugguuuguuccaaguauaaaagcagggaaugauauagcagcuugccugagaaagaauggaaagaaagugauacaacucagcaggaaaacuuuugauucugaauauaucaagacuaggaccaaugauugggacuuuguggucacgacagacauuucagaaaugggugcuaacuucaaggcugagaggguuauagaccccagacgcugcaugaaaccagucauauuaacagacggugaagagcgggugaucuuggcaggacccaugccagugacccauucuagugcagcacaaagaagagggagaguaggaagaaauccaaaaaaugaaaaugaccaguacauauacaugggggaaccucuggaaaaugaugaagacugugcacacuggaaagaagcuaagaugcucuuggauaacaucaacacgccugaagggaucauucccagcauguucgaaccagagcgugaaaagguggaugccauugauggugaauaccgcuugagaggagaagcgaggaaaacuuuuguggaccuaaugagaagaggagauuuaccagucuggcuagccuacagaguggcggcugaaggcaucaacuacgcagacagaagauggugcuuugauggagucaagaacaaccaaaucuuggaagaaaauguggaaguagaaauuuggacaaaagaaggagaaaggaagaaauuaaaacccagaugguuggaugcuaggaucuacucugacccauuggcgcucaaagaauucaaggaauucgcagcuggaagaaagucccugacccugaaucuaaucacagagauggguagacucccaaccuucaugacccagaaagcaaagaaugcacucgacaacuuagcaguccugcauacggcugaagcaggcggaagggcguacaaucaugcucuuagugaacugccggagacucuggagacauugcuuuuacugacacuuuuggccacagucacgggcggaaucuuccuguucuugaugagcggaaaggguauagggaagaugacccugggaaugugcugcauaaucacggcuaguauccucuuaugguaugcacaaauacagccacacuggauagcagcuucaauaauacuggaguuuuuucucauagucuugcucauuccagaaccagaaaaacagagaacaccccaagauaaccaguuaacuuauguugucauagccauccuuacaguaguggccgcaaccauggcaaacgagauggguuuccuggaaaaaacaaagaaagauuucggauugggaagcauuacaacccagcaaccugagaguaacauccuggacauagaucuacguccugcaucagcuuggacucuauaugccguggcaacaacuuucaucacaccaauguugaggcauagcauugaaaacuccucagugaaugugucccuaacagccauugccaaccaagccacaguguuaaugggucuugggaaaggauggccauugucaaaaauggacaucggaguuccccuucucgcuaucgggugcuauucacaagucaaccccauaacucucacugcagcccuucucuuauugguagcccauuaugccaucauagggccaggacuccaagcgaaagcaacuagagaggcucagaaaagagcagcagcgggcaucaugaaaaacccaacuguggauggaaugacagugauugaccuagauccaauacccuaugauccaaaguuugaaaagcaguugggacaaguaaugcucuuaguccucugcgugacccaaguauugaugaugaggacuacaugggcuuuaugugaagcucuaaccuuagcaaccgggcccaucucuacacugugggaaggaaauccagggagauuuuggaauacaacuauugcagugucaauggcuaacauuuuuagagggaguuaccuggccggagccggacuucucuuuucuaucaugaaaaacacggccaacacaagaaggggaacuggcaacacaggagagacgcuuggggagaaauggaaaaaccgguugaaugcauuagggaagagugaauuccagaucuacaagaaaaguggaauccaggaaguggacagaaccuuagcaaaagaaggcaucaaaagaggagaaacggaccaucacgcugugucgcgaggcucagcgaaacugagaugguucgucgagagaaaccuggucacaccagaagggaaaguaguggaccuuggcugcggcagggggggcuggucauacuauugugggggacuaaagaauguaaaagaagucaaaggccuaacaaaaggaggaccaggacacgaagaacccauucccaugucaacauaugguuggaaucuggugcgccuucaaaguggaguugauguuuucuucacuccgccagaaaagugugacacacugcugugugacauaggggagucgucaccaaaccccacgguugaggcaggacgaacacucagaguucuaaacuuaguggaaaauuggcugaacaacaacacccaauuuugcauaaagguucuuaacccauacaugcccucaguuauagaaaaaauggaagcacuacaaaggaaauacggaggagcuuuggugaggaauccacucucacgaaauuccacacacgagauguacuggguauccaaugcuuccgggaauauagugucaucagugaacaugauuucaagaauguugauuaacagauucacaaugagacacaagaaagccacauacgagccagauguugaccucggaaguggaacccgcaacaucggaauugaaagugagacaccaaauuuagacauaauugggaaaagaauagaaaaaauaaaacaagagcaugaaacaucauggcacuaugaccaagaccacccauacaaaacgugggccuaccauggcagcuacgaaacaaaacagacuggaucagcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccgaaagaaggcacgaaaaaacuaaugaaaauuacugcagaauggcucuggaaagaacuaggaaagaaaaagacaccuaggaugugcaccagagaagaauucacaagaaaggugagaagcaaugcagccuuaggugccauauucacugaugagaacaaguggaagucggcacgugaggcuguugaagacaguggauuuugggaauugguugacaaggaaaggaaucuccaucuugaaggaaagugugaaacaugcguguauaacaugaugggaaagagagagaagaagcuaggggaguucggcaaagcaaaaggcagcagagccauaugguacauguggcuuggagcacgcuucuuagaguuugaagcucuaggauucuugaacgaagaucacugguuuuccagagagaacucccugaguggaguggaaggagaagggcuacacaagcuaggcuacauuuuaagagacgugaguaagaaagaaggaggagcaauguaugcugaugacaccgcaggaugggacacaagaaucacacuagaggacuugaaaaaugaagaaauggugacaaaccacauggaaggagaacacaagaaacuugcugaagccauuuucaaauuaacguaccaaaacaagguggugcgugugcaaagaccaacaccaagaggcacaguaauggacauuauaucgagaagagaccaaagagguaguggacaaguugucaccuacggccucaauacuuucaccaauauggaagcccaacugaucagacagauggagggagaaggaguuuucaaaagcauccagcaacugacaguaaaagaagaaauugcagugaaaaacugguuaauaagaguggggcgugagagguuaucaagaauggccaucaguggagaugauuguguugugaaacccuuagaugacagguuugcaagugcucuaacagcucuaaaugacaugggaaagguuaggaaagacauacaacaaugggaaccuucaagaggauggaacgauuggacacaagugcccuuuuguucacaccauuuccaugaguuaaucaugaaggacggucgugugcucguaguuccaugcagaaaccaagaugaacugauuggcagggcccgaauuucccagggagccgggugguccuugcgggaaacagccugucuggggaaguccuacgcccaaauguggagccugauguacuuccacagacgugaccuuaggcuggcggcaaaugccauuugcucggcagucccaucacauuggauuccaacaagucgaacaaccugguccauacacgccacacaugaguggaugacaacagaagacauguugacagucuggaacaggguguggauucaagaaaacccauggauggaagacaaaacuccaguagaaucaugggaggaaaucccguauuuggggaaaagagaagaccaauggugcggcucauugauugggcuaacaagcagggccaccugggcaaagaacauccaaacagcaauaaaucaaguuagaucccuaauaggcaaugaggaauacacagacuacaugccaucuaugaaaagauucagaagagaagaggaagaggcaggagucuugugguag

SEQ ID NO: 6448 - RNA, 9876 nt, Artificial Sequence
  derived and/or modified CDS sequence (wt) from DENV-2__KM279544__SS-prME
acugcagguauaauuauuaugaugaucccaacagugauggcguuccauuuaaccacacgcaacggagaaccacacaugauuguuaguagacaagagaaagggaaaagucuccuguuuaaaacagagaacggugugaacauguguacccucauggccauggaccuuggugaacugugugaagacacaaucacuuauaauuguccucuucucaggcagaaugaaccagaagacauagacuguuggugcaacuccacgucuacauggguaacuuaugggacaugcaccgccacaggagaacacagaagggaaaaaagaucaguggcacucguuccacaugugggaaugggacuggagacacgaacugaaacauggaugucaucagaaggggccuggaaacaugcccagagaauugaaacuuggaucuugagacauccgggcuucaccauaauggcagcaauccuggcauacaccauaggaacaacauauuuccaaagaguccugauuuucauuuuacugacagcugucacuccuucaauggcaaugcguugcauaggaacaucaaauagagacuuuguggaagggguuucaggaggaagcuggguugauauagucuuggaacauggaagcugugugacgacgauggcgaaaaauaaaccaacguuggauuuugaauugauaaaaacagaagccaaacaucucgccacucuaaggaaguauuguguagaggcaaagcugaccaacacaacaacagcaucucgcugcccaacacaaggagaaccuagccuaaacgaagaacaggacaaaagauucgucugcaaacacuccaugguagacagaggauggggaaauggaugcggauuauuuggaaagggaggcaucgugaccugugcaauguucacaugcaaaaagaacauggaaggaaaagucgugcaaccagaaaacuuggaguacaccaucgugauaacaccucacucaggggaagagaaugcagucggaaaugacacaggaaaacauggcaaggaaauuaaaguaacaccacagaguuccaucacagaagcagaacuaacaggcuacggcacugucacgauggaaugcucuccgagaacgggccucgacuucaaugagaugguguugcugcaaauggaaaacaaggcuuggcuggugcacaggcaaugguucuuagaccugccguuaccauggcugcccggagcagacacacaaggaucaaauuggauacagaaggagacacuggucacuuucaaaaauccccaugcaaagaaacaggauguuguuguuuuagguucccaagaaggggccaugcacacggcacucacaggggccacggaaauccagaugucaucaggaaacuuacuguucacgggacaucuuaagugcaggcugagaauggacaaacuacagcucaaaggaaugucauauuccauguguacaggaaaguucaaaguugugaaggaaauagcagaaacacaacauggaacaauaguuauuagaguacaauaugaaggggacgguuccccgugcaagaucccuuuugaaauaauggacuuggaaaaaaggcaugucuuaggucgcuugauuaccgucaacccaauugucacagaaaaagacagcccagucaacauagaagcagaaccuccauuuggagacaguuacaucauuauaggaguagaaccaggacaacugaagcucagcugguuuaagaaaggaaguucuauuggccaaauguuugagacaacaaugagaggagcgaagagaauggccauucuaggugacacagcuugggauuuuggaucccugggaggaauguucacaucuauaggaaaggcccuccaccaagucuuuggagcuaucuauggggcugccuucagugggguuucauggacuaugaaaauccucauaggagucgucaucacauggauaggaaugaauucacgcagcaccucacugucugugucacuaguauuagugggggucgugacauuguauuugggaguuauggugcaggccgauagugggugcguugucaguuggaaaaacaaagaacugaaaugugguagugggauuuuuaucacagacaacgugcacacauggacagaacaauacaaauuccaaccagaauccccuucaaagcuggcuucagcuauccagaaggcucaugaagaaggcauuuguggaauccgcucaguaacaagacuggagaaucugauguggaaacaaauaacaccagaauugaaucacauucuaacagaaaaugaaguaaaguugacuaucaugacaggagacaucaaaggaaucaugcaggcaggaaaacgaucccugcggccucaacccacugagcugaaguacuccuggaaggcauggggcaaagcgaaaaugcuuuccacagagcuucauaaccacaccuuucucauugauggccccgaaacagcagaaugucccaacacaaacagagcuuggaacucacuagaaguugaagacuauggcuuuggaguauucaccacuaacauauggcugaaauugaaagaaaggcaggauguguuuugugacucaaaacucaugucagcagccauaaaggacaauagagccguccacgccgauauggguuauuggauagaaagcgcacucaaugacacauggaagauugagaaagccucuuuuauugaaguuaaaagcugccacuggccaaagucacacacucucuggaguaauggagugcuggaaagugagaugauaauuccaaagaauuuugcaggaccaguuucacaacacaauuacagaccaggcuaccacacacaaacggcaggacccuggcaucuagguaggcuugagauggacuuugauuucugcgaaggaaccacagugguggugacugaggacuguggaaauagaggacccuccuuaagaacaacuacugcuucuggaaaacucauaacagaguggugcugccgaucuugcacauuaccaccgcuaagguacagaggugaggauggaugcugguaugguauggaaaucaggccauugaaagagaaagaagagaaccuggucaacucuuuggucacagccggacauggacagauugacaacuucucacuaggagucuugggaauggcauuguuccuggaagagaugcucaggacucgaguaggaacgaaacaugcaauauuacuaguugcagucucuuucgugacauugaucacagggaacauguccuuucgagauuuggggagagugauggucauggugggcgcuacuaugacggaugacauaggcaugggcgugacuuaucuugcccuauuagcagccuuuaaagucagaccaaccuuugcggcuggacuacucuuaagaaagcugaccuccaaggaauugaugaugaccaccauaggaaucguacuccucucucagaguaccauaccagagagcauacuugaacugacugacgcguuggcuuuggggaugaugguucucaaaauagugagaaacauggaaaaguaucagcuagcagugacuaucauggcaaucuugugcgucccaaaugcagugauauugcaaaaugcauggaaagugagcugcacaacacuggcagugguguccguuuccccacugcuuuuaacauccucacagcagaaagcggauuggauaccacuggcguugacgaucaaaggccucaauccaacagccauuuucuuaacaacucucucaagaacuagcaagaaaaggagcuggccacuaaaugaggcuauuauggcagucgggauggugagcauucuagcuaguucucucuuaaagaaugauauucccaugacaggaccauuaguggcuggagggcuucucacuguguguuacgugcucacuggaaggucggcugacuuggaacuggaaagagcugcugacguaagaugggaagaacaggcagagauaucaggaaguaguccaauucugucgauaacaauaucggaagaugguagcaugucgauaaagaaugaagaagaagaacagacacugaccauacucaucagaacaggacuacuggugauaucaggacuuuuuccugugucaauaccaaucacggcagcugcaugguaccuuugggaagugaaaaaacaacgagcaggaguauugugggaugucccuucacccccaccugugggaaaggccgaacuggaagauggagccuauagaaucaagcagaaagggauccuaggauacucacagauuggagccggaguuuacaaagaaggaacauuccacacaauguggcaugucacacguggugcuguccuaaugcauaaagggaagagaauugaaccaucaugggcggacgucaagaaagaccuaauaucguauggaggaggcuggaagcuggaaggagaauggaaggaaggagaagaaguccagguccuggcauuagagccuggaaagaauccaagagccguccaaacaaaacccggucuuuuuaaaaccaacacuggaaccauaggcgccgugucucuggacuuuucuccuggaacgucaggaucuccaaucgucgauaaaaaaggaaaaguugugggccuuuauggcaacggugucgucacaaggaguggaacauaugugagugccauagcccagacugaaaaaagcaucgaagacaauccagagauugaagaugacaucuuuagaaagaaaagauugaccaucauggaccuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagcuaucagagcugagcacacugggcgggagauuguggaucuaaugugucaugccacauuuaccaugaggcuauuaucaccaauuagagugccaaauuacaaccugaucaucauggaugaagcccauuucacagacccagcaagcauagcagcuagaggauacauuucaacucgaguagagaugggugaagcagcugggauuuucaugacagccaccccuccuggaagcagagacccauuuccccagagcaacgcaccaaucauggaugaagaaagagaaaucccugagcguucguggaacucuggacaugaguggguuacggauuuuaaagggaagacuguuugguuugucccaaguauaaaagcagggaaugauauagcagcuugccugagaaagaauggaaagaaagugauacaacucagcaggaaaacuuuugauucugaauauaucaagacuaggaccaaugauugggacuuuguggucacgacagacauuucagaaaugggugcuaacuucaaggcugagaggguuauagaccccagacgcugcaugaaaccagucauauuaacagacggugaagagcgggugaucuuggcaggacccaugccagugacccauucuagugcagcacaaagaagagggagaguaggaagaaauccaaaaaaugaaaaugaccaguacauauacaugggggaaccucuggaaaaugaugaagacugugcacacuggaaagaagcuaagaugcucuuggauaacaucaacacgccugaaggaaucauucccagcauguucgaaccagagcgugaaaagguggaugccauugauggugaauaccgcuugagaggagaagcgaggaaaacuuuuguggaccuaaugagaagaggagauuuaccagucuggcuagccuacagaguggcggcugaaggcaucaacuacgcagacagaagauggugcuuugauggagucaagaacaaccaaaucuuggaagaaaauguggaaguagaaauuuggacaaaagaaggagaaaggaagaaauuaaaacccagaugguuggaugcuaggaucuacucugacccauuggcgcucaaagaauucaaggaauucgcagcuggaagaaagucccugacccugaaucuaaucacagagauggguagacucccaaccuucaugacccagaaagcaaagaaugcacucgacaacuuagcaguccugcauacggcugaagcaggcggaagggcguacaaucaugcucuuagugaacugccggagacucuggagacauugcuuuuacugacacuuuuggccacagucacgggcggaaucuuccuguucuugaugagcggaaaggguauagggaagaugacccugggaaugugcugcauaaucacggcuaguauccucuuaugguaugcacaaauacagccacacuggauagcagcuucaauaauacuggaguuuuuucucauagucuugcucauuccagaaccagaaaaacagagaacaccccaagauaaccaguuaacuuauguugucauagccauccuuacaguaguggccgcaaccauggcaaacgagauggguuuccuggaaaaaacaaagaaagauuucggauugggaagcauuacaacccagcaaccugagaguaacauccuggacauagaucuacguccugcaucagcuuggacucuauaugccguggcaacaacuuucaucacaccaauguugaggcauagcauugaaaacuccucagugaaugugucccuaacagccauugccaaccaagccacaguguuaaugggucuugggaaaggauggccauugucaaaaauggacaucggaguuccccuucucgcuaucgggugcuauucacaagucaaccccauaacucucacugcagcccuucucuuauugguagcccauuaugccaucauagggccaggacuccaagcgaaagcaacuagagaggcucagaaaagagcagcagcgggcaucaugaaaaacccaacuguggauggaaugacagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcaaccgggcccaucucuacacugugggaaggaaauccagggagauuuuggaauacaacuauugcagugucaauggcuaacauuuuuagagggaguuaccuggccggagccggacuucucuuuucuaucaugaaaaacacggccaacacaagaaggggaacuggcaacacaggagagacgcuuggggagaaauggaaaaaccgguugaaugcauuagggaagagugaauuccagaucuacaagaaaaguggaauccaggaaguggacagaaccuuagcaaaagaaggcaucaaaagaggagaaacggaccaucacgcugugucgcgaggcucagcgaaacugagaugguucgucgagagaaaccuggucacaccagaagggaaaguaguggaccuuggcugcggcagggggggcuggucauacuauugugggggacuaaagaauguaaaagaagucaaaggccuaacaaaaggaggaccaggacacgaagaacccauucccaugucaacauaugguuggaaucuggugcgccuucaaaguggaguugauguuuuuuuuacuccgccagaaaagugugacacacugcugugugacauaggggagucgucaccaaaccccacgguugaggcaggacgaacacucagaguucuaaacuuaguggaaaauuggcugaacaacaacacccaauuuugcauaaagguucuuaacccauacaugcccucaguuauagaaaaaauggaagcacuacaaaggaaauacggaggagcuuuggugaggaauccacucucacgaaauuccacacacgagauguacuggguauccaaugcuuccgggaauauagugucaucagugaacaugauuucaagaauguugauuaacagauucacaaugagacacaagaaagccacauacgagccagauguugaccucggaaguggaacccgcaacaucggaauugaaagugagacaccaaauuuagacauaauugggaaaagaauagagaaaauaaaacaagagcaugaaacaucauggcacuaugaccaagaccacccauacaaaacaugggccuaccauggcagcuacgaaacaaaacagacuggaucagcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccgaaagaaggcacgaaaaaacuaaugaaaauuacugcagaauggcucuggaaagaacuaggaaagaaaaagacaccuaggaugugcaccagagaagaauucacaagaaaggugagaagcaaugcagcuuuaggugccauauucacugaugagaacaaguggaagucggcacgugaggcuguugaagacaguggauuuugggaauugguugacaaggaaaggaaucuccaucuugaaggaaagugugaaacauguguguauaacaugaugggaaagagagagaagaagcuaggggaguucggcaaagcaaaaggcagcagagccauaugguacauguggcuuggagcacgcuucuuagaguuugaagcucuaggauucuugaacgaagaucacugguuuuccagagagaacucccugaguggaguggaaggagaagggcuacacaagcuaggcuacauuuuaagagacgugaguaagaaagaaggaggagcaauguaugcugaugacacugcaggaugggacacaagaaucacacuagaggacuuaaaaaaugaagaaauggugacaaaccacauggaaggagaacacaagaaacuugcugaagccauuuucaaauuaacguaccaaaacaagguggugcgugugcaaagaccaacaccaagaggcacaguaauggacauuauaucgagaagagaccaaagagguaguggacaaguugucaccuacggccucaauacuuucaccaauauggaagcccaacugaucagacagauggagggagaaggaguuuucaaaagcauccagcaacugacaguaaaagaagaaauugcagugaaaaacugguuaauaagaguggggcgugagagguuaucaagaauggccaucaguggagaugauuguguugugaaacccuuagaugacagguuugcaagugcucuaacagcucuaaaugacaugggaaagguuaggaaagacauacaacaaugggaaccuucaagaggauggaacgauuggacacaagugcccuuuuguucacaccauuuccaugaguuaaucaugaaggacggucgugugcucguaguuccaugcagaaaccaagaugaacugauuggcagggcccgaauuucccagggagccgggugguccuugcgggaaacagccugucuggggaaguccuacgcccaaauguggagccugauguacuuccacagacgugaccuuaggcuggcggcaaaugccauuugcucggcagucccaucacauuggauuccaacaagucgaacaaccugguccauacacgccacacaugaguggaugacaacagaagacauguugacagucuggaacaggguguggauucaagaaaacccauggauggaagacaaaacucuaguagaaucaugggaggaaaucccguauuuggggaaaagagaagaccaauggugcggcucauugauugggcuaacaagcagggccaccugggcaaagaacauccaaacagcaauaaaucaaguuagaucccuaauaggcaaugaggaauacacagacuacaugccaucuaugaaaagauucagaagagaagaggaagaggcaggagucuugugguag

SEQ ID NO: 6449 - RNA, 9876 nt, Artificial Sequence
  derived and/or modified CDS sequence (wt) from DENV-2__KM279549__SS-prME
acugcagguauaauuauuaugaugaucccaacagugauggcguuccauuuaaccacacgcaacggagaaccacacaugauuguuaguagacaagagaaagggaaaagucuccuguuuaaaacagagaacggugugaacauguguacccucauggccauggaccuuggugaacugugugaagacacaaucacuuauaauuguccucuucucaggcagaaugaaccagaagacauagacuguuggugcaacuccacgucuacauggguaacuuaugggacaugcaccgccacaggagaacacagaagggaaaaaagaucaguggcacucguuccacaugugggaaugggacuggagacacgaacugaaacauggaugucaucagaaggggccuggaaacaugcccagagaauugaaacuuggaucuugagacauccgggcuucaccauaauggcagcaauccuggcauacaccauaggaacaacauauuuccaaagaguccugauuuucauuuuacugacagcugucacuccuucaauggcaaugcguugcauaggaauaucaaauagagacuuuguggaagggguuucaggaggaagcuggguugauauagucuuggaacauggaagcugugugacgacgauggcgaaaaauaaaccaacguuggauuuugaauugauaaaaacagaagccaaacaccucgccacucuaaggaaguauuguguagaggcaaagcugaccaacacaacaacagcaucucgcugcccaacacaaggagaaccuagccuaaacgaagaacaggacaaaagauucgucugcaaacacuccaugguagacagaggauggggaaauggaugcggauuauuuggaaagggaggcaucgugaccugugcaauguucacaugcaaaaagaacauggaaggaaaagucgugcaaccagaaaacuuggaguacaccaucgugauaacaccucacucaggggaagagaaugcagucggaaaugacacaggaaaacauggcaaggaaauuaaaguaacaccacagaguuccaucacagaagcagaacuaacaggcuacggcacugucacgauggaaugcucuccgagaacgggccucgacuucaaugagaugguguugcugcaaauggaaaacaaggcuuggcuggugcacaggcaaugguucuuagaccugccguuaccauggcugcccggagcagacacacaaggaucaaauuggauacagaaggagacacuggucacuuucaaaaauccccaugcaaagaaacaggauguuguuguuuuagguucccaagaaggggccaugcacacggcacucacaggggccacggaaauccagaugucaucaggaaacuuacuguucacgggacaucuuaagugcaggcugagaauggacaaacuacagcucaaaggaaugucauauuccauguguacaggaaaguucaaaguugugaaggaaauagcagaaacacaacauggaacaauaguuauuagaguacaauaugaaggggacgguuccccgugcaagaucccuuuugaaauaauggacuuggaaaaaaggcaugucuuaggucgcuugauuaccgucaacccaauugucacagaaaaagacagcccagucaacauagaagcagaaccuccauuuggagacaguuacaucauuauaggaguagaaccaggacaacugaagcucagcugguuuaagaaaggaaguucuauuggccaaauguuugagacaacaaugagaggagcgaagagaauggccauucuaggugacacagcuugggauuuuggaucccugggaggaguguucacaucuauaggaaaggcccuccaccaagucuuuggagcuaucuauggggcugccuucagugggguuucauggacuaugaaaauccucauaggagucgucaucacauggauaggaaugaauucacgcagcaccucacugucugugucacuaguauuagugggggucgugacauuguauuugggaguuauggugcaggccgauagugggugcguugucaguuggaaaaacaaagaacugaaaugugguagugggauuuuuaucacagacaacgugcacacauggacagaacaauacaaauuccaaccagaauccccuucaaagcuggcuucagcuauccagaaggcucaugaagaaggcauuuguggaauccgcucaguaacaagacuggagaaucugauguggaaacaaauaacaccagaauugaaucacauucuaacagaaaaugaaguaaaguugacuaucaugacaggagacaucaaaggaaucaugcaggcaggaaaacgaucccugcggccucaacccacugagcugaaguacuccuggaaggcauggggcaaagcgaaaaugcuuuccacagagcuucauaaccacaccuuucucauugauggccccgaaacagcagaaugucccaacacaaacagagcuuggaacucacuagaaguugaagacuauggcuuuggaguauucaccacuaacauauggcugaaauugaaagaaaggcaggauguguuuugugacucaaaacucaugucagcagccauaaaggacaauagagccguccacgccgauauggguuauuggauagaaagcgcacucaaugacacauggaagauugagaaagccucuuuuauugaaguuaaaagcugccacuggccaaagucacacacucucuggaguaauggagugcuggaaagugagaugauaauuccaaagaauuuugcaggaccaguuucacaacacaauuacagaccaggcuaccacacacaaacggcaggacccuggcaucuagguaggcuugagauggacuuugauuucugcgaaggaaccacagugguggugacugaggacuguggaaauagaggacccuccuuaagaacaacuacugcuucuggaaaacucauaacagaguggugcugccgaucuugcacauuaccaccgcuaagguacagaggugaggauggaugcugguaugguauggaaaucaggccauugaaagagaaagaagagaaccuggucaacucuuuggucacagccggacauggacagauugacaacuucucacuaggagucuugggaauggcauuguuccuggaagagaugcucaggacucgaguaggaacgaaacaugcaauauuacuaguugcagucucuuucgugacauugaucacagggaacauguccuuucgagauuuggggagagugauggucauggugggcgcuacuaugacggaugacauaggcaugggcgugacuuaucuugcccuauuagcagccuuuaaagucagaccaaccuuugcggcuggacuacucuuaagaaagcugaccuccaaggaauugaugaugaccaccauaggaaucguacuccucucucagaguaccauaccagagagcauacuugaacugacugacgcguuggcuuuggggaugaugguucucaaaauagugagaaacauggaaaaguaucagcuagcagugacuaucauggcaaucuugugcgucccaaaugcagugauauugcaaaaugcauggaaagugagcugcacaacacuggcagugguguccguuuccccacugcuuuuaacauccucacagcagaaagcggauuggauaccacuggcguugacgaucaaaggccucaauccaacagccauuuucuuaacaacucucucaagaacuagcaagaaaaggagcuggccacuaaaugaggcuauuauggcagucgggauggugagcauucuagcuaguucucucuuaaagaaugauauucccaugacaggaccauuaguggcuggagggcuucucacuguguguuacgugcucacuggaaggucggcugacuuggaacuggaaagagcugcugacguaagaugggaagaacaggcagagauaucaggaaguaguccaauucugucgauaacaauaucggaagaugguagcaugucgauaaagaaugaagaagaagaacagacacugaccauacucaucagaacaggacuacuggugauaucaggacuuuuuccugugucaauaccaaucacggcagcugcaugguaccuuugggaagugaaaaaacaacgagcaggaguauugugggaugucccuucacccccaccugugggaaaggccgaacuggaagauggagccuauagaaucaagcagaaagggauccuaggauacucacagauuggagccggaguuuacaaagaaggaacauuccacacaauguggcaugucacacguggugcuguccuaaugcauaaagggaagagaauugaaccaucaugggcggacgucaagaaagaccuaauaucguauggaggaggcuggaagcuggaaggagaauggaaggaaggagaagaaguccagguccuggcauuagagccuggaaagaauccaagagccguccaaacaaaacccggucuuuuuaaaaccaacacuggaaccauaggcgccgugucucuggacuuuucuccuggaacgucaggaucuccaaucgucgauaaaaaaggaaaaguugugggccuuuauggcaacggugucgucacaaggaguggaacauaugugagugccauagcccagacugaaaaaagcaucgaagacaauccagagauugaagaugacaucuuuagaaagaaaagauugaccaucauggaccuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagcuaucagagcugagcacacugggcgggagauuguggaucuaaugugucaugccacauuuaccaugaggcuauuaucaccaauuagagugccaaauuacaaccugaucaucauggaugaagcccauuucacagacccagcaagcauagcagcuagaggauacauuucaacucgaguagagaugggugaagcagcugggauuuucaugacagccaccccuccuggaagcagagacccauuuccccagagcaacgcaccaaucauggaugaagaaagagaaaucccugagcguucguggaacucuggacaugaguggguuacggauuuuaaagggaagacuguuugguuugucccaaguauaaaagcagggaaugauauagcagcuugccugagaaagaauggaaagaaagugauacaacucagcaggaaaacuuuugauucugaauauaucaagacuaggaccaaugauugggacuuuguggucacgacagacauuucagaaaugggugcuaacuucaaggcugagaggguuauagaccccagacgcugcaugaaaccagucauauuaacagacggugaagagcgggugaucuuggcaggacccaugccagugacccauucuagugcagcacaaagaagagggagaguaggaagaaauccaaaaaaugaaaaugaccaguacauauacaugggggaaccucuggaaaaugaugaagacugugcacacuggaaagaagcuaagaugcucuuggauaacaucaacacgccugaaggaaucauucccagcauguucgaaccagagcgugaaaagguggaugccauugauggugaauaccgcuugagaggagaagcgaggaaaacuuuuguggaccuaaugagaagaggagauuuaccagucuggcuagccuacagaguggcggcugaaggcaucaacuacguagacagaagauggugcuuugauggagucaagaacaaccaaaucuuggaagaaaauguggaaguagaaauuuggacaaaagaaggagaaaggaagaaauuaaaacccagaugguuggaugcuaggaucuacucugacccauuggcgcucaaagaauucaaggaauucgcagcuggaagaaagucccugacccugaaucuaaucacagagauggguagacucccaaccuucaugacccagaaagcaaagaaugcacucgacaacuuagcaguccugcauacggcugaagcaggcggaagggcguacaaucaugcucuuagugaacugccggagacucuggagacauugcuuuuacugacacuuuuggccacagucacgggcggaaucuuccuguucuugaugagcggaaaggguauagggaagaugacccugggaaugugcugcauaaucacggcuaguauccucuuaugguaugcacaaauacagccacacuggauagcagcuucaauaauacuggaguuuuuucucauagucuugcucauuccagaaccagaaaaacagagaacaccccaagauaaccaguuaacuuauguugucauagccauccuuacaguaguggccgcaaccauggcaaacgagauggguuuccuggaaaaaacaaagaaagauuucggauugggaagcauuacaacccagcaaccugagaguaacauccuggacauagaucuacguccugcaucagcuuggacucuauaugccguggcaacaacuuucaucacaccaauguugaggcauagcauugaaaacuccucagugaaugugucccuaacagccauugccaaccaagccacaguguuaaugggucuugggaaaggauggccauugucaaaaauggacaucggaguuccccuucucgcuaucgggugcuauucacaagucaaccccauaacucucacugcagcccuucucuuauugguagcccauuaugccaucauagggccaggacuccaagcgaaagcaacuagagaggcucagaaaagagcagcagcggguaucaugaaaaacccaacuguggauggaaugacagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcaaccgggcccaucucuacacugugggagggaaauccagggagauuuuggaauacaacuauugcagugucaauggcuaacauuuuuagagggaguuaccuggccggagccggacuucucuuuucuaucaugaaaaacacggccaacacaagaaggggaacuggcaacacaggagagacgcuuggggagaaauggaaaaaccgguugaaugcauuagggaagagugaauuccagaucuacaagaaaaguggaauccaggaaguggacagaaccuuagcaaaagaaggcaucaaaagaggagaaacggaccaucacgcugugucgcgaggcucagcgaaacugagaugguucgucgagagaaaccuggucacaccagaagggaaaguaguggaccuuggcugcggcagggggggcuggucauacuauugugggggacuaaagaauguaaaagaagucaaaggccuaacaaaaggaggaccaggacacgaagaacccauucccaugucaacauaugguuggaaucuggugcgccuucaaaguggaguugauguuuuuuuuacuccgccagaaaagugugacacacugcugugugacauaggggagucgucaccaaaccccacgguugaggcaggacgaacacucagaguucuaaacuuaguggaaaauuggcugaacaacaacacccaauuuugcauaaagguucuuaacccauacaugcccucaguuauagaaaaaauggaagcacuacaaaggaaauacggaggagcuuuggugaggaauccacucucacgaaauuccacacacgagauguacuggguauccaaugcuuccgggaauauagugucaucagugaacaugauuucaagaauguugauuaacagauucacaaugagacacaagaaagccacauacgagccagauguugaccucggaaguggaacccgcaacaucggaauugaaagugagacaccaaauuuagacauaauugggaaaagaauagaaaaaauaaaacaagagcaugaaacaucauggcacuaugaccaagaccacccauacaaaacaugggccuaccauggcagcuacgaaacaaaacagacuggaucagcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccgaaagaaggcacgaaaaaacuaaugaaaauuacugcagaauggcucuggaaagaacuaggaaagaaaaagacaccuaggaugugcaccagagaagaauucacaagaaaggugagaagcaaugcagcuuuaggugccauauucacugaugagaacaaguggaagucggcacgugaggcuguugaagacaguggauuuugggaauugguugacaaggaaaggaaucuccaucuugagggaaagugugaaacauguguguauaacaugaugggaaagagagagaagaagcuaggggaguucggcaaagcaaaaggcagcagagccauaugguacauguggcuuggagcacgcuucuuagaguuugaagcucuaggauucuugaacgaagaucacugguuuuccagagagaacucccugaguggaguggaaggagaagggcuacacaagcuaggcuacauuuuaagagacgugaguaagaaagaaggaggagcaauguaugcugaugacacugcaggaugggacacaagaaucacacuagaggacuuaaaaaaugaagaaauggugacaaaccacauggaaggagaacacaagaaacuugcugaagccauuuucaaauuaacguaccaaaacaagguggugcgugugcaaagaccaacaccaagaggcacaguaauggacauuauaucgagaagagaccaaagagguaguggacaaguugucaccuacggccucaauacuuucaccaauauggaagcccaacugaucagacagauggagggagaaggaguuuucaaaagcauccagcaacugacaguaaaagaagaaauugcagugaaaaacugguuaauaagaguggggcgugagagguuaucaagaauggccaucaguggagaugauuguguugugaaacccuuagaugacagguuugcaagugcucuaacagcucuaaaugacaugggaaagguuaggaaagacauacaacaaugggaaccuucaagaggauggaacgauuggacacaagugcccuuuuguucacaccauuuccaugaguuaaucaugaaggacggucgugugcucguaguuccaugcagaaaccaagaugaacugauuggcagggcccgaauuucccagggagccgggugguccuugcgggaaacagccugucuggggaaguccuacgcccaaauguggagccugauguacuuccacagacgugaccuuaggcuggcggcaaaugccauuugcucggcagucccaucacauuggauuccaacaagucgaacaaccugguccauacacgccacacaugaguggaugacaacagaagacauguugacagucuggaacaggguguggauucaagaaaacccauggauggaagacaaaacuccaguagaaucaugggaggaaaucccguauuuggggaaaagagaagaccaauggugcggcucauugauugggcuaacaagcagggccaccugggcaaagaacauccaaacagcaauaaaucaaguuagaucccuaauaggcaaugaggaauacacagacuacaugccaucuaugaaaagauucagaagagaagaggaagaggcaggagucuugugguag

SEQ ID NO: 6450 - RNA, 9876 nt, Artificial Sequence
  derived and/or modified CDS sequence (wt) from DENV-2__KM279552__SS-prME
acugcagguauaauuauuaugaugaucccaacagugauggcguuccauuuaaccacacgcaacggagaaccacacaugauuguuaguagacaagagaaagggaaaagucuccuguuuaaaacagagaacggugugaacauguguacccucauggccauggaccuuggugaacugugugaagacacaaucacuuauaauuguccucuucucaggcagaaugaaccagaagacauagacuguuggugcaacuccacgucuacauggguaacuuaugggacaugcaccgccacaggagaacacagaagggaaaaaagaucaguggcacucguuccacaugugggaaugggacuggagacacgaacugaaacauggaugucaucagaaggggccuggaaacaugcccagagaauugaaacuuggaucuugagacauccgggcuucaccauaauggcagcaauccuggcauacaccauaggaacaacauauuuccaaagaguccugauuuucauuuuacugacagcugucacuccuucaauggcaaugcguugcauaggaauaucaaauagagacuuuguggaagggguuucaggaggaagcuggguugauauagucuuggaacauggaagcugugugacgacgauggcgaaaaauaaaccaacguuggauuuugaauugauaaaaacagaagccaaacaucucgccacucuaaggaaguauuguguagaggcaaagcugaccaacacaacaacagcaucucgcugcccaacacaaggagaaccuagccuaaacgaagaacaggacaaaagauucgucugcaaacacuccaugguagacagaggauggggaaauggaugcggauuauuuggaaagggaggcaucgugaccugugcaauguucacaugcaaaaagaacauggaaggaaaagucgugcaaccagaaaacuuggaguacaccaucgugauaacaccucacucaggggaagagaaugcagucggaaaugacacaggaaaacauggcaaggaaauuaaaguaacaccacagaguuccaucacagaagcagaacuaacaggcuacggcacugucacgauggaaugcucuccgagaacgggccucgacuucaaugagaugguguugcugcaaauggaaaacaaggcuuggcuggugcacaggcaaugguucuuagaccugccguuaccauggcugcccggagcagacacacaaggaucaaauuggauacagaaggagacacuggucacuuucaaaaauccccaugcaaagaaacaggauguuguuguuuuagguucccaagaaggggccaugcacacggcacucacaggggccacggaaauccagaugucaucaggaaacuuacuguucacgggacaucuuaagugcaggcugagaauggacaaacuacagcucaaaggaaugucauauuccauguguacaggaaaguucaaaguugugaaggaaauagcagaaacacaacauggaacaauaguuauuagaguacaauaugaaggggacgguuccccgugcaagaucccuuuugaaauaauggacuuggaaaaaaggcaugucuuaggucgcuugauuaccgucaacccaauugucacagaaaaagacagcccagucaacauagaagcagaaccuccauuuggagacaguuacaucauuauaggaguagaaccaggacaacugaagcucagcugguuuaagaaaggaaguucuauuggccaaauguuugagacaacaaugagaggagcgaagagaauggccauucuaggugacacagcuugggauuuuggaucccugggaggaguguucacaucuauaggaaaggcccuccaccaagucuuuggagcuaucuauggggcugccuucagugggguuucauggacuaugaaaauccucauaggagucgucaucacauggauaggaaugaauucacgcagcaccucacugucugugucacuaguauuagugggggucgugacauuguauuugggaguuauggugcaggccgauagugggugcguugucaguuggaaaaacaaagaacugaaaugugguagugggauuuuuaucacagacaacgugcacacauggacagaacaauacaaauuccaaccagaauccccuucaaagcuggcuucagcuauccagaaggcucaugaagaaggcauuuguggaauccgcucaguaacaagacuggagaaucugauguggaaacaaauaacaccagaauugaaucacauucuaacagaaaaugaaguaaaguugacuaucaugacaggagacaucaaaggaaucaugcaggcaggaaaacgaucccugcggccucaacccacugagcugaaguacuccuggaaggcauggggcaaagcgaaaaugcuuuccacagagcuucauaaccacaccuuucucauugauggccccgaaacagcagaaugucccaacacaaacagagcuuggaacucacuagaaguugaagacuauggcuuuggaguauucaccacuaacauauggcugaaauugaaagaaaggcaggauguguuuugugacucaaaacucaugucagcagccauaaaggacaauagagccguccacgccgauauggguuauuggauagaaagcgcacucaaugacacauggaagauugagaaagccucuuuuauugaaguuaaaagcugccacuggccaaagucacacacucucuggaguaauggagugcuggaaagugagaugauaauuccaaagaauuuugcaggaccaguuucacaacacaauuacagaccaggcuaccacacacaaacggcaggacccuggcaucuagguaggcuugagauggacuuugauuucugcgaaggaaccacagugguggugacugaggacuguggaaauagaggacccuccuuaagaacaacuacugcuucuggaaaacucauaacagaguggugcugccgaucuugcacauuaccaccgcuaagguacagaggugaggauggaugcugguaugguauggaaaucaggccauugaaagagaaagaagagaaccuggucaacucuuuggucacagccggacauggacagauugacaacuucucacuaggagucuugggaauggcauuguuccuggaagagaugcucaggacucgaguaggaacgaaacaugcaauauuacuaguugcagucucuuucgugacauugaucacagggaacauguccuuucgagauuuggggagagugauggucauggugggcgcuacuaugacggaugacauaggcaugggcgugacuuaucuugcccuauuagcagccuuuaaagucagaccaaccuuugcggcuggacuacucuuaagaaagcugaccuccaaggaauugaugaugaccaccauaggaaucguacuccucucucacaguaccauaccagagagcauacuugaacugacugacgcguuggcuuuggggaugaugguucucaaaauagugagaaacauggaaaaguaucagcuagcagugacuaucauggcaaucuugugcgucccaaaugcagugauauugcaaaaugcauggaaagugagcugcacaacacuggcagugguguccguuuccccacugcuuuuaacauccucacagcagaaagcggauuggauaccacuggcguugacgaucaaaggccucaauccaacagccauuuucuuaacaacucucucaagaacuagcaagaaaaggagcuggccacuaaaugaggcuauuauggcagucgggauggugagcauucuagcuaguucucucuuaaagaaugauauucccaugacaggaccauuaguggcuggagggcuucucacuguguguuacgugcucacuggaaggucggcugacuuggaacuggaaagagcugcugacguaagaugggaagaacaggcagagauaucaggaaguaguccaauucugucgauaacaauaucggaagaugguagcaugucgauaaagaaugaagaagaagaacagacacugaccauacucaucagaacaggacuacuggugauaucaggacuuuuuccugugucaauaccaaucacggcagcugcaugguaccuuugggaagugaaaaaacaacgagcaggaguauugugggaugucccuucacccccaccugugggaaaggccgaacuggaagauggagccuauagaaucaagcagaaagggauccuaggauacucacagauuggagccggaguuuacaaagaaggaacauuccacacaauguggcaugucacacguggugcuguccuaaugcauaaagggaagagaauugaaccaucaugggcggacgucaagaaagaccuaauaucguauggaggaggcuggaagcuggaaggagaauggaaggaaggagaagaaguccagguccuggcauuagagccuggaaagaauccaagagccguccaaacaaaacccggucuuuuuaaaaccaacacuggaaccauaggcgccgugucucuggacuuuucuccuggaacgucaggaucuccaaucgucgauaaaaaaggaaaaguugugggccuuuauggcaacggugucgucacaaggaguggaacauaugugagugccauagcccagacugaaaaaagcaucgaagacaauccagagauugaagaugacaucuuuagaaagaaaagauugaccaucauggaccuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagcuaucagagcugagcacacugggcgggagauuguggaucuaaugugucaugccacauuuaccaugaggcuauuaucaccaauuagagugccaaauuacaaccugaucaucauggaugaagcccauuucacagacccagcaagcauagcagcuagaggauacauuucaacucgaguagagaugggugaagcagcugggauuuucaugacagccaccccuccuggaagcagagacccauuuccccagagcaacgcaccaaucauggaugaagaaagagaaaucccugagcguucguggaacucuggacaugaguggguuacggauuuuaaagggaagacuguuugguuugucccaaguauaaaagcagggaaugauauagcagcuugccugagaaagaauggaaagaaagugauacaacucagcaggaaaacuuuugauucugaauauaucaagacuaggaccaaugauugggacuuuguggucacgacagacauuucagaaaugggugcuaacuucaaggcugagaggguuauagaccccagacgcugcaugaaaccagucauauuaacagacggugaagagcgggugaucuuggcaggacccaugccagugacccauucuagugcagcacaaagaagagggagaguaggaagaaauccaaaaaaugaaaaugaccaguacauauacaugggggaaccucuggaaaaugaugaagacugugcacacuggaaagaagcuaagaugcucuuggauaacaucaacacgccugaaggaaucauucccagcauguucgaaccagagcgugaaaagguggaugccauugauggugaauaccgcuugagaggagaagcgaggaaaacuuuuguggaccuaaugagaagaggagauuuaccagucuggcuagccuacagaguggcggcugaaggcaucaacuacgcagacagaagauggugcuuugauggagucaagaacaaccaaaucuuggaagaaaauguggaaguagaaauuuggacaaaagaaggagaaaggaagaaauuaaaacccagaugguuggaugcuaggaucuacucugacccauuggcgcucaaagaauucaaggaauucgcagcuggaagaaagucccugacccugaaucuaaucacagagauggguagacucccaaccuucaugacccagaaagcaaagaaugcacucgacaacuuagcaguccugcauacggcugaagcaggcggaagggcguacaaucaugcucuuagugaacugccggagacucuggagacauugcuuuuacugacacuuuuggccacagucacgggcggaaucuuccuguucuugaugagcggaaaggguauagggaagaugacccugggaaugugcugcauaaucacggcuaguauccucuuaugguaugcacaaauacagccacacuggauagcagcuucaauaauacuggaguuuuuucucauagucuugcucauuccagaaccagaaaaacagagaacaccccaagauaaccaguuaacuuauguugucauagccauccuuacaguaguggccgcaaccauggcaaacgagauggguuuccuggaaaaaacaaagaaagauuucggauugggaagcauuacaacccagcaaccugagaguaacauccuggacauagaucuacguccugcaucagcuuggacucuauaugccguggcaacaacuuucaucacaccaauguugaggcauagcauugaaaacuccucagugaaugugucccuaacagccauugccaaccaagccacaguguuaaugggucuugggaaaggauggccauugucaaaaauggacaucggaguuccccuucucgcuaucgggugcuauucacaagucaaccccauaacucucacugcagcccuucucuuauugguagcccauuaugccaucauagggccaggacuccaagcgaaagcaacuagagaggcucagaaaagagcagcagcgggcaucaugaaaaacccaacuguggauggaaugacagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcaaccgggcccaucucuacacugugggaaggaaauccagggagauuuuggaauacaacuauugcagugucaauggcuaacauuuuuagagggaguuaccuggccggagccggacuucucuuuucuaucaugaaaaacacggccaacacaagaaggggaacuggcaacacaggagagacgcuuggggagaaauggaaaaaccgguugaaugcauuagggaagagugaauuccagaucuacaagaaaaguggaauccaggaaguggacagaaccuuagcaaaagaaggcaucaaaagaggagaaacggaccaucacgcugugucgcgaggcucagcgaaacugagaugguucgucgagagaaaccuggucacaccagaagggaaaguaguggaccuuggcugcggcagggggggcuggucauacuauugugggggacuaaagaauguaaaagaagucaaaggccuaacaaaaggaggaccaggacacgaagaacccauucccaugucaacauaugguuggaaucuggugcgccuucaaaguggaguugauguuuuuuuuacuccgccagaaaagugugacacacugcugugugacauaggggagucgucaccaaaccccacgguugaggcaggacgaacacucagaguucuaaacuuaguggaaaauuggcugaacaacaacacccaauuuugcauaaagguucuuaacccauacaugcccucaguuauagaaaaaauggaagcacuacaaaggaaauacggaggagcuuuggugaggaauccacucucacgaaauuccacacacgagauguacuggguauccaaugcuuccgggaauauagugucaucagugaacaugauuucaagaauguugauuaacagauucacaaugagacacaagaaagccacauacgagccagauguugaccucggaaguggaacccgcaacaucggaauugaaagugagacaccaaauuuagacauaauugggaaaagaauagaaaaaauaaaacaagagcaugaaacaucauggcacuaugaccaagaccacccauacaaaacaugggccuaccauggcagcuacgaaacaaaacagacuggaucagcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccgaaagaaggcacgaaaaaacuaaugaaaauuacugcagaauggcucuggaaagaacuaggaaagaaaaagacaccuaggaugugcaccagagaagaauucacaagaaaggugagaagcaaugcagcuuuaggugccauauucacugaugagaacaaguggaagucggcacgugaggcuguugaagacaguggauuuugggaauugguugacaaggaaaggaaucuccaucuugaaggaaagugugaaacauguguguauaacaugaugggaaagagagagaagaagcuaggggaguucggcaaagcaaaaggcagcagagccauaugguacauguggcuuggagcacgcuucuuagaguuugaagcucuaggauucuugaacgaagaucacugguuuuccagagagaacucccugaguggaguggaaggagaagggcuacacaagcuaggcuacauuuuaagagacgugaguaagaaagaaggaggagcaauguaugcugaugacacugcaggaugggacacaagaaucacacuagaggacuuaaaaaaugaagaaauggugacaaaccacauggaaggagaacacaagaaacuugcugaagccauuuucaaauuaacguaccaaaacaagguggugcgugugcaaagaccaacaccaagaggcacaguaauggacauuauaucgagaagagaccaaagagguaguggacaaguugucaccuacggccucaauacuuucaccaauauggaagcccaacugaucagacagauggagggagaaggaguuuucaaaagcauccagcaacugacaguaaaagaagaaauugcagugaaaaacugguuaauaagaguggggcgugagagguuaucaagaauggccaucaguggagaugauuguguugugaaacccuuagaugacagguuugcaagugcucuaacagcucuaaaugacaugggaaagguuaggaaagacauacaacaaugggaaccuucaagaggauggaacgauuggacacaagugcccuuuuguucacaccauuuucaugaguuaaucaugaaggacggucgugugcucguaguuccaugcagaaaccaagaugaacugauuggcagggcccgaauuucccagggagccgggugguccuugcgggaaacagccugucuggggaaguccuacgcccaaauguggagccugauguacuuccacagacgugaccuuaggcuggcggcaaaugccauuugcucggcagucccaucacauuggauuccaacaagucgaacaaccugguccauacacgccacacaugaguggaugacaacagaagacauguugacagucuggaacaggguguggauucaagaaaacccauggauggaagacaaaacuccaguagaaucaugggaggaaaucccguauuuggggaaaagagaagaccaauggugcggcucauugauugggcuaacaagcagggccaccugggcaaagaacauccaaacagcaauaaaucaaguuagaucccuaauaggcaaugaggaauacacagacuacaugccaucuaugaaaagauucagaagagaagaggaagaggcaggagucuugugguag

SEQ ID NO: 6451 - RNA, 9876 nt, Artificial Sequence
  derived and/or modified CDS sequence (wt) from DENV-2__KM279557__SS-prME
acugcagguauaauuauuaugaugaucccaacagugauggcguuccauuuaaccacacgcaacggagaaccacacaugauuguuaguagacaagagaaagggaaaagucuccuguuuaaaacagagaacggugugaacauguguacccucauggccauggaccuuggugaacugugugaagacacaaucacuuauaauuguccucuucucaggcagaaugaaccagaagacauagacuguuggugcaacuccacgucuacauggguaacuuaugggacaugcaccgccacaggagaacacagaagggaaaaaagaucaguggcacucguuccacaugugggaaugggacuggagacacgaacugaaacauggaugucaucagaaggggccuggaaacaugcccagagaauugaaacuuggaucuugagacauccgggcuucaccauaauggcagcaauccuggcauacaccauaggaacaacauauuuccaaagaguccugauuuucauuuuacugacagcugucacuccuucaauggcaaugcguugcauaggaauaucaaauagagacuuuguggaagggguuucaggaggaagcuggguugauauagucuuggaacauggaagcugugugacgacgauggcgaaaaauaaaccaacguuggauuuugaauugauaaaaacagaagccaaacaucucgccacucuaaggaaguauuguguagaggcaaagcugaccaacacaacaacagcaucucgcugcccaacacaaggagaaccuagccuaaacgaagaacaggacaaaagauucgucugcaaacacuccaugguagacagaggauggggaaauggaugcggauuauuuggaaagggaggcaucgugaccugugcaauguucacaugcaaaaagaacauggaaggaaaagucgugcaaccagaaaacuuggaguacaccaucgugauaacaccucacucaggggaagagaaugcagucggaaaugacacaggaaaacauggcaaggaaauuaaaguaacaccacagaguuccaucacagaagcagaacuaacaggcuacggcacugucacgauggaaugcucuccgagaacgggccucgacuucaaugagaugguguugcugcaaauggaaaacaaggcuuggcuggugcacaggcaaugguucuuagaccugccguuaccauggcugcccggagcagacacacaaggaucaaauuggauacagaaggagacacuggucacuuucaaaaauccccaugcaaagaaacaggauguuguuguuuuagguucccaagaaggggccaugcacacggcacucacaggggccacggaaauccagaugucaucaggaaacuuacuguucacgggacaucuuaagugcaggcugagaauggacaaacuacagcucaaaggaaugucauauuccauguguacaggaaaguucaaaguugugaaggaaauagcagaaacacaacauggaacaauaguuauuagaguacaauaugaaggggacgguuccccgugcaagaucccuuuugaaauaauggacuuggaaaaaaggcaugucuuaggucgcuugauuaccgucaacccaauugucacagaaaaagacagcccagucaacauagaagcagaaccuccauuuggagacaguuacaucauuauaggaguagaaccaggacaacugaagcucagcugguuuaagaaaggaaguucuauuggccaaauguuugagacaacaaugagaggagcgaagagaauggccauucuaggugacacagcuugggauuuuggaucccugggaggaguguucacaucuauaggaaaggcccuccaccaagucuuuggagcuaucuauggggcugccuucagugggguuucauggacuaugaaaauccucauaggagucgucaucacauggauaggaaugaauucacgcagcaccucacugucugugucacuaguauuggugggggucgugacauuguauuugggaguuauggugcaggccgauagugggugcguugucaguuggaaaaacaaagaacugaaaugugguagugggauuuuuaucacagacaacgugcacacauggacagaacaauacaaauuccaaccagaauccccuucaaagcuggcuucagcuauccagaaggcucaugaagaaggcauuuguggaauccgcucaguaacaagacuggagaaucugauguggaaacaaauaacaccagaauugaaucacauucuaacagaaaaugaaguaaaguugacuaucaugacaggagacaucaaaggaaucaugcaggcaggaaaacgaucccugcggccucaacccacugagcugaaguacuccuggaaggcauggggcaaagcgaaaaugcuuuccacagagcuucauaaccacaccuuucucauugauggccccgaaacagcagaaugucccaacacaaacagagcuuggaacucacuagaaguugaagacuauggcuuuggaguauucaccacuaacauauggcugaaauugaaagaaaggcaggauguguuuugugacucaaaacucaugucagcagccauaaaggacaauagagccguccacgccgauauggguuauuggauagaaagcgcacucaaugacacauggaagauugagaaagccucuuuuauugaaguuaaaagcugccacuggccaaagucacacacucucuggaguaauggagugcuggaaagugagaugauaauuccaaagaauuuugcaggaccaguuucacaacacaauuacagaccaggcuaccacacacaaacggcaggacccuggcaucuagguaggcuugagauggacuuugauuucugcgaaggaaccacagugguggugacugaggacuguggaaauagaggacccuccuuaagaacaacuacugcuucuggaaaacucauaacagaguggugcugccgaucuugcacauuaccaccgcuaagguacagaggugaggauggaugcugguaugguauggaaaucaggccauugaaagagaaagaagagaaccuggucaacucuuuggucacagccggacauggacagauugacaacuucucacuaggagucuugggaauggcauuguuccuggaagagaugcucaggacucgaguaggaacgaaacaugcaauauuacuaguugcagucucuuucgugacauugaucacagggaacauguccuuucgagauuuggggagagugauggucauggugggcgcuacuaugacggaugacauaggcaugggcgugacuuaucuugcccuauuagcagccuuuaaagucagaccaaccuuugcggcuggacuacucuuaagaaagcugaccuccaaggaauugaugaugaccaccauaggaaucguacuccucucucagaguaccauaccagagagcauacuugaacugacugacgcguuggcuuuggggaugaugguucucaaaauagugagaaacauggaaaaguaucagcuagcagugacuaucauggcaaucuugugcgucccaaaugcagugauauugcaaaaugcauggaaagugagcugcacaacacuggcagugguguccguuuccccacugcuuuuaacauccucacagcagaaagcggauuggauaccacuggcguugacgaucaaaggccucaauccaacagccauuuucuuaacaacucucucaagaacuagcaagaaaaggagcuggccacuaaaugaggcuauuauggcagucgggauggugagcauucuagcuaguucucucuuaaagaaugauauucccaugacaggaccauuaguggcuggagggcuucucacuguguguuacgugcucacuggaaggucggcugacuuggaacuggaaagagcugcugacguaagaugggaagaacaggcagagauaucaggaaguaguccaauucugucgauaacaauaucggaagaugguagcaugucgauaaagaaugaagaagaagaacagacacugaccauacucaucagaacaggacuacuggugauaucaggacuuuuuccugugucaauaccaaucacggcagcugcaugguaccuuugggaagugaaaaaacaacgagcaggaguauugugggaugucccuucacccccaccugugggaaaggccgaacuggaagauggagccuauagaaucaagcagaaagggauccuaggauacucacagauuggagccggaguuuacaaagaaggaacauuccacacaauguggcaugucacacguggugcuguccuaaugcauaaagggaagagaauugaaccaucaugggcggacgucaagaaagaccuaauaucguauggaggaggcuggaagcuggaaggagaauggaaggaaggagaagaaguccagguccuggcauuagagccuggaaagaauccaagagccguccaaacaaaacccggucuuuuuaaaaccaacacuggaaccauaggcgccgugucucuggacuuuucuccuggaacgucaggaucuccaaucgucgauaaaaaaggaaaaguugugggccuuuauggcaacggugucgucacaaggaguggaacauaugugagugccauagcccagacugaaaaaagcaucgaagacaauccagagauugaagaugacaucuuuagaaagaaaagauugaccaucauggaccuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagcuaucagagcugagcacacugggcgggagauuguggaucuaaugugucaugccacauuuaccaugaggcuauuaucaccaauuagagugccaaauuacaaccugaucaucauggaugaagcccauuucacagacccagcaagcauagcagcuagaggauacauuucaacucgaguagagaugggugaagcagcugggauuuucaugacagccaccccuccuggaagcagagacccauuuccccagagcaacgcaccaaucauggaugaagaaagagaaaucccugagcguucguggaacucuggacaugaguggguuacggauuuuaaagggaagacuguuugguuugucccaaguauaaaagcagggaaugauauagcagcuugccugagaaagaauggaaagaaagugauacaacucagcaggaaaacuuuugauucugaauauaucaagacuaggaccaaugauugggacuuuguggucacgacagacauuucagaaaugggugcuaacuucaaggcugagaggguuauagaccccagacgcugcaugaaaccagucauauuaacagacggugaagagcgggugaucuuggcaggacccaugccagugacccauucuagugcagcacaaagaagagggagaguaggaagaaauccaaaaaaugaaaaugaccaguacauauacaugggggaaccucuggaaaaugaugaagacugugcacacuggaaagaagcuaagaugcucuuggauaacaucaacacgccugaaggaaucauucccagcauguucgaaccagagcgugaaaagguggaugccauugauggugaauaccgcuugagaggagaagcgaggaaaacuuuuguggaccuaaugagaagaggagauuuaccagucuggcuagccuacagaguggcggcugaaggcaucaacuacgcagacagaagauggugcuuugauggagucaagaacaaccaaaucuuggaagaaaauguggaaguagaaauuuggacaaaagaaggagaaaggaagaaauuaaaacccagaugguuggaugcuaggaucuacucugacccauuggcgcucaaagaauucaaggaauucgcagcuggaagaaagucccugacccugaaucuaaucacagagauggguagacucccaaccuucaugacccagaaagcaaagaaugcacucgacaacuuagcaguccugcauacggcugaagcaggcggaagggcguacaaucaugcucuuagugaacugccggagacucuggagacauugcuuuuacugacacuuuuggccacagucacgggcggaaucuuccuguucuugaugagcggaaaggguauagggaagaugacccugggaaugugcugcauaaucacggcuaguauccucuuaugguaugcacaaauacagccacacuggauagcagcuucaauaauacuggaguuuuuucucauagucuugcucauuccagaaccagaaaaacagagaacaccccaagauaaccaguuaacuuauguugucauagccauccuuacaguaguggccgcaaccauggcaaacgagauggguuuccuggaaaaaacaaagaaagauuucggauugggaagcauuacaacccagcaaccugagaguaacauccuggacauagaucuacguccugcaucagcuuggacucuauaugccguggcaacaacuuucaucacaccaauguugaggcauagcauugaaaacuccucagugaaugugucccuaacagccauugccaaccaagccacaguguuaaugggucuugggaaaggauggccauugucaaaaauggacaucggaguuccccuucucgcuaucgggugcuauucacaagucaaccccauaacucucacugcagcccuucucuuauugguagcccauuaugccaucauagggccaggacuccaagcgaaagcaacuagagaggcucagaaaagagcagcagcggguaucaugaaaaacccaacuguggauggaaugacagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcaaccgggcccaucucuacacugugggagggaaauccaggaagauuuuggaauacaacuauugcagugucaauggcuaacauuuuuagagggaguuaccuggccggagccggacuucucuuuucuaucaugaaaaacacggccaacacaagaaggggaacuggcaacacaggagagacgcuuggggagaaauggaaaaaccgguugaaugcauuagggaagagugaauuccagaucuacaagaaaaguggaauccaggaaguggacagaaccuuagcaaaagaaggcaucaaaagaggagaaacggaccaucacgcugugucgcgaggcucagcgaaacugagaugguucgucgagagaaaccuggucacaccagaagggaaaguaguggaccuuggcugcggcagggggggcuggucauacuauugugggggacuaaagaauguaaaagaagucaaaggccuaacaaaaggaggaccaggacacgaagaacccauucccaugucaacauaugguuggaaucuggugcgccuucaaaguggaguugauguuuuuuuuacuccgccagaaaagugugacacacugcugugugacauaggggagucgucaccaaaccccacgguugaggcaggacgaacacucagaguucuaaacuuaguggaaaauuggcugaacaacaacacccaauuuugcauaaagguucuuaacccauacaugcccucaguuauagaaaaaauggaagcacuacaaaggaaauacggaggagcuuuggugaggaauccacucucacgaaauuccacacacgagauguacuggguauccaaugcuuccgggaauauagugucaucagugaacaugauuucaagaauguugauuaacagauucacaaugagacacaagaaagccacauacgagccagauguugaccucggaaguggaacccgcaacaucggaauugaaagugagacaccaaauuuagacauaauugggaaaagaauagaaaaaauaaaacaagagcaugaaacaucauggcacuaugaccaagaccacccauacaaaacaugggccuaccauggcagcuacgaaacaaaacagacuggaucagcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccgaaagaaggcacgaaaaaacuaaugaaaauuacugcagaauggcucuggaaagaacuaggaaagaaaaagacaccuaggaugugcaccagagaagaauucacaagaaaggugagaagcaaugcagcuuuaggugccauauucacugaugagaacaaguggaagucggcacgugaggcuguugaagacaguggauuuugggaauugguugacaaggaaaggaaucuccaucuugagggaaagugugaaacguguguguauaacaugaugggaaagagagagaagaagcuaggggaguucggcaaagcaaaaggcagcagagccauaugguacauguggcuuggagcacgcuucuuagaguuugaagcucuaggauucuugaacgaagaucacugguuuuccagagagaacucccugaguggaguggaaggagaagggcuacacaagcuaggcuacauuuuaagagacgugaguaagaaagaaggaggagcaauguaugcugaugacacugcaggaugggacacaagaaucacacuagaggacuuaaaaaaugaagaaauggugacaaaccacauggaaggagaacacaagaaacuugcugaagccauuuucaaauuaacguaccaaaacaagguggugcgugugcaaagaccaacaccaagaggcacaguaauggacauuauaucgagaagagaccaaagagguaguggacaaguugucaccuacggccucaauacuuucaccaauauggaagcccaacugaucagacagauggagggagaaggaguuuucaaaagcauccagcaacugacaguaaaagaagaaauugcagugaaaaacugguuaauaagaguggggcgugagagguuaucaagaauggccaucaguggagaugauuguguugugaaacccuuagaugacagguuugcaagugcucuaacagcucuaaaugacaugggaaagguuaggaaagacauacaacaaugggaaccuucaagaggauggaacgauuggacacaagugcccuuuuguucacaccauuuccaugaguuaaucaugaaggacggucgugugcucguaguuccaugcagaaaccaagaugaacugauuggcagggcccgaauuucccagggagccgggugguccuugcgggaaacagccugucuggggaaguccuacgcccaaauguggagccugauguacuuccacagacgugaccuuaggcuggcggcaaauuccauuugcucggcagucccaucacauuggauuccaacaagucgaacaaccugguccauacacgccacacaugaguggaugacaacagaagacauguugacagucuggaacaggguguggauucaagaaaacccauggauggaagacaaaacuccaguagaaucaugggaggaaaucccguauuuggggaaaagagaagaccaauggugcggcucauugauugggcuaacaagcagggccaccugggcaaagaacauccaaacagcaauaaaucaaguuagaucccuaauaggcaaugaggaauacacagacuacaugccaucuaugaaaagauucagaagagaagaggaagaggcaggagucuugugguag

SEQ ID NO: 6452 - RNA, 9876 nt, Artificial Sequence
  derived and/or modified CDS sequence (wt) from DENV-2__KM279591__SS-prME
acugcagguauaauuauuaugaugaucccaacagugauggcguuccauuuaaccacacgcaacggagaaccacacaugauuguuaguagacaagagaaagggaaaagucuccuguuuaaaacagagaacggugugaacauguguacccucauggccauggaccuuggugaacugugugaagacacaaucacuuauaauuguccucuucucaggcagaaugaaccagaagacauagacuguuggugcaacuccacgucuacauggguaacuuaugggacaugcaccgccacaggagaacacagaagggaaaaaagaucaguggcacucguuccacaugugggaaugggacuggagacacgaacugaaacauggaugucaucagaaggggccuggaaacaugcccagagaauugaaacuuggaucuugagacauccgggcuucaccauaauggcagcaauccuggcauacaccauaggaacaacauauuuccaaagaguccugauuuucauuuuacugacagcugucacuccuucaauggcaaugcguugcauaggaauaucaaauagagacuuuguggaagggguuucaggaggaagcuggguugauauagucuuggaacauggaagcugugugacgacgauggcgaaaaauaaaccaacguuggauuuugaauugauaaaaacagaagccaaacaucucgccacucuaaggaaguauuguguagaggcaaagcugaccaacacaacaacagcaucucgcugcccaacacaaggagaaccuagccuaaacgaagaacaggacaaaagauucgucugcaaacacuccaugguagacagaggauggggaaauggaugcggauuauuuggaaagggaggcaucgugaccugugcaauguucacaugcaaaaagaacauggaaggaaaagucgugcaaccagaaaacuuggaguacaccaucgugauaacaccucacucaggggaagagaaugcagucggaaaugacacaggaaaacauggcaaggaaauuaaaguaacaccacagaguuccaucacagaagcagaacuaacaggcuacggcacugucacgauggaaugcucuccgagaacgggccucgacuucaaugagaugguguugcugcaaauggaaaacaaggcuuggcuggugcacaggcaaugguucuuagaccugccguuaccauggcugcccggagcagacacacaaggaucaaauuggauacagaaggagacacuggucacuuucaaaaauccccaugcaaagaaacaggauguuguuguuuuagguucccaagaaggggccaugcacacggcacucacaggggccacggaaauccagaugucaucaggaaacuuacuguucacgggacaucuuaagugcaggcugagaauggacaaacuacagcucaaaggaaugucauauuccauguguacaggaaaguucaaaguugugaaggaaauagcagaaacacaacauggaacaauaguuauuagaguacaauaugaaggggacgguuccccgugcaagaucccuuuugaaauaauggacuuggaaaaaaggcaugucuuaggucgcuugauuaccgucaacccaauugucacagaaaaagacagcccagucaacauagaagcagaaccuccauuuggagacaguuacaucauuauaggaguagaaccaggacaacugaagcucagcugguuuaagaaaggaaguucuauuggccaaauguuugagacaacaaugagaggagcgaagagaauggccauucuaggugacacagcuugggauuuuggaucccugggaggaguguucacaucuauaggaaaggcccuccaccaagucuuuggagcuaucuauggggcugccuucagugggguuucauggacuaugaaaauccucauaggagucgucaucacauggauaggaaugaauucacgcagcaccucacugucugugucacuaguauuagugggggucgugacauuguauuugggaguuauggugcaggccgauagugggugcguugucaguuggaaaaacaaagaacugaaaugugguagugggauuuuuaucacagacaacgugcacacauggacagaacaauacaaauuccaaccagaauccccuucaaagcuggcuucagcuauccagaaggcucaugaagaaggcauuuguggaauccgcucaguaacaagacuggagaaucugauguggaaacaaauaacaccagaauugaaucacauucuaacagaaaaugaaguaaaguugacuaucaugacaggagacaucaaaggaaucaugcaggcaggaaaacgaacccugcggccucaacccacugagcugaaguacuccuggaaggcauggggcaaagcgaaaaugcuuuccacagagcuucauaaccacaccuuucucauugauggccccgaaacagcagaaugucccaacacaaacagagcuuggaacucacuagaaguugaagacuauggcuuuggaguauucaccacuaacauauggcugaaauugaaagaaaggcaggauguguuuugugacucaaaacucaugucagcagccauaaaggacaauagagccguccacgccgauauggguuauuggauagaaagcgcacucaaugacacauggaagauugagaaagccucuuuuauugaaguuaaaagcugccacuggccaaagucacacacucucuggaguaauggagugcuggaaagugagaugauaauuccaaagaauuuugcaggaccaguuucacaacacaauuacagaccaggcuaccacacacaaacggcaggacccuggcaucuagguaggcuugagauggacuuugauuucugcgaaggaaccacagugguggugacugaggacuguggaaauagaggacccuccuuaagaacaacuacugcuucuggaaaacucauaacagaguggugcugccgaucuugcacauuaccaccgcuaagguacagaggugaggauggaugcugguaugguauggaaaucaggccauugaaagagaaagaagagaaccuggucaacucuuuggucacagccggacauggacagauugacaacuucucacuaggagucuugggaauggcauuguuccuggaagagaugcucaggacucgaguaggaacgaaacaugcaauauuacuaguugcagucucuuucgugacauugaucacagggaacauguccuuucgagauuuggggagagugauggucauggugggcgcuacuaugacggaugacauaggcaugggcgugacuuaucuugcccuauuagcagccuuuaaagucagaccaaccuuugcggcuggacuacucuuaagaaagcugaccuccaaggaauugaugaugaccaccauaggaaucguacuccucucucagaguaccauaccagagagcauacuugaacugacugacgcguuggcuuuggggaugaugguucucaaaauagugagaaacauggaaaaguaucagcuagcagugacuaucauggcaaucuugugcgucccaaaugcagugauauugcaaaaugcauggaaagugagcugcacaacacuggcagugguguccguuuccccacugcuuuuaacauccucacagcagaaagcggauuggauaccacuggcguugacgaucaaaggccucaauccaacagccauuuucuuaacaacucucucaagaacuagcaagaaaaggagcuggccacuaaaugaggcuauuauggcagucgggauggugagcauucuagcuaguucucucuuaaagaaugauauucccaugacaggaccauuaguggcuggagggcuucucacuguguguuacgugcucacuggaaggucggcugacuuggaacuggaaagagcugcugacguaagaugggaagaacaggcagagauaucaggaaguaguccaauucugucgauaacaauaucggaagaugguagcaugucgauaaagaaugaagaagaagaacagacacugaccauacucaucagaacaggacuacuggugauaucaggacuuuuuccugugucaauaccaaucacggcagcugcaugguaccuuugggaagugaaaaaacaacgagcaggaguauugugggaugucccuucacccccaccugugggaaaggccgaacuggaagauggagccuauagaaucaagcagaaagggauccuaggauacucacagauuggagccggaguuuacaaagaaggaacauuccacacaauguggcaugucacacguggugcuguccuaaugcauaaagggaagagaauugaaccaucaugggcggacgucaagaaagaccuaauaucguauggaggaggcuggaagcuggaaggagaauggaaggaaggagaagaaguccagguccuggcauuagagccuggaaagaauccaagagccguccaaacaaaacccggucuuuuuaaaaccaacacuggaaccauaggcgccgugucucuggacuuuucuccuggaacgucaggaucuccaaucgucgauaaaaaaggaaaaguugugggccuuuauggcaacggugucgucacaaggaguggaacauaugugagugccauagcccagacugaaaaaagcaucgaagacaauccagagauugaagaugacaucuuuagaaagaaaagauugaccaucauggaccuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagcuaucagagcugagcacacugggcgggagauuguggaucuaaugugucaugccacauuuaccaugaggcuauuaucaccaauuagagugccaaauuacaaccugaucaucauggaugaagcccauuucacagacccagcaagcauagcagcuagaggauacauuucaacucgaguagagaugggugaagcagcugggauuuucaugacagccaccccuccuggaagcagagacccauuuccccagagcaacgcaccaaucauggaugaagaaagagaaaucccugagcguucguggaacucuggacaugaguggguuacggauuuuaaagggaagacuguuugguuugucccaaguauaaaagcagggaaugauauagcagcuugccugagaaagaauggaaagaaagugauacaacucagcaggaaaacuuuugauucugaauauaucaagacuaggaccaaugauugggacuuuguggucacgacagacauuucagaaaugggugcuaacuucaaggcugagaggguuauagaccccagacgcugcaugaaaccagucauauuaacagacggugaagagcgggugaucuuggcaggacccaugccagugacccauucuagugcagcacaaagaagagggagaguaggaagaaauccaaaaaaugaaaaugaccaguacauauacaugggggaaccucuggaaaaugaugaagacugugcacacuggaaagaagcuaagaugcucuuggauaacaucaacacgccugaaggaaucauucccagcauguucgaaccagagcgugaaaagguggaugccauugauggugaauaccgcuugagaggagaagcgaggaaaacuuuuguggaccuaaugagaagaggagauuuaccagucuggcuagccuacagaguggcggcugaaggcaucaacuacguagacagaagauggugcuuugauggagucaagaacaaccaaaucuuggaagaaaauguggaaguagaaauuuggacaaaagaaggagaaaggaagaaauuaaaacccagaugguuggaugcuaggaucuacucugacccauuggcgcucaaagaauucaaggaauucgcagcuggaagaaagucccugacccugaaucuaaucacagagauggguagacucccaaccuucaugacccagaaagcaaagaaugcacucgacaacuuagcaguccugcauacggcugaagcaggcggaagggcguacaaucaugcucuuagugaacugccggagacucuggagacauugcuuuuacugacacuuuuggccacagucacgggcggaaucuuccuguucuugaugagcggaaaggguauagggaagaugacccugggaaugugcugcauaaucacggcuaguauccucuuaugguaugcacaaauacagccacacuggauagcagcuucaauaauacuggaguuuuuucucauagucuugcucauuccagaaccagaaaaacagagaacaccccaagauaaccaguuaacuuauguugucauagccauccuuacaguaguggccgcaaccauggcaaacgagauggguuuccuggaaaaaacaaagaaagauuucggauugggaagcauuacaacccagcaaccugagaguaacauccuggacauagaucuacguccugcaucagcuuggacucuauaugccguggcaacaacuuucaucacaccaauguugaggcauagcauugaaaacuccucagugaaugugucccuaacagccauugccaaccaagccacaguguuaaugggucuugggaaaggauggccauugucaaaaauggacaucggaguuccccuucucgcuaucgggugcuauucacaagucaaccccauaacucucacugcagcccuucucuuauugguagcccauuaugccaucauagggccaggacuccaagcgaaagcaacuagagaggcucagaaaagagcagcagcggguaucaugaaaaacccaacuguggauggaaugacagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcaaccgggcccaucucuacacugugggagggaaauccagggagauuuuggaauacaacuauugcagugucaauggcuaacauuuuuagagggaguuaccuggccggagccggacuucucuuuucuaucaugaaaaacacggccaacacaagaaggggaacuggcaacacaggagagacgcuuggggagaaauggaaaaaccgguugaaugcauuagggaagagugaauuccagaucuacaagaaaaguggaauccaggaaguggacagaaccuuagcaaaagaaggcaucaaaagaggagaaacggaccaucacgcugugucgcgaggcucagcgaaacugagaugguucgucgagagaaaccuggucacaccagaagggaaaguaguggaccuuggcugcggcagggggggcuggucauacuauugugggggacuaaagaauguaaaagaagucaaaggccuaacaaaaggaggaccaggacacgaagaacccauucccaugucaacauaugguuggaaucuggugcgccuucaaaguggaguugauguuuuuuuuacuccgccagaaaagugugacacacugcugugugacauaggggagucgucaccaaaccccacgguugaggcaggacgaacacucagaguucuaaacuuaguggaaaauuggcugaacaacaacacccaauuuugcauaaagguucuuaacccauacaugcccucaguuauagaaaaaauggaagcacuacaaaggaaauacggaggagcuuuggugaggaauccacucucacgaaauuccacacacgagauguacuggguauccaaugcuuccgggaauauagugucaucagugaacaugauuucaagaauguugauuaacagauucacaaugagacacaagaaagccacauacgagccagauguugaccucggaaguggaacccgcaacaucggaauugaaagugagacaccaaauuuagacauaauugggaaaagaauagaaaaaauaaaacaagagcaugaaacaucauggcacuaugaccaagaccacccauacaaaacaugggccuaccauggcagcuacgaaacaaaacagacuggaucagcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccgaaagaaggcacgaaaaaacuaaugaaaauuacugcagaauggcucuggaaagaacuaggaaagaaaaagacaccuaggaugugcaccagagaagaauucacaagaaaggugagaagcaaugcagcuuuaggugccauauucacugaugagaacaaguggaagucggcacgugaggcuguugaagacaguggauuuugggaauugguugacaaggaaaggaaucuccaucuugagggaaagugugaaacauguguguauaacaugaugggaaagagagagaagaagcuaggggaguucggcaaagcaaaaggcagcagagccauaugguacauguggcuuggagcacgcuucuuagaguuugaagcucuaggauucuugaacgaagaucacugguuuuccagagagaacucccugaguggaguggaaggagaagggcuacacaagcuaggcuacauuuuaagagacgugaguaagaaagaaggaggagcaauguaugcugaugacacugcaggaugggacacaagaaucacacuagaggacuuaaaaaaugaagaaauggugacaaaccacauggaaggagaacacaagaaacuugcugaagccauuuucaaauuaacguaccaaaacaagguggugcgugugcaaagaccaacaccaagaggcacaguaauggacauuauaucgagaagagaccaaagagguaguggacaaguugucaccuacggccucaauacuuucaccaauauggaagcccaacugaucagacagauggagggagaaggaguuuucaaaagcauccagcaacugacaguaaaagaagaaauugcagugaaaaacugguuaauaagaguggggcgugagagguuaucaagaauggccaucaguggagaugauuguguugugaaacccuuagaugacagguuugcaagugcucuaacagcucuaaaugacaugggaaagguuaggaaagacauacaacaaugggaaccuucaagaggauggaacgauuggacacaagugcccuuuuguucacaccauuuccaugaguuaaucaugaaggacggucgugugcucguaguuccaugcagaaaccaagaugaacugauuggcagggcccgaauuucccagggagccgggugguccuugcgggaaacagccugucuggggaaguccuacgcccaaauguggagccugauguacuuccacagacgugaccuuaggcuggcggcaaaugccauuugcucggcagucccaucacauuggauuccaacaagucgaacaaccugguccauacacgccacacaugaguggaugacaacagaagacauguugacagucuggaacaggguguggauucaagaaaacccauggauggaagacaaaacuccaguagaaucaugggaggaaaucccguauuuggggaaaagagaagaccaauggugcggcucauugauugggcuaacaagcagggccaccugggcaaagaacauccaaacagcaauaaaucaaguuagaucccuaauaggcaaugaggaauacacagacuacaugccaucuaugaaaagauucagaagagaagaggaagaggcaggagucuugugguag

SEQ ID NO: 6453 - RNA, 9876 nt, Artificial Sequence
  derived and/or modified CDS sequence (wt) from DENV-2__KM279558__SS-prME
acugcagguauaauuauuaugaugaucccaacagugauggcguuccauuuaaccacacgcaacggagaaccacacaugauuguuaguagacaagagaaagggaaaagucuccuguuuaaaacagagaacggugugaacauguguacccucauggccauggaccuuggugaacugugugaagacacaaucacuuauaauuguccucuucucaggcagaaugaaccagaagacauagacuguuggugcaacuccacgucuacauggguaacuuaugggacaugcaccgccacaggagaacacagaagggaaaaaagaucaguggcacucguuccacaugugggaaugggacuggagacacgaacugaaacauggaugucaucagaaggggccuggaaacaugcccagagaauugaaacuuggaucuugagacauccaggcuucaccauaauggcagcaauccuggcauacaccauaggaacaacauauuuccaaagaguccugauuuucauuuuacugacagcugucacuccuucaauggcaaugcguugcauaggaauaucaaauagagacuuuguggaagggguuucaggaggaagcuggguugauauagucuuggaacauggaagcugugugacgacgauggcgaaaaauaaaccaacguuggauuuugaacugauaaaaacagaagccaaacaucucgccacucuaaggaaguauuguguagaggcaaagcugaccaacacaacaacagcaucucgcugcccaacacaaggagaaccuagccuaaacgaagaacaggacaaaagauucgucugcaaacacuccaugguagacagaggauggggaaauggaugcggauuauuuggaaagggaggcaucgugaccugugcaauguucacaugcaaaaagaacauggaaggaaaagucgugcaaccagaaaacuuggaguacaccaucgugauaacaccucacucaggggaagagaaugcagucggaaaugacacaggaaaacauggcaaggaaauuaaaauaacaccacagaguuccaucacagaagcagaacuaacaggcuacggcacugucacgauggaaugcucuccgagaacgggccucgacuucaaugagaugguguugcugcaaauggaaaacaaggcuuggcuggugcacaggcaaugguucuuagaccugccguuaccauggcugcccggagcagacacacaaggaucaaauuggauacagaaggagacacuggucacuuucaaaaauccccaugcaaagaaacaggauguuguuguuuuagguucccaagaaggggccaugcacacggcacucacaggggccacggaaauccagaugucaucaggaaacuuacuguucacaggacaucuuaagugcaggcugagaauggacaaacuacagcucaaaggaaugucauauuccauguguacaggaaaguucaaaguugugaaggaaauagcagaaacacaacauggaacaauaguuauuagaguacaauaugaaggggacgguuccccgugcaagaucccuuuugaaauaauggacuuggaaaaaaggcaugucuuaggucgcuugauuaccgucaacccaauugucacagaaaaagacagcccagucaacauagaagcagaaccuccauuuggagacaguuacaucauuauaggaguagaaccaggacaacugaagcucagcugguuuaagaaaggaaguucuauuggccaaauguuugagacaacaaugagaggagcgaagagaauggccauucuaggugacacagcuugggauuuuggaucccugggaggaguguucacaucuauaggaaaggcccuccaccaagucuuuggagcuaucuauggggcugccuucagugggguuucauggacuaugaaaauccucauaggagucgucaucacauggauaggaaugaauucacgcagcaccucacugucugugucacuaguauuagugggggucgugacauuguauuugggaguuauggugcaggccgauagugggugcguugucaguuggaaaaacaaagaacugaaaugugguagugggauuuuuaucacagacaacgugcacacauggacagaacaauacaaauuccaaccagaauccccuucaaagcuggcuucagcuauccagaaggcucaugaagaaggcauuuguggaauccgcucaguaacaagacuggagaaucugauguggaaacaaauaacaccagaauugaaucacauucuaacagaaaaugaaguaaaguugacuaucaugacaggagacaucaaaggaaucaugcaggcaggaaaacgaucccugcggccucaacccacugagcugaaguacuccuggaaggcauggggcaaagcgaaaaugcuuuccacagagcuucauaaccacaccuuucucauugauggccccgaaacagcagaaugucccaacacaaacagagcuuggaacucacuagaaguugaagacuauggcuuuggaguauucaccacuaacauauggcugaaauugaaagaaaggcaggauguguuuugugacucaaaacucaugucggcagccauaaaggacaauagagccguccacgccgauauggguuauuggauagaaagcgcacucaaugacacauggaagauugagaaagccucuuuuauugaaguuaaaagcugccacuggccaaagucacacacucucuggaguaauggagugcuggaaagugagaugauaauuccaaagaauuuugcaggaccaguuucacaacacaauuacagaccaggcuaccacacacaaacggcaggacccuggcaucuagguaggcuugagauggacuuugauuucugcgaaggaaccacagugguggugacugaggacuguggaaauagaggacccuccuuaagaacaacuacugcuucuggaaaacucauaacagaguggugcugccgaucuugcacauuaccaccgcuaagguacagaggugaggauggaugcugguaugguauggaaaucaggccauugaaagagaaagaagagaaccuggucaacucuuuggucacagccggacauggacagauugacaacuucucacuaggagucuugggaauggcauuguuccuggaagaaaugcucaggacucgaguaggaacgaaacaugcaauauuacuaguugcagucucuuucgugacauugaucacagggaacauguccuuucgagauuuggggagagugauggucauggugggcgcuacuaugacggaugacauaggcaugggcgugacuuaucuugcccuauuagcagccuuuaaagucagaccaaccuuugcggcuggacuacucuuaagaaagcugaccuccaaggaauugaugaugaccaccauaggaaucguacuccucucucagaguaccauaccagagagcauacuugaacugacugacgcguuggcuuuggggaugaugguucucaaaauagugagaaacauggaaaaguaucagcuagcagugacuaucauggcaaucucgugcguuccaaaugcagugauauugcaaaaugcauggaaagugagcugcacaacacuggcagugguguccguuuccccacugcuuuuaacauccucacagcagaaagcggauuggauaccacuggcguugacgaucaaaggccucaauccaacagccauuuucuuaacaacucucucaagaacuagcaagaaaaggagcuggccacuaaaugaggcuauuauggcagucgggauggugagcauucuagcuaguucucucuuaaagaaugauauucccaugacaggaccauuaguggcuggagggcuucucacuguguguuacgugcucacuggaaggucggcugacuuggaacuggaaagagcugcugacguaagaugggaagaacaggcagagauaucaggaaguaguccaauucugucgauaacaauaucggaagaugguagcaugucgauaaagaaugaagaagaagaacagacacugaccauacucaucagaacaggacuacuggugauaucaggacuuuuuccugugucaauaccaaucacggcagcugcaugguaccuuugggaagugaaaaaacaacgagcaggaguauugugggaugucccuucacccccaccugugggaaaggccgaacuggaagauggagccuauagaaucaagcagaaagggauccuaggauacucacagauuggagccggaguuuacaaagaaggaacauuccacacaauguggcaugucacacguggugcuguccuaaugcauaaagggaagagaauugaaccaucaugggcggacgucaagaaagaccuaauaucguauggaggaggcuggaagcuggaaggagaauggaaggaaggagaagaaguccagguccuggcauuagagccuggaaagaauccaagagccguccaaacaaaacccggucuuuuuaaaaccaacacuggaaccauaggcgccgugucucuggacuuuucuccuggaacgucaggaucuccaaucgucgauaaaaaaggaaaaguugugggccuuuauggcaacggugucgucacaaggaguggaacauaugugagugccauagcccagacugaaaaaagcaucgaagacaauccagagauugaagaugacaucuuuagaaagaaaagauugaccaucauggaccuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagcuaucagagcugagcacacugggcgggagauuguggaucuaaugugucaugccacauuuaccaugaggcuauuaucaccaauuagagugccaaauuacaaccugaucaucauggaugaagcccauuucacagacccagcaagcauagcagcuagaggauacauuucaacucgaguagagaugggugaagcagcugggauuuucaugacagccaccccuccuggaagcagagacccauuuccccagagcaacgcaccaaucauggaugaagaaagagaaaucccugagcguucguggaacucuggacaugaguggguuacggauuuuaaagggaagacuguuugguuuguuccaaguauaaaagcagggaaugauauagcagcuugccugagaaagaauggaaagaaagugauacaacucagcaggaaaacuuuugauucugaauauaucaagacuaggaccaaugauugggacuuuguggucacgacagacauuucagaaaugggugcuaacuucaaggcugagaggguuauagaccccagacgcugcaugaaaccagucauauuaacagacggugaagagcgggugaucuuggcaggacccaugccagugacccauucuagugcagcacaaagaagagggagaguaggaagaaauccaaaaaaugaaaaugaccaguacauauacaugggggaaccucuggaaaaugaugaagacugugcacacuggaaagaagcuaagaugcucuuggauaacaucaacacgccugaaggaaucauucccagcauguucgaaccagagcgugaaaagguggaugccauugauggugaauaccgcuugagaggagaagcgaggaaaacuuuuguggaccuaaugagaagaggagauuuaccagucuggcuagccuacagaguggcggcugaaggcaucaacuacgcagacagaagauggugcuuugauggagucaagaacaaccaaaucuuggaagaaaauguggaaguagaaauuuggacaaaagaaggagaaaggaagaaauuaaaacccagaugguuggaugcuaggaucuacucugacccauuggcgcucaaagaauucaaggaauucgcagcuggaagaaagucccugacccugaaucuaaucacagagauggguagacucccaaccuucaugacccagaaagcaaagaaugcacucgacaacuuagcaguccugcauacggcugaagcaggcggaagggcguacaaucaugcucuuagugaacugccggagacucuggagacauugcuuuuacugacacuuuuggccacagucacgggcggaaucuuccuguucuugaugagcggaaaggguauagggaagaugacccugggaaugugcugcauaaucacggcuaguauccucuuaugguaugcacaaauacagccacacuggauagcagcuucaauaauacuggaguuuuuucucauagucuugcucauuccagaaccagaaaaacagagaacaccccaagauaaccaguuaacuuauguugucauagccauccuuacaguaguggccgcaaccauggcaaacgagauggguuuccuggaaaaaacaaagaaagauuucggauugggaagcauuacaacccagcaaccugagaguaacauccuggacauagaucuacguccugcaucagcuuggacucuauaugccguggcaacaacuuucaucacaccaauguugaggcauagcauugaaaacuccucagugaaugugucccuaacagccauugccaaccaagccacaguguuaaugggucuugggaaaggauggccauugucaaaaauggacaucggaguuccccuucucgcuaucgggugcuauucacaagucaaccccauaacucucacugcagcccuucucuuauugguagcccauuaugccaucauagggccaggacuccaagcgaaagcaacuagagaggcucagaaaagagcagcagcgggcaucaugaaaaacccaacuguggauggaaugacagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcaaccgggcccaucucuacacugugggaaggaaauccagggagauuuuggaauacaacuauugcagugucaauggcuaacauuuuuagagggaguuaccuggccggagccggacuucucuuuucuaucaugaaaaacacggccaacacaagaaggggaacuggcaacacaggagagacgcuuggggagaaauggaaaaaccgguugaaugcauuagggaagagugaauuccagaucuacaagaaaaguggaauccaggaaguggacagaaccuuagcaaaagaaggcaucaaaagaggagaaacggaccaucacgcugugucgcgaggcucagcgaaacugagaugguucgucgagagaaaccuggucacaccagaagggaaaguaguggaccuuggcugcggcagggggggcuggucauacuauugugggggacuaaagaauguaaaagaagucaaaggccuaacaaaaggaggaccaggacacgaagaacccauucccaugucaacauaugguuggaaucuggugcgccuucaaaguggaguugauguuuuuuucacuccgccagaaaagugugacacacugcugugugacauaggggagucgucaccaaaccccacgguugaggcaggacgaacacucagaguucuaaacuuaguggaaaauuggcugaacaacaacacccaauuuugcauaaagguucuuaacccauacaugcccucaguuauagaaaaaauggaagcacuacaaaggaaauacggaggagcuuuggugaggaauccacucucacgaaauuccacacacgagauguacuggguauccaaugcuuccgggaauauagugucaucagugaacaugauuucaagaauguugauuaacagauucacaaugagacacaagaaagccacauacgagccagauguugaccucggaaguggaacccgcaacaucggaauugaaagugagacaccaaauuuagacauaauugggaaaagaauagaaaaaauaaaacaagagcaugaaacaucauggcacuaugaccaagaccacccauacaaaacgugggccuaccauggcagcuacgaaacaaaacagacuggaucagcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccgaaagaaggcacgaaaaaacuaaugaaaauuacugcagaauggcucuggaaagaacuaggaaagaaaaagacaccuaggaugugcaccagagaagaauucacaagaaaggugagaagcaaugcagcuuuaggugccauauucacugaugagaacaaguggaagucggcacgugaggcuguugaagacaguggauuuugggaauugguugacaaggaaaggaaucuccaucuugaaggaaagugugaaacauguguguauaacaugaugggaaagagagagaagaagcuaggggaguucggcaaagcaaaaggcagcagagccauaugguacauguggcuuggagcacgcuucuuagaguuugaagcucuaggauucuugaacgaagaucacugguuuuccagagagaacucccugaguggaguggaaggagaagggcuacacaagcuaggcuacauuuuaagagacgugaguaagaaagaaggaggagcaauguaugcugaugacaccgcaggaugggacacaagaaucacacuagaggacuuaaaaaaugaagaaauggugacaaaccacauggaaggagaacacaagaaacuugcugaagccauuuucaaauuaacguaccaaaacaagguggugcgugugcaaagaccaacaccaagaggcacaguaauggacauuauaucgagaagagaccaaagagguaguggacaaguugucaccuacggccucaauacuuucaccaauauggaagcccaacugaucagacagauggagggagaaggaguuuucaaaagcauccagcaacugacaguaaaagaagaaauugcagugaaaaacugguuaauaagaguggggcgugagagguuaucaagaauggccaucaguggagaugauuguguugugaaacccuuagaugacagguuugcaagugcucuaacagcucuaaaugacaugggaaagguuaggaaagacauacaacaaugggaaccuucaagaggauggaacgauuggacacaagugcccuuuuguucacaccauuuccaugaguuaaucaugaaggacggucgugugcucguaguuccaugcagaaaccaagaugaacugauuggcagggcccgaauuucccagggagccgggugguccuugcgggaaacagccugucuggggaaguccuacgcccaaauguggagccugauguacuuccacagacgugaccuuaggcuggcggcaaaugccauuugcucggcagucccaucacauuggauuccaacaagucgaacaaccugguccauacacgccacacaugaguggaugacaacagaagacauguugacagucuggaacaggguguggauucaagaaaacccauggauggaagacaaaacuccaguagaaucaugggaggaaaucccguauuuggggaaaagagaagaccaauggugcggcucauugauugggcuaacaagcagggccaccugggcaaagaacauucaaacagcaauaaaucaaguuagaucccuaauaggcaaugaggaauacacagacuacaugccaucuaugaaaagauucagaagagaagaggaagaggcaggagucuugugguag

SEQ ID NO: 6454 - RNA, 9876 nt, Artificial Sequence
  derived and/or modified CDS sequence (wt) from DENV-2__KM279564__SS-prME
acugcagguauaauuauuaugaugaucccaacagugauggcguuccauuuaaccacacgcaacggagaaccacacaugauuguuaguagacaagagaaagggaaaagucuccuguuuaaaacagagaacggugugaacauguguacccucauggccauggaccuuggugaacugugugaagacacaaucacuuauaauuguccucuucucaggcagaaugaaccagaagacauagacuguuggugcaacuccacgucuacauggguaacuuaugggacaugcaccgccacaggagaacacagaagggaaaaaagaucaguggcacucguuccacaugugggaaugggacuggagacacgaacugaaacauggaugucaucagaaggggccuggaaacaugcccagagaauugaaacuuggaucuugagacauccaggcuucaccauaauggcagcaauccuggcauacaccauaggaacaacauauuuccaaagaguccugauuuucauuuuacugacagcugucacuccuucaauggcaaugcguugcauaggaauaucaaauagagacuuuguggaagggguuucaggaggaagcuggguugauauagucuuggaacauggaagcugugugacgacgauggcgaaaaauaaaccaacguuggauuuugaacugauaaaaacagaagccaaacaucucgccacucuaaggaaguauuguguagaggcaaagcugaccaacacaacaacagcaucucgcugcccaacacaaggagaaccuagccuaaacgaagaacaggacaaaagauucgucugcaaacacuccaugguagacagaggauggggaaaugguugcggauuauuuggaaagggaggcaucgugaccugugcaauguucacaugcaaaaagaacauggaaggaaaagucgugcaaccagaaaacuuggaguacaccaucgugauaacaccucacucaggggaagagaaugcagucggaaaugacacaggaaaacauggcaaggaaauuaaaauaacaccacagaguuccaucacagaagcagaacuaacaggcuacggcacugucacgauggaaugcucuccgagaacgggccucgacuucaaugagaugguguugcugcaaauggaaaacaaggcuuggcuggugcacaggcaaugguucuuagaccugccguuaccauggcugcccggagcagacacacaaggaucaaauuggauacagaaggagacacuggucacuuucaaaaauccccaugcaaagaaacaggauguuguuguuuuagguucccaagaaggggccaugcacacggcacucacaggggccacggaaauccagaugucaucaggaaacuuacuguucacaggacaucuuaagugcaggcugagaauggacaaacuacagcucaaaggaaugucauauuccauguguacaggaaaguucaaaguugugaaggaaauagcagaaacacaacauggaacaauaguuauuagaguacaauaugaaggggacgguuccccgugcaagaucccuuuugaaauaauggacuuggaaaaaaggcaugucuuaggucgcuugauuaccgucaacccaauugucacagaaaaagacagcccagucaacauagaagcagaaccuccauuuggagacaguuacaucauuauaggaguagaaccaggacaacugaagcucagcugguuuaagaaaggaaguucuauuggccaaauguuugagacaacaaugagaggagcgaagagaauggccauucuaggugacacagcuugggauuuuggaucccugggaggaguguucacaucuauaggaaaggcccuccaccaagucuuuggagcuaucuauggggcugccuucagugggguuucauggacuaugaaaauccucauaggagucgucaucacauggauaggaaugaauucacgcagcaccucacugucugugucacuaguauuagugggggucgugacauuguauuugggaguuauggugcaggccgauagugggugcguugucaguuggaaaaacaaagaacugaaaugugguagugggauuuuuaucacagacaacgugcacacauggacagaacaauacaaauuccaaccagaauccccuucaaagcuggcuucagcuauccagaaggcucaugaagaaggcauuuguggaauccgcucaguaacaagacuggagaaucugauguggaaacaaauaacaccagaauugaaucacauucuaacagaaaaugaaguaaaguugacuaucaugacaggagacaucaaaggaaucaugcaggcaggaaaacgaucccugcggccucaacccacugagcugaaguacuccuggaaggcauggggcaaagcgaaaaugcuuuccacagagcuucauaaccacaccuuucucauugauggccccgaaacagcagaaugucccaacacaaacagagcuuggaacucacuagaaguugaagacuauggcuuuggaguauucaccacuaacauauggcugaaauugaaagaaaggcaggauguguuuugugacucaaaacucaugucggcagccauaaaggacaauagagccguccacgccgauauggguuauuggauagaaagcgcacucaaugacacauggaagauugagaaagccucuuuuauugaaguuaaaagcugccacuggccaaagucacacacucucuggaguaauggagugcuggaaagugagaugauaauuccaaagaauuuugcaggaccaguuucacaacacaauuacagaccaggcuaccacacacaaacggcaggacccuggcaucuagguaggcuugagauggacuuugauuucugcgaaggaaccacagugguggugacugaggacuguggaaauagaggacccuccuuaagaacaacuacugcuucuggaaaacucauaacagaguggugcugccgaucuugcacauuaccaccgcuaagguacagaggugaggauggaugcugguaugguauggaaaucaggccauugaaagagaaagaagagaaccuggucaacucuuuggucacagccggacauggacagauugacaacuucucacuaggagucuugggaauggcauuguuccuggaagaaaugcucaggacucgaguaggaacgaaacaugcaauauuacuaguugcagucucuuucgugacauugaucacagggaacauguccuuucgagauuuggggagagugauggucauggugggcgcuacuaugacggaugacauaggcaugggcgugacuuaucuugcccuauuagcagccuuuaaagucagaccaaccuuugcggcuggacuacucuuaagaaagcugaccuccaaggaauugaugaugaccaccauaggaaucguacuccucucucagaguaccauaccagagagcauacuugaacugacugacgcguuggcuuuggggaugaugguucucaaaauagugagaaacauggaaaaguaucagcuagcagugacuaucauggcaaucucgugcguuccaaaugcagugauauugcaaaaugcauggaaagugagcugcacaacacuggcagugguguccguuuccccacugcuuuuaacauccucacagcagaaagcggauuggauaccacuggcguugacgaucaaaggccucaauccaacagccauuuucuuaacaacucucucaagaacuagcaagaaaaggagcuggccacuaaaugaggcuauuauggcagucgggauggugagcauucuagcuaguucucucuuaaagaaugauauucccaugacaggaccauuaguggcuggagggcuucucacuguguguuacgugcucacuggaaggucggcugacuuggaacuggaaagagcugcugacguaagaugggaagaacaggcagagauaucaggaaguaguccaauucugucgauaacaauaucggaagaugguagcaugucgauaaagaaugaagaagaagaacagacacugaccauacucaucagaacaggacuacuggugauaucaggacuuuuuccugugucaauaccaaucacggcagcugcaugguaccuuugggaagugaaaaaacaacgagcaggaguauugugggaugucccuucacccccaccugugggaaaggccgaacuggaagauggagccuauagaaucaagcagaaagggauccuaggauacucacagauuggagccggaguuuacaaagaaggaacauuccacacaauguggcaugucacacguggugcuguccuaaugcauaaagggaagagaauugaaccaucaugggcggacgucaagaaagaccuaauaucguauggaggaggcuggaagcuggaaggagaauggaaggaaggagaagaaguccagguccuggcauuagagccuggaaagaauccaagagccguccaaacaaaacccggucuuuuuaaaaccaacacuggaaccauaggcgccgugucucuggacuuuucuccuggaacgucaggaucuccaaucgucgauaaaaaaggaaaaguugugggccuuuauggcaacggugucgucacaaggaguggaacauaugugagugccauagcccagacugaaaaaagcaucgaagacaauccagagauugaagaugacaucuuuagaaagaaaagauugaccaucauggaccuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagcuaucagagcugagcacacugggcgggagauuguggaucuaaugugucaugccacauuuaccaugaggcuauuaucaccaauuagagugccaaauuacaaccugaucaucauggaugaagcccauuucacagacccagcaagcauagcagcuagaggauacauuucaacucgaguagagaugggugaagcagcugggauuuucaugacagccaccccuccuggaagcagagacccauuuccccagagcaacgcaccaaucauggaugaagaaagagaaaucccugagcguucguggaacucuggacaugaguggguuacggauuuuaaagggaagacuguuugguuuguuccaaguauaaaagcagggaaugauauagcagcuugccugagaaagaauggaaagaaagugauacaacucagcaggaaaacuuuugauucugaauauaucaagacuaggaccaaugauugggacuuuguggucacgacagacauuucagaaaugggugcuaacuucaaggcugagaggguuauagaccccagacgcugcaugaaaccagucauauuaacagacggugaagagcgggugaucuuggcaggacccaugccagugacccauucuagugcagcacaaagaagagggagaguaggaagaaauccaaaaaaugaaaaugaccaguacauauacaugggggaaccucuggaaaaugaugaagacugugcacacuggaaagaagcuaagaugcucuuggauaacaucaacacgccugaaggaaucauucccagcauguucgaaccagagcgugaaaagguggaugccauugauggugaauaccgcuugagaggagaagcgaggaaaacuuuuguggaccuaaugagaagaggagauuuaccagucuggcuagccuacagaguggcggcugaaggcaucaacuacgcagacagaagauggugcuuugauggagucaagaacaaccaaaucuuggaagaaaauguggaaguagaaauuuggacaaaagaaggagaaaggaagaaauuaaaacccagaugguuggaugcuaggaucuacucugacccauuggcgcucaaagaauucaaggaauucgcagcuggaagaaagucccugacccugaaucuaaucacagagauggguagacucccaaccuucaugacccagaaagcaaagaaugcacucgacaacuuagcaguccugcauacggcugaagcaggcggaagggcguacaaucaugcucuuagugaacugccggagacucuggagacauugcuuuuacugacacuuuuggccacagucacgggcggaaucuuccuguucuugaugagcggaaaggguauagggaagaugacccugggaaugugcugcauaaucacggcuaguauccucuuaugguaugcacaaauacagccacacuggauagcagcuucaauaauacuggaguuuuuucucauagucuugcucauuccagaaccagaaaaacagagaacaccccaagauaaccaguuaacuuauguugucauagccauccuuacaguaguggccgcaaccauggcaaacgagauggguuuccuggaaaaaacaaagaaagauuucggauugggaagcauuacaacccagcaaccugagaguaacauccuggacauagaucuacguccugcaucagcuuggacucuauaugccguggcaacaacuuucaucacaccaauguugaggcauagcauugaaaacuccucagugaaugugucccuaacagccauugccaaccaagccacaguguuaaugggucuugggaaaggauggccauugucaaaaauggacaucggaguuccccuucucgcuaucgggugcuauucacaagucaaccccauaacucucacugcagcccuucucuuauugguagcccauuaugccaucauagggccaggacuccaagcgaaagcaacuagagaggcucagaaaagagcagcagcgggcaucaugaaaaacccaacuguggauggaaugacagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcaaccgggcccaucucuacacugugggaaggaaauccagggagauuuuggaauacaacuauugcagugucaauggcuaacauuuuuagagggaguuaccuggccggagccggacuucucuuuucuaucaugaaaaacacggccaacacaagaaggggaacuggcaacacaggagagacgcuuggggagaaauggaaaaaccgguugaaugcauuagggaagagugaauuccagaucuacaagaaaaguggaauccaggaaguggacagaaccuuagcaaaagaaggcaucaaaagaggagaaacggaccaucacgcugugucgcgaggcucagcgaaacugagaugguucgucgagagaaaccuggucacaccagaagggaaaguaguggaccuuggcugcggcagggggggcuggucauacuauugugggggacuaaagaauguaaaagaagucaaaggccuaacaaaaggaggaccaggacacgaagaacccauucccaugucaacauaugguuggaaucuggugcgccuucaaaguggaguugauguuuuuuucacuccgccagaaaagugugacacacugcugugugacauaggggagucgucaccaaaccccacgguugaggcaggacgaacacucagaguucuaaacuuaguggaaaauuggcugaacaacaacacccaauuuugcauaaagguucuuaacccauacaugcccucaguuauagaaaaaauggaagcacuacaaaggaaauacggaggagcuuuggugaggaauccacucucacgaaauuccacacacgagauguacuggguauccaaugcuuccgggaauauagugucaucagugaacaugauuucaagaauguugauuaacagauucacaaugagacacaagaaagccacauacgagccagauguugaccucggaaguggaacccgcaacaucggaauugaaagugagacaccaaauuuagacauaauugggaaaagaauagaaaaaauaaaacaagagcaugaaacaucauggcacuaugaccaagaccacccauacaaaacgugggccuaccauggcagcuacgaaacaaaacagacuggaucagcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccgaaagaaggcacgaaaaaacuaaugaaaauuacugcagaauggcucuggaaagaacuaggaaagaaaaagacaccuaggaugugcaccagagaagaauucacaagaaaggugagaaguaaugcagcuuuaggugccauauucacugaugagaacaaguggaagucggcacgugaggcuguugaagacaguggauuuugggaauugguugacaaggaaaggaaucuccaucuugaaggaaagugugaaacauguguguauaacaugaugggaaagagagagaagaagcuaggggaguucggcaaagcaaaaggcagcagagccauaugguacauguggcuuggagcacgcuucuuagaguuugaagcucuaggauucuugaacgaagaucacugguuuuccagagagaacucccugaguggaguggaaggagaagggcuacacaagcuaggcuacauuuuaagagacgugaguaagaaagaaggaggagcaauguaugcugaugacaccgcaggaugggacacaagaaucacacuagaggacuuaaaaaaugaagaaauggugacaaaccacauggaaggagaacacaagaaacuugcugaagccauuuucaaauuaacguaccaaaacaagguggugcgugugcaaagaccaacaccaagaggcacaguaauggacauuauaucgagaagagaccaaagagguaguggacaaguugucaccuacggccucaauacuuucaccaauauggaagcccaacugaucagacagauggagggagaaggaguuuucaaaagcauccagcaacugacaguaaaagaagaaauugcagugaaaaacugguuaauaagaguggggcgugagagguuaucaagaauggccaucaguggagaugauuguguugugaaacccuuagaugacagguuugcaagugcucuaacagcucuaaaugacaugggaaagguuaggaaagacauacaacaaugggaaccuucaagaggauggaacgauuggacacaagugcccuuuuguucacaccauuuccaugaguugaucaugaaggacggucgugugcucguaguuccaugcagaaaccaagaugaacugauuggcagggcccgaauuucccagggagccgggugguccuugcgggaaacagccugucuggggaaguccuacgcccaaauguggagccugauguacuuccacagacgugaccuuaggcuggcggcaaaugccauuugcucggcagucccaucacauuggauuccaacaagucgaacaaccugguccauacacgccacacaugaguggaugacaacagaagacauguugacagucuggaacaggguguggauucaagaaaacccauggauggaagacaaaacuccaguagaaucaugggaggaaaucccguauuuggggaaaagagaagaccaauggugcggcucauugauugggcuaacaagcagggccaccugggcaaagaacauucaaacagcaauaaaucaaguuagaucccuaauaggcaaugaggaauacacagacuacaugccaucuaugaaaagauucagaauagaagaggaagaggcaggagucuugugguag

SEQ ID NO: 6455 - RNA, 9876 nt, Artificial Sequence
  derived and/or modified CDS sequence (wt) from DENV-2__KM279595__SS-prME
acugcagguauaauuauuaugaugaucccaacagugauggcguuccauuuaaccacacgcaacggagaaccacacaugaucguuaguagacaagagaaagggaaaagucuccuguuuaaaacagagaacggugugaacauguguacccucauggccauggaccuuggugaacugugugaagacacaaucacuuauaauuguccucuucucaggcagaaugaaccagaagacauagacuguuggugcaacuccacgucuacauggguaacuuaugggacaugcaccgccacaggagaacacagaagggaaaaaagaucaguggcacucguuccacaugugggaaugggacuggagacacgaacugaaacauggaugucaucagaaggggccuggaaacaugcccagagaauugaaacuuggaucuugagacauccaggcuucaccauaauggcagcaauccuggcauacaccauaggaacaacauauuuccaaagaguccugauuuucauuuuacugacagcugucacuccuucaauggcaaugcguuguauaggaauaucaaauagagacuuuguggaagggguuucaggaggaagcuggguugauauagucuuggaacauggaagcugugugacgacgauggcgaaaaauaaaccaacgcuggauuuugaacugauaaaaacagaagccaaacaucucgccacucuaaggaaguauuguguagaggcaaagcugaccaacacaacaacagcaucucgcugcccaacacaaggagaaccuagccuaaaugaagaacaggacaaaagauucgucugcaaacacuccaugguagacagaggauggggaaauggaugcggauuauuuggaaagggaggcaucgugaccugugcaauguucacaugcaaaaagaacauggaaggaaaagucgugcaaccagaaaacuuggaguacaccaucgugauaacaccucacucaggggaagagaaugcagucggaaaugacacaggaaaacauggcaaggaaauuaaaguaacaccacagaguuccaucacagaagcagaacuaacaggcuacggcaccgucacgauggaaugcucuccgagaacgggccucgacuucaaugagaugguguugcugcaaauggaaaacaaggcuuggcuggugcacaggcaaugguucuuagaccugccguuaccauggcugcccggagcagacacacaaggaucaaauuggauacagaaggagacacuggucacuuucaaaaauccccaugcaaagaaacaggauguaguuguuuuagguucccaagaaggggccaugcacacggcacucacaggggccacggaaauccagaugucaucaggaaacuuacuguucacaggacaucuuaagugcaggcugagaauggacaaacuacagcucaaaggaaugucauauuccauguguacgggaaaguucaaaguugugaaggaaauagcagaaacacaacauggaacaauaguuauuagaguacaauaugaaggggacgguuccccgugcaagaucccuuuugaaauaauggacuuggaaaaaaggcaugucuuaggacgcuugauuaccgucaacccaauugucacagaaaaagacagcccagucaacauagaagcagaaccuccauuuggagacaguuacaucauuauaggaguagaaccaggacaacugaagcucagcugguuuaagaaaggaaguucuauuggccaaauguuugagacaacaaugagaggagcgaagagaauggccauucuaggugacacagcuugggauuuuggaucccugggaggaguguucacaucuauaggaaaggcccuccaccaagucuuuggagcuaucuauggggcugccuucagugggguuucauggacuaugaaaauccucauaggagucgucaucacauggauaggaaugaauucacgcagcaccucacugucugugucacuaguauuagugggggucgugacauuguauuugggaguuauggugcaggccgauagugggugcguugugaguuggaaaaacaaagaacugaaaugugguagugggauuuuuaucacagacaacgugcacacauggacagaacaauacaaauuccaaccagaauccccuucaaagcuggcuucagcuauccagaaggcucaugaagaaggcauuuguggaauccgcucaguaacaagacuggagaaucugauguggaaacaaauaacaccagaauugaaucacauucuaacagaaaaugaaguaaaguugacuaucaugacaggagacaucaaaggaaucaugcaggcaggaaaacgaacccugcggccucaacccacugagcugaaguacuccuggaaggcauggggcaaagcgaaaaugcuuuccacagagcuucauaaccacaccuuucucauugauggccccgaaacagcagaaugucccaacacaaacagagcuuggaacucacuagaaguugaagacuauggcuuuggaguauucaccacuaacauauggcugaaauugaaagaaaggcaggauguguuuugugacucaaaacucaugucagcagccauaaaggacaauagagccguccacgccgauauggguuauuggauagaaagcgcacucaaugacacauggaagauugagaaagccucuuuuauugaaguuaaaagcugccacuggccaaagucacacacucucuggaguaauggagugcuggaaagugagaugauaauuccaaagaauuuugcaggaccaguuucacaacacaauuacagaccaggcuaccacacacaaacagcaggacccuggcaucuagguaggcuugagauggacuuugauuucugcgaaggaaccacagugguggugacugaggacuguggaaauagaggacccuccuuaagaacaacuacugcuucuggaaaacucauaacagaguggugcugccgaucuugcacauuaccaccgcuaagguacagaggugaggauggaugcugguaugguauggaaaucaggccauugaaagagaaagaagagaaccuggucaacucuuuggucacagccggacauggacagauugacaacuucucacuaggagucuugggaauggcauuguuccuggaagagaugcucaggacucgaguaggaacgaaacaugcaauauuacuaguugcagucucuuucgugacauugaucacagggaacauguccuuucgagauuuggggagagugauggucauggugggcgcuacuaugacggaugacauaggcaugggcgugacuuaucuugcccuauuagcagccuuuaaagucagaccaaccuuugcggcuggacuacucuuaagaaagcugaccuccaaggaauugaugaugaccaccauaggaaucguacuccucucucagaguaccauaccagagagcauacuugaacugacugacgcguuggcuuuggggaugaugguucuuaaaauagugagaaacauggaaaaguaucagcuagcagugacuaucauggcaaucuugugcgucccaaaugcagugauauugcaaaaugcauggaaagugagcugcacaacacuggcagugguguccguuuccccacugcuuuuaacauccucacagcagaaagcggauuggauaccacuggcguugacgaucaaaggccucaauccaacagccauuuucuuaacaacucucucaagaacuagcaagaaaaggagcuggccacuaaaugaggcuauuauggcagucgggauggugagcauucuagcuaguucucucuuaaagaaugauauucccaugacaggaccauuaguggcuggagggcuucucacuguguguuacgugcucaccggaaggucggcugacuuggaacuggaaagagcugcugacguaagaugggaagaacaggcagagauaucaggaaguaguccaauucugucgauaacaauaucggaagaugguagcaugucgauaaagaaugaagaagaagaacagacacugaccauacucaucagaacaggacuacuggugauaucaggacuuuuuccugugucaauaccaaucacggcagcugcaugguaccuuugggaagugaaaaaacaacgagcaggaguauugugggaugucccuucacccccaccugugggaaaggccgaacuggaagauggagccuauagaaucaagcagaaagggauccuaggauacucacagauuggagccggaguuuacaaagaaggaacauuccacacaauguggcaugucacacguggugcuguccuaaugcauaaagggaagagaauugaaccaucaugggcggacgucaagaaagaccuaauaucguauggaggaggcuggaagcuggaaggagaauggaaggaaggagaagaaguccagguccuggcauuagagcccggaaagaauccaagagccguccaaacaaaacccggucuuuuuaaaaccaacacuggaaccauaggcgccgugucucuggacuuuucuccuggaacgucaggaucuccaaucgucgauaaaaaaggaaaaguugugggccuuuauggcaacggugucgucacaaggaguggaacauaugugagugccauagcccagacugaaaaaaacaucgaagacaauccagagauugaagaugacaucuuuagaaagaaaagauugaccaucauggaccuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagcuaucagagcugagcacacugggcgggagauuguggaucuaaugugucaugccacauuuaccaugaggcuauuaucaccaauuagagugccaaauuacaaccugaucaucauggaugaagcccauuucacagacccagcaagcauagcagcuagaggauacauuucaacucgaguagagaugggugaagcagcugggauuuucaugacagccaccccuccuggaagcagagacccauuuccccagagcaacgcaccaaucauggaugaagaaaaagaaaucccugagcguucguggaacucuggacaugaguggguuacggauuuuaaagggaagacuguuugguuuguuccaaguauaaaagcagggaaugauauagcagcuugccugagaaagaauggaaagaaagugauacaacucagcaggaaaacuuuugauucugaauauaucaagacuaggaccaaugauugggacuuuguggucacgacagacauuucagaaaugggugcuaacuucaaggcugagaggguuauagaccccagacgcugcaugaaaccagucauauuaacagacggugaagagcgggugaucuuggcaggacccaugccagugacccauucuagugcagcacaaagaagagggagaguaggaagaaauccaaaaaaugaaaaugaccaguacauauacaugggggaaccucuggaaaaugaugaagacugugcacacuggaaagaagcuaagaugcucuuggauaacaucaacacgccugaaggaaucauucccagcauguucgaaccagagcgugaaaagguggaugccauugauggugaauaccgcuugagaggagaagcgaggaaaacuuuuguggaccuaaugagaagaggagauuuaccagucuggcuagccuacagaguggcggcugaaggcaucaacuacgcagacagaagauggugcuuugauggagucaagaacaaccaaaucuuggaagaaaauguggaaguagaaauuuggacaaaagaaggagaaaggaagaaauuaaaacccagaugguuggaugcuaggaucuacucugacccauuggcgcucaaagaauucaaggaauucgcagcuggaagaaagucccugacccugaaucuaaucacagagauggguagacucccaaccuucaugacccagaaagcaaagaaugcacucgacaacuuagcaguccugcauacggcugaagcaggcggaagggcguacaaucaugcucuuagugaacugccggagacucuggagacauugcuuuuacugacacuuuuggccacagucacgggcggaaucuuccuguucuugaugagcggaaaggguauagggaagaugacccugggaaugugcugcauaaucacggcuaguauccucuuaugguaugcacaaauacagccacacuggauagcagcuucaauaauacuggaguuuuuucucauagucuugcucauuccagaaccagaaaaacagagaacaccccaagauaaccaguuaacuuauguugucauagccauccuuacaguaguggccgcaaccauggcaaacgagauggguuuccuggaaaaaacaaagaaagauuucggauugggaagcauuacaacccagcaaccugagaguaacauccuggacauagaucuacguccugcaucagcuuggacucuauaugccguggcaacaacuuucaucacaccaauguugaggcauagcauugaaaacuccucagugaaugugucccuaacagccauugccaaccaagccacaguguuaaugggucuugggaaaggauggccauugucaaaaauggacaucggaguuccccuucucgcuaucgggugcuauucacaagucaaccccauaacucucacugcagcccuucucuuacugguagcccauuaugccaucauagggccaggacuccaagcgaaagcaacuagagaggcucagaaaagagcagcagcgggcaucaugaaaaacccaacuguggauggaaugacagugauugaccuagauccaauacccuaugauccaaaguuugaaaagcaguugggacaaguaaugcucuuaguccucugcgugacccaaguauugaugaugaggacuacaugggcuuuaugugaagcucuaaccuuagcaaccgggcccaucucuacacugugggaaggaaauccagggagauuuuggaauacaacuauugcagugucaauggcuaacauuuuuagagggaguuaccuggccggagccggacuucucuuuucuaucaugaaaaacacggccaacacaagaaggggaacuggcaacacaggagagacgcuuggggagaaauggaaaaaccgguugaaugcauuagggaagagugaauuccagaucuacaagaaaaguggaauccaggaaguggacagaaccuuagcaaaagaaggcaucaaaagaggagaaacggaccaucacgcugugucgcgaggcucagcgaaacugagaugguucgucgagagaaaccuggucacaccagaagggaaaguaguggaccuuggcugcggcagggggggcuggucauacuauugugggggacuaaagaauguaaaagaagucaaaggccuaacaaaaggaggaccaggacacgaagaacccauucccaugucaacauaugguuggaaucuggugcgccuucaaaguggaguugauguuuucuucacuccgccagaaaagugugacacacugcugugugacauaggggagucgucaccaaaccccacgguugaggcaggacgaacacucagaguucuaaacuuaguggaaaauuggcugaacaacaacacccaauuuugcauaaagguucuuaacccauacaugcccucaguuauagaaaaaauggaagcacuacaaaggaaauacggaggagcuuuggugaggaauccacucucacgaaauuccacacacgagauguacuggguauccaaugcuuccgggaauauagugucaucagugaacaugauuucaagaauguugauuaacagauucacaaugagacacaagaaagccacauacgagccagauguugaccucggaaguggaacccgcaacaucggaauugaaagugagacaccaaauuuagacauaauugggaaaagaauagaaaaaauaaaacaagagcaugaaacaucauggcacuaugaccaagaccacccauacaaaacgugggccuaccauggcagcuacgaaacaaaacagacuggaucagcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccgaaagaaggcacgaaaaaacuaaugaaaauuacugcagaauggcucuggaaagaacuaggaaagaaaaagacaccuaggaugugcaccagagaagaauucacaagaaaggugagaagcaaugcagccuuaggugccauauucacugaugagaacaaguggaagucggcacgugaggcuguugaagacaguggauuuugggaauugguugacaaggaaaggaaucuccaucuugaaggaaagugugaaacaugcguguauaacaugaugggaaagagagagaagaagcuaggggaguucggcaaagcaaaaggcagcagagccauaugguacauguggcuuggagcacgcuucuuagaguuugaagcucuaggauucuugaacgaagaucacugguuuuccagagagaacucccugaguggaguggaaggagaagggcuacacaagcuaggcuacauuuuaagagacgugaguaagaaagaaggaggagcaauguaugcugaugacaccgcaggaugggacacaagaaucacacuagaggacuugaaaaaugaagaaauggugacaaaccacauggaaggagaacacaagaaacuugcugaagccauuuucaaauuaacguaccaaaacaagguggugcgugugcaaagaccaacaccaagaggcacaguaauggacauuauaucgagaagagaccaaagagguaguggacaaguugucaccuacggccucaauacuuucaccaauauggaagcccaacugaucagacagauggagggagaaggaguuuucaaaagcauccagcaacugacaguaaaagaagaaauugcagugaaagacugguuaauaagaguggggcgugagagguuaucaagaauggccaucaguggagaugauuguguugugaaacccuuagaugacagguuugcaagugcucuaacagcucuaaaugacaugggaaagguuaggaaagacauacaacaaugggaaccuucaagaggauggaacgauuggacacaagugcccuuuuguucacaccauuuccaugaguuaaucaugaaggacggucgugugcucguaguuccaugcagaaaccaagaugaacugauuggcagggcccgaauuucccagggagccgggugguccuugcgggaaacagccugucuggggaaguccuacgcccaaauguggagccugauguacuuccacagacgugaccuuaggcuggcggcaaaugccauuugcucggcagucccaucacauuggauuccaacaagucgaacaaccugguccauacacgccacacaugaguggaugacaacagaagacauguugacagucuggaacaggguguggauucaagaaaacccauggauggaagacaaaacuccaguagaaucaugggaggaaaucccguauuuggggaaaagagaagaccaauggugcggcucauugauugggcuaacaagcagggccaccugggcaaagaacauccaaacagcaauaaaucaaguuagaucccuaauaggcaaugaggaauacacagacuacaugccaucuaugaaaagauucagaagagaagaggaagaggcaggagucuugugguag

SEQ ID NO: 6456 - RNA, 9876 nt, Artificial Sequence
  derived and/or modified CDS sequence (wt) from DENV-2__KM279566__SS-prME
acugcagguauaauuauuaugaugaucccaacagugauggcguuccauuuaaccacacgcaacggagaaccacacaugaucguuaguagacaagagaaagggaaaagucuccuguuuaaaacagagaacggugugaacauguguacccucauggccauggaccuuggugaacugugugaagacacaaucacuuauaauuguccucuucucaggcagaaugaaccagaagacauagacuguuggugcaacuccacgucuacauggguaacuuaugggacaugcaccgccacaggagaacacagaagggaaaaaagaucaguggcacucguuccacaugugggaaugggacuggagacacgaacugaaacauggaugucaucagaaggggccuggaaacaugcccagagaauugaaacuuggaucuugagacauccaggcuucaccauaauggcagcaauccuggcauacaccauaggaacaacauauuuccaaagaguccugauuuucauuuuacugacagcugucacuccuucaauggcaaugcguuguauaggaauaucaaauagagacuuuguggaagggguuucaggaggaagcuggguugauauagucuuggaacauggaagcugugugacgacgauggcgaaaaauaaaccaacgcuggauuuugaacugauaaaaacagaagccaaacaucucgccacucuaaggaaguauuguguagaggcaaagcugaccaacacaacaacagcaucucgcugcccaacacaaggagaaccuagccuaaaugaagaacaggacaaaagauucgucugcaaacacuccaugguagacagaggauggggaaauggaugcggauuauuuggaaagggaggcaucgugaccugugcaauguucacaugcaaaaagaacauggaaggaaaagucgugcaaccagaaaacuuggaguacaccaucgugauaacaccucacucaggggaagagaaugcagucggaaaugacacaggaaaacauggcaaggaaauuaaaguaacaccacagaguuccaucacagaagcagaacuaacaggcuacggcaccgucacgauggaaugcucuccgagaacgggccucgacuucaaugagaugguguugcugcaaauggaaaacaaggcuuggcuggugcacaggcaaugguucuuagaccugccguuaccauggcugcccggagcagacacacaaggaucaaauuggauacagaaggagacacuggucacuuucaaaaauccccaugcaaagaaacaggauguaguuguuuuagguucccaagaaggggccaugcacacggcacucacaggggccacggaaauccagaugucaucaggaaacuuacuguucacaggacaucuuaagugcaggcugagaauggacaaacuacagcucaaaggaaugucauauuccauguguacaggaaaguucaaaguugugaaggaaauagcagaaacacaacauggaacaauaguuauuagaguacaauaugaaggggacgguuccccgugcaagaucccuuuugaaauaauggacuuggaaaaaaggcaugucuuaggacgcuugauuaccgucaacccaauugucacagaaaaagacagcccagucaacauagaagcagaaccuccauuuggagacaguuacaucauuauaggaguagaaccaggacaacugaagcucagcugguuuaagaaaggaaguucuauuggccaaauguuugagacaacaaugagaggagcgaagagaauggccauucuaggugacacagcuugggauuuuggaucccugggaggaguguucacaucuauaggaaaggcccuccaccaagucuuuggagcuaucuauggggcugccuucagugggguuucauggacuaugaaaauccucauaggagucgucaucacauggauaggaaugaauucacgcagcaccucacugucugugucacuaguauuagugggggucgugacauuguauuugggaguuauggugcaggccgauagugggugcguugugaguuggaaaaacaaagaacugaaaugugguagugggauuuuuaucacagacaacgugcacacauggacagaacaauacaaauuccaaccagaauccccuucaaagcuggcuucagcuauccagaaggcucaugaagaaggcauuuguggaauccgcucaguaacaagacuggagaaucugauguggaaacaaauaacaccagaauugaaucacauucuaacagaaaaugaaguaaaguugacuaucaugacaggagacaucaaaggaaucaugcaggcaggaaaacgaacccugcggccucaacccacugagcugaaguacuccuggaaggcauggggcaaagcgaaaaugcuuuccacagagcuucauaaccacaccuuucucauugauggccccgaaacagcagaaugucccaacacaaacagagcuuggaacucacuagaaguugaagacuauggcuuuggaguauucaccacuaacauauggcugaaauugaaagaaaggcaggauguguuuugugacucaaaacucaugucagcagccauaaaggacaauagagccguccacgccgauauggguuauuggauagaaagcgcacucaaugacacauggaagauugagaaagccucuuuuauugaaguuaaaagcugccacuggccaaagucacacacucucuggaguaauggagugcuggaaagugagaugauaauuccaaagaauuuugcaggaccaguuucacaacacaauuacagaccaggcuaccacacacaaacagcaggacccuggcaucuagguaggcuugagauggacuuugauuucugcgaaggaaccacagugguggugacugaggacuguggaaauagaggacccuccuuaagaacaacuacugcuucuggaaaacucauaacagaguggugcugccgaucuugcacauuaccaccgcuaagguacagaggugaggauggaugcugguaugguauggaaaucaggccauugaaagagaaagaagagaaccuggucaacucuuuggucacagccggacauggacagauugacaacuucucacuaggagucuugggaauggcauuguuccuggaagagaugcucaggacucgaguaggaacgaaacaugcaauauuacuaguugcagucucuuucgugacauugaucacagggaacauguccuuucgagauuuggggagagugauggucauggugggcgcuacuaugacggaugacauaggcaugggcgugacuuaucuugcccuauuagcagccuuuaaagucagaccaaccuuugcggcuggacuacucuuaagaaagcugaccuccaaggaauugaugaugaccaccauaggaaucguacuccucucucagaguaccauaccagagagcauacuugaacugacugacgcguuggcuuuggggaugaugguucuuaaaauagugagaaacauggaaaaguaucagcuagcagugacuaucauggcaaucuugugcgucccaaaugcagugauauugcaaaaugcauggaaagugagcugcacaacacuggcagugguguccguuuccccacugcuuuuaacauccucacagcagaaagcggauuggauaccacuggcguugacgaucaaaggccucaauccaacagccauuuucuuaacaacucucucaagaacuagcaagaaaaggagcuggccacuaaaugaggcuauuauggcagucgggauggugagcauucuagcuaguucucucuuaaagaaugauauucccaugacaggaccauuaguggcuggagggcuucucacuguguguuacgugcucaccggaaggucggcugacuuggaacuggaaagagcugcugacguaagaugggaagaacaggcagagauaucaggaaguaguccaauucugucgauaacaauaucggaagaugguagcaugucgauaaagaaugaagaagaagaacagacacugaccauacucaucagaacaggacuacuggugauaucaggacuuuuuccugugucaauaccaaucacggcagcugcaugguaccuuugggaagugaaaaaacaacgagcaggaguauugugggaugucccuucacccccaccugugggaaaggccgaacuggaagauggagccuauagaaucaagcagaaagggauccuaggauacucacagauuggagccggaguuuacaaagaaggaacauuccacacaauguggcaugucacacguggugcuguccuaaugcauaaagggaagagaauugaaccaucaugggcggacgucaagaaagaccuaauaucguauggaggaggcuggaagcuggaaggagaauggaaggaaggagaagaaguccagguccuggcauuagagcccggaaagaauccaagagccguccaaacaaaacccggucuuuuuaaaaccaacacuggaaccauaggcgccgugucucuggacuuuucuccuggaacgucaggaucuccaaucgucgauaaaaaaggaaaaguugugggccuuuauggcaacggugucgucacaaggaguggaacauaugugagugccauagcccagacugaaaaaagcaucgaagacaauccagagauugaagaugacaucuuuagaaagaaaagauugaccaucauggaccuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagcuaucagagcugagcacacugggcgggagauuguggaucuaaugugucaugccacauuuaccaugaggcuauuaucaccaauuagagugccaaauuacaaccugaucaucauggaugaagcccauuucacagacccagcaagcauagcagcuagaggauacauuucaacucgaguagagaugggugaagcagcugggauuuucaugacagccaccccuccuggaagcagagacccauuuccccagagcaacgcaccaaucauggaugaagaaaaagaaaucccugagcguucguggaacucuggacaugaguggguuacggauuuuaaagggaagacuguuugguuuguuccaaguauaaaagcagggaaugauauagcagcuugccugagaaagaauggaaagaaagugauacaacucagcaggaaaacuuuugauucugaauauaucaagacuaggaccaaugauugggacuuuguggucacgacagacauuucagaaaugggugcuaacuucaaggcugagaggguuauagaccccagacgcugcaugaaaccagucauauuaacagacggugaagagcgggugaucuuggcaggacccaugccagugacccauucuagugcagcacaaagaagagggagaguaggaagaaauccaaaaaaugaaaaugaccaguacauauacaugggggaaccucuggaaaaugaugaagacugugcacacuggaaagaagcuaagaugcucuuggauaacaucaacacgccugaaggaaucauucccagcauguucgaaccagagcgugaaaagguggaugccauugauggugaauaccgcuugagaggagaagcgaggaaaacuuuuguggaccuaaugagaagaggagauuuaccagucuggcuagccuacagaguggcggcugaaggcaucaacuacgcagacagaagauggugcuuugauggagucaagaacaaccaaaucuuggaagaaaauguggaaguagaaauuuggacaaaagaaggagaaaggaagaaauuaaaacccagaugguuggaugcuaggaucuacucugacccauuggcgcucaaagaauucaaggaauucgcagcuggaagaaagucccugacccugaaucuaaucacagagauggguagacucccaaccuucaugacccagaaagcaaagaaugcacucgacaacuuagcaguccugcauacggcugaagcaggcggaagggcguacaaucaugcucuuagugaacugccggagacucuggagacauugcuuuuacugacacuuuuggccacagucacgggcggaaucuuccuguucuugaugagcggaaaggguauagggaagaugacccugggaaugugcugcauaaucacggcuaguauccucuuaugguaugcacaaauacagccacacuggauagcagcuucaauaauacuggaguuuuuucucauagucuugcucauuccagaaccagaaaaacagagaacaccccaagauaaccaguuaacuuauguugucauagccauccuuacaguaguggccgcaaccauggcaaacgagauggguuuccuggaaaaaacaaagaaagauuucggauugggaagcauuacaacccagcaaccugagaguaacauccuggacauagaucuacguccugcaucagcuuggacucuauaugccguggcaacaacuuucaucacaccaauguugaggcauagcauugaaaacuccucagugaaugugucccuaacagccauugccaaccaagccacaguguuaaugggucuugggaaaggauggccauugucaaaaauggacaucggaguuccccuucucgcuaucgggugcuauucacaagucaaccccauaacucucacugcagcccuucucuuauugguagcccauuaugccaucauagggccaggacuccaagcgaaagcaacuagagaggcucagaaaagagcagcagcgggcaucaugaaaaacccaacuguggauggaaugacagugauugaccuagauccaauacccuaugauccaaaguuugaaaagcagcugggacaaguaaugcucuuaguccucugcgugacccaaguauugaugaugaggacuacaugggcuuuaugugaagcucuaaccuuagcaacugggcccaucucuacacugugggaaggaaauccagggagauuuuggaauacaacuauugcagugucaauggcuaacauuuuuagagggaguuaccuggccggagccggacuucucuuuucuaucaugaaaaacacggccaacacaagaaggggaacuggcaacacaggagagacgcuuggggagaaauggaaaaaccgguugaaugcauuagggaagagugaauuccagaucuacaagaaaaguggaauccaggaaguggacagaaccuuagcaaaagaaggcaucaaaagaggagaaacggaccaucacgcugugucgcgaggcucagcgaaacugagaugguucgucgagagaaaccuggucacaccagaagggaaaguaguggaccuuggcugcggcagggggggcuggucauacuauugugggggacuaaagaauguaaaagaagucaaaggccuaacaaaaggaggaccaggacacgaagaacccauucccaugucaacauaugguuggaaucuggugcgccuucaaaguggaguugauguuuucuucacuccgccagaaaagugugacacacugcugugugacauaggggagucgucaccaaaccccacgguugaggcaggacgaacacucagaguucuaaacuuaguggaaaauuggcugaacaacaacacccaauuuugcauaaagguucuuaacccauacaugcccucaguuauagaaaaaauggaagcacuacaaaggaaauacggaggagcuuuggugaggaauccacucucacgaaauuccacacacgagauguacuggguauccaaugcuuccgggaauauagugucaucagugaacaugauuucaagaauguugauuaacagauucacaaugagacacaagaaagccacauacgagccagauguugaccucggaaguggaacccgcaacaucggaauugaaagugagacaccaaauuuagacauaauugggaaaagaauagaaaaaauaaaacaagagcaugaaacaucauggcacuaugaccaagaccacccauacaaaacgugggccuaccauggcagcuacgaaacaaaacagacuggaucagcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccgaaagaaggcacgaaaaaacuaaugaaaauuacugcagaauggcucuggaaagaacuaggaaagaaaaagacaccuaggaugugcaccagagaagaauucacaagaaaggugagaagcaaugcagccuuaggugccauauucacugaugagaacaaguggaagucggcacgugaggcuguugaagacaguggauuuugggaauugguugacaaggaaaggaaucuccaucuugaaggaaagugugaaacaugcguguauaacaugaugggaaagagagagaagaagcuaggggaguucggcaaagcaaaaggcagcagagccauaugguacauguggcuuggagcacgcuucuuagaguuugaagcucuaggauucuugaacgaagaucacugguuuuccagagagaacucccugaguggaguggaaggagaagggcuacacaagcuaggcuacauuuuaagagacgugaguaagaaagaaggaggagcaauguaugcugaugacaccgcaggaugggacacaagaaucacacuagaggacuugaaaaaugaagaaauggugacaaaccacauggaaggagaacacaagaaacuugcugaagccauuuucaaauuaacguaccaaaacaagguggugcgugugcaaagaccaacaccaagaggcacaguaauggacauuauaucgagaagagaccaaagagguaguggacaaguugucaccuacggccucaauacuuucaccaauauggaagcccaacugaucagacagauggagggagaaggaguuuucaaaagcauccagcaacugacaguaaaagaagaaauugcagugaaaaacugguuaauaagaguggggcgugagagguuaucaagaauggccaucaguggagaugauuguguugugaaacccuuagaugacagguuugcaagugcucuaacagcucuaaaugacaugggaaagguuaggaaagacauacaacaaugggaaccuucaagaggauggaacgauuggacacaagugcccuuuuguucacaccauuuccaugaguuaaucaugaaggacggucgugugcucguaguuccaugcagaaaccaagaugaacugauuggcagggcccgaauuucccagggagccgggugguccuugcgggaaacagccugucuggggaaguccuacgcccaaauguggagccugauguacuuccacagacgugaccuuaggcuggcggcaaaugccauuugcucggcagucccaucacauuggauuccaacaagucgaacaaccugguccauacacgccacacaugaguggaugacaacagaagacauguugacagucuggaacaggguguggauucaagaaaacccauggauggaagacaaaacuccaguagaaucaugggaggaaaucccguauuuggggaaaagagaagaccaauggugcggcucauugauugggcuaacaagcagggccaccugggcaaagaacauccaaacagcaauaaaucaaguuagaucccuaauaggcaaugaggaauacacagacuacaugccaucuaugaaaagauucagaagagaagaggaagaggcaggagucuugugguag

SEQ ID NO: 6457 - RNA, 9876 nt, Artificial Sequence
  derived and/or modified CDS sequence (wt) from DENV-2__KM279574__SS-prME
acugcagguauaauuauuaugaugaucccaacagugauggcguuccauuuaaccacacgcaacggagaaccacacaugaucguuaguagacaagagaaagggaaaagucuccuguuuaaaacagagaacggugugaacauguguacccucauggccauggaccuuggugaacugugugaagacacaaucacuuauaauuguccucuucucaggcagaaugaaccagaagacauagacuguuggugcaacuccacgucuacauggguaacuuaugggacaugcaccgccacaggagaacacagaagggaaaaaagaucaguggcacucguuccacaugugggaaugggacuggagacacgcacugaaacauggaugucaucagaaggggccuggaaacaugcccagagaauugaaacuuggaucuugagacauccaggcuucaccauaauggcagcuauccuggcauacaccauaggaacaacauauuuccaaagaguccugauuuucauuuuacugacagcugucacuccuucaauggcaaugcguuguauaggaauaucaaauagagacuuuguggaagggguuucaggaggaagcuggguugauauagucuuggaacauggaagcugugugacgacgauggcgaaaaauaaaccaacgcuggauuuugaacugauaaaaacagaagccaaacaucucgccacucuaaggaaguauuguguagaggcaaagcugaccaacacaacaacagcaucucgcugcccaacacaaggagaaccuagccuaaaugaagaacaggacaaaagauucgucugcaaacacuccaugguagacagaggauggggaaauggaugcggauuauuuggaaagggaggcaucgugaccugugcaauguucacaugcaaaaagaacauggaaggaaaagucgugcaaccagaaaacuuggaguacaccaucgugauaacaccucacucaggggaagagaaugcagucggaaaugacacaggaaaacauggcaaggaaauuaaaguaacaccacagaguuccaucacagaagcagaacuaacaggcuacggcacugucacgauggaaugcucuccgagaacgggccucgacuucaaugagaugguguugcugcaaauggaaaacaaggcuuggcuggugcacaggcaaugguucuuagaccugccguuaccauggcugcccggagcagacacacaaggaucaaauuggauacagaaggagacacuggucacuuucaaaaauccccaugcaaagaaacaggauguaguuguuuuagguucccaagaaggggccaugcacacggcacucacaggggccacggaaauccagaugucaucaggaaacuuacuguucacaggacaucuuaagugcaggcugagaauggacaaacuacagcucaaaggaaugucauauuccauguguacaggaaaguucaaaguugugaaggaaauagcagaaacacaacauggaacaauaguuauuagaguacaauaugaaggggacgguuccccgugcaagaucccuuuugaaauaauggacuuggaaaaaaggcaugucuuaggacgcuugauuaccgucaacccaauugucacagaaaaagacagcccagucaacauagaagcagaaccuccauuuggagacaguuacaucauuauaggaguagaaccaggacaacugaagcucagcugguuuaagaaaggaaguucuauuggccaaauguuugagacaacaaugagaggagcgaagagaauggccauucuaggugacacagcuugggauuuuggaucccugggaggaguguucacaucuauaggaaaggcccuccaccaagucuuuggagcuaucuauggggcugccuucagugggguuucauggacuaugaaaauccucauaggagucgucaucacauggauaggaaugaauucacgcagcaccucacugucugugucacuaguauuagugggggucgugacauuguauuugggaguuauggugcaggccgauagugggugcguugugaguuggaaaaacaaagaacugaaaugugguagugggauuuuuaucacagacaacgugcacacauggacagaacaauacaaauuccaaccagaauccccuucaaagcuggcuucagcuauccagaaggcucaugaagaaggcauuuguggaauccgcucaguaacaagacuggagaaucugauguggaaacaaauaacaccagaauugaaucacauucuaacagaaaaugaaguaaaguugacuaucaugacaggagacaucaaaggaaucaugcaggcaggaaaacgaacccugcggccucaacccacugagcugaaguacuccuggaaggcauggggcaaagcgaaaaugcuuuccacagagcuucauaaccacaccuuucucauugauggccccgaaacagcagaaugucccaacacaaacagagcuuggaacucacuagaaguugaagacuauggcuuuggaguauucaccacuaacauauggcugaaauugaaagaaaggcaggauguguuuugugacucaaaacucaugucagcagccauaaaggacaauagagccguccacgccgauauggguuauuggauagaaagcgcacucaaugacacauggaagauugagaaagccucuuuuauugaaguuaaaagcugccacuggccaaagucacacacucucuggaguaauggagugcuggaaagugagaugauaauuccaaagaauuuugcaggaccaguuucacaacacaauuacagaccaggcuaccacacacaaacggcaggacccuggcaucuagguaggcuugagauggacuuugauuucugcgaaggaaccacagugguggugacugaggacuguggaaauagaggacccuccuuaagaacaacuacugcuucuggaaaacucauaacagaguggugcugccgaucuugcacauuaccaccgcuaagguacagaggugaggauggaugcugguaugguauggaaaucaggccauugaaagagaaagaagagaaccuggucaacucuuuggucacagccggacauggacagauugacaacuucucacuaggagucuugggaauggcauuguuccuggaagagaugcucaggacucgaguaggaacgaaacaugcaauauuacuaguugcagucucuuucgugacauugaucacagggaacauguccuuucgagauuuggggagagugauggucauggugggcgcuacuaugacggaugacauaggcaugggcgugacuuaucuugcccuauuagcagccuuuaaaaucagaccaaccuuugcggcuggacuacucuuaagaaagcugaccuccaaggaauugaugaugaccaccauaggaaucguacuccucucucagaguaccauaccagagagcauacuugaacugacugacgcguuggcuuuggggaugaugguucuuaaaauagugagaaacauggaaaaguaucagcuagcagugacuaucauggcaaucuugugcgucccaaaugcagugauauugcaaaaugcauggaaagugagcugcacaacacuggcagugguguccguuuccccacugcuuuuaacauccucacagcagaaagcggauuggauaccacuggcguugacgaucaaaggccucaauccaacagccauuuucuuaacaacucucucaagaacuagcaagaaaaggagcuggccacuaaaugaggcuauuauggcagucgggauggugagcauucuagcuaguucucucuuaaagaaugauauucccaugacaggaccauuaguggcuggagggcuucucacuguguguuacgugcucaccggaaggucggcugacuuggaacuggaaagagcugcugacguaagaugggaagaacaggcagagauaucaggaaguaguccaauucugucgauaacaauaucggaagaugguagcaugucgauaaagaaugaagaagaagaacagacacugaccauacucaucagaacaggacuacuggugauaucaggacuuuuuccugugucaauaccaaucacggcagcugcaugguaccuuugggaagugaaaaaacaacgagcaggaguauugugggaugucccuucacccccaccugugggaaaggccgaacuggaagauggagccuauagaaucaagcagaaagggauccuaggauacucacagauuggagccggaguuuacaaagaaggaacauuccacacaauguggcaugucacacguggugcuguccuaaugcauaaagggaagagaauugaaccaucaugggcggacgucaagaaagaccuaauaucguauggaggaggcuggaagcuggaaggagaauggaaggaaggagaagaaguccagguccuggcauuagagcccggaaagaauccaagagccguccaaacaaaacccggucuuuuuaaaaccaacacuggaaccauaggcgccgugucucuggacuuuucuccuggaacgucaggaucuccaaucgucgauaaaaaaggaaaaguugugggccuuuauggcaacggugucgucacaaggaguggaacauaugugagugccauagcccagacugaaaaaagcaucgaagacaauccagagauugaagaugacaucuuuagaaagaaaagauugaccaucauggaccuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagcuauuagagcugagcacacugggcgggagauuguggaucuaaugugucaugccacauuuaccaugaggcuauuaucaccaauuagagugccaaauuacaaccugaucaucauggaugaagcccauuucacagacccagcaagcauagcagcuagaggauacauuucaacucgaguagagaugggugaagcagcugggauuuucaugacagccaccccuccuggaagcagagacccauuuccccagagcaacgcaccaaucauggaugaagaaaaagaaaucccugagcguucguggaacucuggacaugaguggguuacggauuuuaaagggaagacuguuugguuuguuccaaguauaaaagcagggaaugauauagcagcuugccugagaaagaauggaaagaaagugauacaacucagcaggaaaacuuuugauucugaauauaucaagacuaggaccaaugauugggacuuuguggucacgacagacauuucagaaaugggugcuaacuucaaggcugagaggguuauagaccccagacgcugcaugaaaccagucauauuaacagacggugaagagcgggugaucuuggcaggacccaugccagugacccauucuagugcagcacaaagaagagggagaguaggaagaaauccaaaaaaugaaaaugaccaguacauauacaugggggaaccucuggaaaaugaugaagacugugcacacuggaaagaagcuaagaugcucuuggauaacaucaacacgccugaagggaucauucccagcauguucgaaccagagcgugaaaagguggaugccauugauggugaauaccgcuugagaggagaagcgaggaaaacuuuuguggaccuaaugagaagaggagauuuaccagucuggcuagccuacagaguggcggcugaaggcaucaacuacgcagacagaagauggugcuuugauggagucaagaacaaccaaaucuuggaagaaaauguggaaguagaaauuuggacaaaagaaggagaaaggaagaaauuaaaacccagaugguuggaugcuaggaucuacucugacccauuggcgcucaaagaauucaaggaauucgcagcuggaagaaagucccugacccugaaucuaaucacagagauggguagacucccaaccuucaugacccagaaagcaaagaaugcacucgacaacuuagcaguccugcauacggcugaagcaggcggaagggcguacaaucaugcucuuagugaacugccggagacucuggagacauugcuuuuacugacacuuuuggccacagucacgggcggaaucuuccuguucuugaugagcggaaaggguauagggaagaugacccugggaaugugcugcauaaucacggcuaguauccucuuaugguaugcacaaauacagccacacuggauagcagcuucaauaauacuggaguuuuuucucauagucuugcucauuccagaaccagaaaaacagagaacaccccaagauaaccaguuaacuuauguugucauagccauccuuacaguaguggccgcaaccauggcaaacgagauggguuuccuggaaaaaacaaagaaagauuucggauugggaagcauuacaacccagcaaccugagaguaacauccuggacauagaucuacguccugcaucagcuuggacucuauaugccguggcaacaacuuucaucacaccaauguugaggcauagcauugaaaacuccucagugaaugugucccuaacagccauugccaaccaagccacaguguuaaugggucuugggaaaggauggccauugucaaaaauggacaucggaguuccccuucucgcuaucgggugcuauucacaagucaaccccauaacucucacugcagcccuucucuuauugguagcccauuaugccaucauagggccaggacuccaagcgaaagcaacuagagaggcucagaaaagagcagcagcgggcaucaugaaaaacccaacuguggauggaaugacagugauugaccuagauccaauacccuaugauccaaaguuugaaaagcaguugggacaaguaaugcucuuaguccucugcgugacccaaguauugaugaugaggacuacaugggcuuuaugugaagcucuaaccuuagcaaccgggcccaucucuacacugugggaaggaaauccagggagauuuuggaauacaacuauugcagugucaauggcuaacauuuuuagagggaguuaccuggccggagccggacuucucuuuucuaucaugaaaaacacggccaacacaagaaggggaacuggcaacacaggagagacgcuuggggagaaauggaaaaaccgguugaaugcauuagggaagagugaauuccagaucuacaagaaaaguggaauccaggaaguggacagaaccuuagcaaaagaaggcaucaaaagaggagaaacggaccaucacgcugugucgcgaggcucagcgaaacugagaugguucgucgagagaaaccuggucacaccagaagggaaaguaguggaccuuggcugcggcagggggggcuggucauacuauugugggggacuaaagaauguaaaagaagucaaaggccuaacaaaaggaggaccaggacacgaagaacccauucccaugucaacauaugguuggaaucuggugcgccuucaaaguggaguugauguuuucuucacuucgccagaaaagugugacacacugcugugugacauaggggagucgucaccaaaccccacgguugaggcaggacgaacacucagaguucuaaacuuaguggaaaauuggcugaacaacaacacccaauuuugcauaaagguucuuaacccauacaugcccucaguuauagaaaaaauggaagcacuacaaaggaaauacggaggagcuuuggugaggaauccacucucacgaaauuccacacacgagauguacuggguauccaaugcuuccgggaauauagugucaucagugaacaugauuucaagaauguugauuaacagauucacaaugagacacaagaaagccacauacgagccagauguugaccucggaaguggaacccgcaacaucggaauugaaagugagacaccaaauuuagacauaauugggaaaagaauagaaaaaauaaaacaagagcaugaaacaucauggcacuaugaccaagaccacccauacaaaacgugggccuaccauggcagcuacgaaacaaaacagacuggaucagcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccgaaagaaggcacgaaaaaacuaaugaaaauuacugcagaauggcucuggaaagaacuaggaaagaaaaagacaccuaggaugugcaccagagaagaauucacaagaaaggugagaagcaaugcagccuuaggugccauauucacugaugagaacaaguggaagucggcacgugaggcuguugaagacaguggauuuugggaauugguugacaaggaaaggaaucuccaucuugaaggaaagugugaaacaugcguguauaacaugaugggaaagagagagaagaagcuaggggaguucggcaaagcaaaaggcagcagagccauaugguacauguggcuuggagcacgcuucuuagaguuugaagcucuaggauucuugaacgaagaucacugguuuuccagagagaacucccugaguggaguggaaggagaagggcuacacaagcuaggcuacauuuuaagagacgugaguaagaaagaaggaggagcaauguaugcugaugacaccgcaggaugggacacaagaaucacacuagaggacuuggaaaaugaagaaauggugacaaaccacauggaaggagaacacaagaaacuugcugaagccauuuucaaauuaacguaccaaaacaagguggugcgugugcaaagaccaacaccaagaggcacaguaauggacauuauaucgagaagagaccaaagagguaguggacaaguugucaccuacggccucaauacuuucaccaauauggaagcccaacugaucagacagauggagggagaaggaguuuucaaaagcauccagcaacugacaguaaaagaagaaauugcagugaaaaacugguuaacaagaguggggcgugagagguuaucaagaauggccaucaguggagaugauuguguugugaaacccuuagaugacagguuugcaagugcucuaacagcucuaaaugacaugggaaagguuaggaaagacauacaacaaugggaaccuucaagaggauggaacgauuggacacaagugcccuuuuguucacaccauuuccaugaguuaaucaugaaggacggucgugugcucguaguuccaugcagaaaccaagaugaacugauuggcagggcccgaauuucccagggagccgggugguccuugcgggaaacagccugucuggggaaguccuacgcccaaauguggagccugauguacuuccacagacgugaccuuaggcuggcggcaaaugccauuugcucggcagucccaucacauuggauuccaacaagucgaacaaccugguccauacacgccacacaugaguggaugacaacagaagacauguugacagucuggaacaggguguggauucaagaaaacccauggauggaagacaaaacuccaguagaaucaugggaggaaaucccguauuuggggaaaagagaagaccaauggugcggcucauugauugggcuaacaagcagggccaccugggcaaagaacauccaaacagcaauaaaucaaguuagaucccuaauaggcaaugaggaauacacagacuacaugccaucuaugaaaagauucagaagagaagaggaagaggcaggagucuugugguag

SEQ ID NO: 6458 - RNA, 9876 nt, Artificial Sequence
  derived and/or modified CDS sequence (wt) from DENV-2__KM279568__SS-prME
acugcagguauaauuauuaugaugaucccaacagugauggcguuccauuuaaccacacgcaacggagaaccacacaugauuguuaguagacaagagaaagggaaaagucuccuguuuaaaacagagaacggugugaacauguguacccucauggccauggaccuuggugaacugugugaagacacaaucacuuauaauuguccucuucucaggcagaaugaaccagaagacauagacuguuggugcaacuccacgucuacauggguaacuuaugggacaugcaccgccacaggagaacacagaagggaaaaaagaucaguggcacucguuccacaugugggaaugggacuggagacacgaacugaaacauggaugucaucagaaggggccuggaaacaugcccagagaauugaaacuuggaucuugagacauccaggcuucaccauaauggcagcaauccuggcauacaccauaggaacaacauauuuccaaagaguccugauuuucauuuuacugacagcugucacuccuucaauggcaaugcguugcauaggaauaucaaauagagacuuuguggaagggguuucaggaggaagcuggguugauauagucuuggaacauggaagcugugugacgacgauggcgaaaaauaaaccaacguuggauuuugaacugauaaaaacagaagccaaacaucucgccacucuaaggaaguauuguguagaggcaaagcugaccaacacaacaacagcaucucgcugcccaacacaaggagaaccuagccuaaacgaagaacaggacaaaagauucgucugcaaacacuccaugguagacagaggauggggaaauggaugcggauuauuuggaaagggaggcaucgugaccugugcaauguucacaugcaaaaagaacauggaaggaaaagucgugcaaccagaaaacuuggaguacaccaucgugauaacaccucacucaggggaagagaaugcagucggaaaugacacaggaaaacauggcaaggaaauuaaaauaacaccacagaguuccaucacagaagcagaacuaacaggcuacggcacugucacgauggaaugcucuccgagaacgggccucgacuucaaugagaugguguugcugcaaauggaaaacaaggcuuggcuggugcacaggcaaugguucuuagaccugccguuaccauggcugcccggagcagacacacaaggaucaaauuggauacagaaggagacacuggucacuuucaaaaauccccaugcaaagaaacaggauauuguuguuuuagguucccaagaaggggccaugcacacggcacucacaggggccacggaaauccagaugucaucaggaaacuuacuguucacaggacaucuuaagugcaggcugagaauggacaaacuacagcucaaaggaaugucauauuccauguguacaggaaaguucaaaguugugaaggaaauagcagaaacacaacauggaacaauaguuauuagaguacaauaugaaggggacgguuccccgugcaagaucccuuuugaaauaauggacuuggaaaaaaggcaugucuuaggucgcuugauuaccgucaacccaauugucacagaaaaagacagcccagucaacauagaagcagaaccuccauuuggagacaguuacaucauuauaggaguagaaccaggacaacugaagcucagcugguuuaagaaaggaaguucuauuggccaaauguuugagacaacaaugagaggagcgaagagaauggccauucuaggugacacagcuugggauuuuggaucccugggaggaguguucacaucuauaggaaaggcccuccaccaagucuuuggagcuaucuauggggcugccuucagugggguuucauggacuaugaaaauccucauaggagucgucaucacauggauaggaaugaauucacgcagcaccucacugucugugucacuaguauuagugggggucgugacauuguauuugggaguuauggugcaggccgauagugggugcguugucaguuggaaaaacaaagaacugaaaugugguagugggauuuuuaucacagacaaugugcacacauggacagaacaauacaaauuccaaccagaauccccuucaaagcuggcuucagcuauccagaaggcucaugaagaaggcauuuguggaauccgcucaguaacaagacuggagaaucugauguggaaacaaauaacaccagaauugaaucacauucuaacagaaaaugaaguaaaguugacuaucaugacaggagacaucaaaggaaucaugcaggcaggaaaacgaucccugcggccucaacccacugagcugaaguacuccuggaaggcauggggcaaagcgaaaaugcuuuccacagagcuucauaaccacaccuuucucauugauggccccgaaacagcagaaugucccaacacaaacagagcuuggaacucacuagaaguugaagacuauggcuuuggaguauucaccacuaacauauggcugaaauugaaagaaaggcaggauguguuuugugacucaaaacucaugucggcagccauaaaggacaauagagccguccacgccgauauggguuauuggauagaaagcgcacucaaugacacauggaagauugagaaagccucuuuuauugaaguuaaaagcugccacuggccaaagucacacacucucuggaguaauggagugcuggaaagugagaugauaauuccaaagaauuuugcaggaccaguuucacaacacaauuacagaccaggcuaccacacacaaacggcaggacccuggcaucuagguaggcuugagauggacuuugauuucugcgaaggaaccacagugguggugacugaggacuguggaaauagaggacccuccuuaagaacaacuacugcuucuggaaaacucauaacagaguggugcugccgaucuugcacauuaccaccgcuaagguacagaggugaggauggaugcugguaugguauggaaaucaggccauugaaagagaaagaagagaaccuggucaacucuuuggucacagccggacauggacagauugacaacuucucacuaggagucuugggaauggcauuguuccuggaagaaaugcucaggacucgaguaggaacgaaacaugcaauauuacuaguugcagucucuuucgugacauugaucacagggaacauguccuuucgagauuuggggagagugauggucauggugggcgcuacuaugacggaugacauaggcaugggcgugacuuaucuugcccuauuagcagccuuuaaagucagaccaaccuuugcggcuggacuacucuuaagaaagcugaccuccaaggaauugaugaugaccaccauaggaaucguacuccucucucagaguaccauaccagagagcauacuugaacugacugacgcguuggcuuuggggaugaugguucucaaaauagugagaaacauggaaaaguaucagcuagcagugacuaucauggcaaucucgugcguuccaaaugcagugauauugcaaaaugcauggaaagugagcugcacaacacuggcagugguguccguuuccccacugcuuuuaacauccucacagcagaaagcggauuggauaccacuggcguugacgaucaaaggccucaauccaacagccauuuucuuaacaacucucucaagaacuagcaagaaaaggagcuggccacuaaaugaggcuauuauggcagucgggauggugagcauucuagcuaguucucucuuaaagaaugauauucccaugacaggaccauuaguggcuggagggcuucucacuguguguuacgugcucacuggaaggucggcugacuuggaacuggaaagagcugcugacguaagaugggaagaacaggcagagauaucaggaaguaguccaauucugucgauaacaauaucggaagaugguagcaugucgauaaagaaugaagaagaagaacagacacugaccauacucaucagaacaggacuacuggugauaucaggacuuuuuccugugucaauaccaaucacggcagcugcaugguaccuuugggaagugaaaaaacaacgagcaggaguauugugggaugucccuucacccccaccugugggaaaggccgaacuggaagauggagccuauagaaucaagcagaaagggauccuaggauacucacagauuggagccggaguuuacaaagaaggaacauuccacacaauguggcaugucacacguggugcuguccuaaugcauaaagggaagagaauugaaccaucaugggcggacgucaagaaagaccuaauaucguauggaggaggcuggaagcuggaaggagaauggaaggaaggagaagaaguccagguccuggcauuagagccuggaaagaauccaagagccguccaaacaaaacccggucuuuuuaaaaccaacacuggaaccauaggcgccgugucucuggacuuuucuccuggaacgucaggaucuccaaucgucgauaaaaaaggaaaaguugugggccuuuauggcaacggugucgucacaaggaguggaacauaugugagugccauagcccagacugaaaaaagcaucgaagacaauccagagauugaagaugacaucuuuagaaagaaaagauugaccaucauggaccuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagcuaucagagcugagcacacugggcgggagauuguggaucuaaugugucaugccacauuuaccaugaggcuauuaucaccaauuagagugccaaauuacaaccugaucaucauggaugaagcccauuucacagacccagcaagcauagcagcuagaggauacauuucaacucgaguagagaugggugaagcagcugggauuuucaugacagccaccccuccuggaagcagagacccauuuccccagagcaacgcaccaaucauggaugaagaaagagaaaucccugagcguucguggaacucuggacaugaguggguuacggauuuuaaagggaagacuguuugguuuguuccaaguauaaaagcagggaaugauauagcagcuugccugagaaagaauggaaagaaagugauacaacucagcaggaaaacuuuugauucugaauauaucaagacuaggaccaaugauugggacuuuguggucacgacagacauuucagaaaugggugcuaacuucaaggcugagaggguuauagaccccagacgcugcaugaaaccagucauauuaacagacggugaagagcgggugaucuuggcaggacccaugccagugacccauucuagugcagcacaaagaagagggagaguaggaagaaauccaaaaaaugaaaaugaccaguacauauacaugggggaaccucuggaaaaugaugaagacugugcacacuggaaagaagcuaagaugcucuuggauaacaucaacacgccugaaggaaucauucccagcauguucgaaccagagcgugaaaagguggaugccauugauggugaauaccgcuugagaggagaagcgaggaaaacuuuuguggaccuaaugagaagaggagauuuaccagucuggcuagccuacagaguggcggcugaaggcaucaacuacgcagacagaagauggugcuuugauggagucaagaacaaccaaaucuuggaagaaaauguggaaguagaaauuuggacaaaagaaggagaaaggaagaaauuaaaacccagaugguuggaugcuaggaucuacucugacccauuggcgcucaaagaauucaaggaauucgcagcuggaagaaagucccugacccugaaucuaaucacagagauggguagacucccaacuuucaugacccagaaagcaaagaaugcacucgacaacuuagcaguccugcauacggcugaagcaggcggaagggcguacaaucaugcucuuagugaacugccggagacucuggagacauugcuuuuacugacacuuuuggccacagucacgggcggaaucuuccuguucuugaugagcggaaaggguauagggaagaugacccugggaaugugcugcauaaucacggcuaguauccucuuaugguaugcacaaauacagccacacuggauagcagcuucaauaauacuggaguuuuuucucauagucuugcucauuccagaaccagaaaaacagagaacaccccaagauaaccaguuaacuuauguugucauagccauccuuacaguaguggccgcaaccauggcaaacgagauggguuuccuggaaaaaacaaagaaagauuucggauugggaagcauuacaacccagcaaccugagaguaacauccuggacauagaucuacguccugcaucagcuuggacucuauaugccguggcaacaacuuucaucacaccaauguugaggcauagcauugaaaacuccucagugaaugugucccuaacagccauugccaaccaagccacaguguuaaugggucuugggaaaggauggccauugucaaaaauggacaucggaguuccccuucucgcuaucgggugcuauucacaagucaaccccauaacucucacugcagcccuucucuuauugguagcccauuaugccaucauagggccaggacuccaagcgaaagcaacuagagaggcucagaaaagagcagcagcgggcaucaugaaaaacccaacuguggauggaaugacagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcaaccgggcccaucucuacacugugggaaggaaauccagggagauuuuggaauacaacuauugcagugucaauggcuaacauuuuuagagggaguuaccuggccggagccggacuucucuuuucuaucaugaaaaacacggccaacacaagaaggggaacuggcaacacaggagagacgcuuggggagaaauggaaaaaccgguugaaugcauuagggaagagugaauuccagaucuacaagaaaaguggaauccaggaaguggacagaaccuuagcaaaagaaggcaucaaaagaggagaaacggaccaucacgcugugucgcgaggcucagcgaaacugagaugguucgucgagagaaaccuggucacaccagaagggaaaguaguggaccuuggcugcggcagggggggcuggucauacuauugugggggacuaaagaauguaaaagaagucaaaggccuaacaaaaggaggaccaggacacgaagaacccauucccaugucaacauaugguuggaaucuggugcgccuucaaaguggaguugauguuuuuuucacuccgccagaaaagugugacacacugcugugugacauaggggagucgucaccaaaccccacgguugaggcaggacgaacacucagaguucuaaacuuaguggaaaauuggcugaacaacaacacccaauuuugcauaaagguucuuaacccauacaugcccucaguuauagaaaaaauggaagcacuacaaaggaaauacggaggagcuuuggugaggaauccacucucacgaaauuccacacacgagauguacuggguauccaaugcuuccgggaauauagugucaucagugaacaugauuucaagaauguugauuaacagauucacaaugagacacaagaaagccacauacgagccagauguugaccucggaaguggaacccgcaacaucggaauugaaagugagacaccaaauuuagacauaauugggaaaagaauagaaaaaauaaaacaagagcaugaaacaucauggcacuaugaccaagaccacccauacaaaacgugggccuaccauggcagcuacgaaacaaaacagacuggaucagcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccgaaagaaggcacgaaaaaacuaaugaaaauuacugcagaauggcucuggaaagaacuaggaaagaaaaagacaccuaggaugugcaccagagaagaauucacaagaaaggugagaagcaaugcagcuuuaggugccauauucacugaugagaacaaguggaagucggcacgugaggcuguugaagacaguggauuuugggaauugguugacaaggaaaggaaucuccaucuugaaggaaagugugaaacauguguguauaacaugaugggaaagagagagaagaagcuaggggaguucggcaaagcaaaaggcagcagagccauaugguacauguggcuuggagcacgcuucuuagaguuugaagcucuaggauucuugaacgaagaucacugguuuuccagagagaacucccugaguggaguggaaggagaagggcuacacaagcuaggcuacauuuuaagagacgugaguaagaaagaaggaggagcaauguaugcugaugacaccgcaggaugggacacaagaaucacacuagaggacuuaaaaaaugaagaaauggugacaaaccacauggaaggagaacacaagaaacuugcugaagccauuuucaaauuaacguaccaaaacaagguggugcgugugcaaagaccaacaccaagaggcacaguaauggacauuauaucgagaagagaccaaagagguaguggacaaguugucaccuacggccucaauacuuucaccaauauggaagcccaacugaucagacagauggagggagaaggaguuuucaaaagcauccagcaacugacaguaaaagaagaaauugcagugaaaaacugguuaauaagaguggggcgugagagguuaucaagaauggccaucaguggagaugauuguguugugaaacccuuagaugacagguuugcaagugcucuaacagcucuaaaugacaugggaaagguuaggaaagacauacaacaaugggaaccuucaagaggauggaacgauuggacacaagugcccuuuuguucacaccauuuccaugaguuaaucaugaaggacggucgugugcucguaguuccaugcagaaaccaagaugaacugauuggcagggcccgaauuucccagggagccgggugguccuugcgggaaacagccugucuggggaaguccuacgcccaaauguggagccugauguacuuccacagacgugaccuuaggcuggcggcaaaugccauuugcucggcagucccaucacauuggauuccaacaagucgaacaaccugguccauacacgccacacaugaguggaugacaacagaagacauguugacagucuggaacaggguguggauucaagaaaacccauggauggaagacaaaacuccaguagaaucaugggaggaaaucccguauuuggggaaaagagaagaccaauggugcggcucauugauugggcuaacaagcagggccaccugggcaaagaacauucaaacagcaauaaaucaaguuagaucccuaauaggcaaugaggaauacacagacuacaugccaucuaugaaaagauucagaagagaagaggaagaggcaggagucuugugguag

SEQ ID NO: 6459 - RNA, 9876 nt, Artificial Sequence
  derived and/or modified CDS sequence (wt) from DENV-2__KM279569__SS-prME
acugcagguauaauuauuaugaugaucccaacagugauggcguuccauuuaaccacacgcaacggagaaccacacaugaucguuaguagacaagagaaagggaaaagucuccuguuuaaaacagagaacggugugaacauguguacccucauggccauggaccuuggugaacugugugaagacacaaucacuuauaauuguccucuucucaggcagaaugaaccagaagacauagacuguuggugcaacuccacgucuacauggguaacuuaugggacaugcaccgccacaggagaacacagaagggaaaaaagaucaguggcacucguuccacaugugggaaugggacuggagacacgaacugaaacauggaugucaucagaaggggccuggaaacaugcccagagaauugaaacuuggaucuugagacauccaggcuucaccauaauggcagcaauccuggcauacaccauaggaacaacauauuuccaaagaguccugauuuucauuuuacugacagcugucacuccuucaauggcaaugcguuguauaggaauaucaaauagagacuuuguggaagggguuucaggaggaagcuggguugauauagucuuggaacauggaagcugugugacgacgauggcgaaaaauaaaccaacgcuggauuuugaacugauaaaaacagaagccaaacaucucgccacucuaaggaaguauuguguagaggcaaagcugaccaacacaacaacagcaucucgcugcccaacacaaggagaaccuagccuaaaugaagaacaggacaaaagauucgucugcaaacacuccaugguagacagaggauggggaaauggaugcggauuauuuggaaagggaggcaucgugaccugugcaauguucacaugcaaaaagaacauggaaggaaaagucgugcaaccagaaaacuuggaguacaccaucgugauaacaccucacucaggggaagagaaugcagucggaaaugacacaggaaaacauggcaaggaaauuaaaguaacaccacagaguuccaucacagaagcagaacuaacaggcuacggcaccgucacgauggaaugcucuccgagaacgggccucgacuucaaugagaugguguugcugcaaauggaaaacaaggcuuggcuggugcacaggcaaugguucuuagaccugccguuaccauggcugcccggagcagacacacaaggaucaaauuggauacagaaggagacacuggucacuuucaaaaauccccaugcaaagaaacaggauguaguuguuuuagguucccaagaaggggccaugcacacggcacucacaggggccacggaaauccagaugucaucaggaaacuuacuguucacaggacaucuuaagugcaggcugagaauggacaaacuacagcucaaaggaaugucauauuccauguguacaggaaaguucaaaguugugaaggaaauagcagaaacacaacauggaacaauaguuauuagaguacaauaugaaggggacgguuccccgugcaagaucccuuuugaaauaauggacuuggaaaaaaggcaugucuuaggacgcuugauuaccgucaacccaauugucacagaaaaagacagcccagucaacauagaagcagaaccuccauuuggagacaguuacaucauuauaggaguagaaccaggacaacugaagcucagcugguuuaagaaaggaaguucuauuggccaaauguuugagacaacaaugagaggagcgaagagaauggccauucuaggugacacagcuugggauuuuggaucccugggaggaguguucacaucuauaggaaaggcccuccaccaagucuuuggagcuaucuauggggcugccuucagugggguuucauggacuaugaaaauccucauaggagucgucaucacauggauaggaaugaauucacgcagcaccucacugucugugucacuaguauuagugggggucgugacauuguauuugggaguuauggugcaggccgauagugggugcguugugaguuggaaaaacaaagaacugaaaugugguagugggauuuuuaucacagacaacgugcacacauggacagaacaauacaaauuccaaccagaauccccuucaaagcuggcuucagcuauccagaaggcucaugaagaaggcauuuguggaauccgcucaguaacaagacuggagaaucugauguggaaacaaauaacaccagaauugaaucacauucuaacagaaaaugaaguaaaguugacuaucaugacaggagacaucaaaggaaucaugcaggcaggaaaacgaacccugcggccucaacccacugagcugaaguacuccuggaaggcauggggcaaagcgaaaaugcuuuccacagagcuucauaaccacaccuuucucauugauggccccgaaacagcagaaugucccaacacaaacagagcuuggaacucacuagaaguugaagacuauggcuuuggaguauucaccacuaacauauggcugaaauugaaagaaaggcaggauguguuuugugacucaaaacucaugucagcagccauaaaggacaauagagccguccacgccgauauggguuauuggauagaaagcgcacucaaugacacauggaagauugagaaagccucuuuuauugaaguuaaaagcugccacuggccaaagucacacacucucuggaguaauggagugcuggaaagugagaugauaauuccaaagaauuuugcaggaccaguuucacaacacaauuacagaccaggcuaccacacacaaacagcaggacccuggcaucuagguaggcuugagauggacuuugauuucugcgaaggaaccacagugguggugacugaggacuguggaaauagaggacccuccuuaagaacaacuacugcuucuggaaaacucauaacagaguggugcugccgaucuugcacauuaccaccgcuaagguacagaggugaggauggaugcugguaugguauggaaaucaggccauugaaagagaaagaagagaaccuggucaacucuuuggucacagccggacauggacagauugacaacuucucacuaggagucuugggaauggcauuguuccuggaagagaugcucaggacucgaguaggaacgaaacaugcaauauuacuaguugcagucucuuucgugacauugaucacagggaacauguccuuucgagauuuggggagagugauggucauggugggcgcuacuaugacggaugacauaggcaugggcgugacuuaucuugcccuauuagcagccuuuaaagucagaccaaccuuugcggcuggacuacucuuaagaaagcugaccuccaaggaauugaugaugaccaccauaggaaucguacuccucucucagaguaccauaccagagagcauacuugaacugacugacgcguuggcuuuggggaugaugguucuuaaaauagugagaaacauggaaaaguaucagcuagcagugacuaucauggcaaucuugugcgucccaaaugcagugauauugcaaaaugcauggaaagugagcugcacaacacuggcagugguguccguuuccccacugcuuuuaacauccucacagcagaaagcggauuggauaccacuggcguugacgaucaaaggccucaauccaacagccauuuucuuaacaacucucucaagaacuagcaagaaaaggagcuggccacuaaaugaggcuauuauggcagucgggauggugagcauucuagcuaguucucucuuaaagaaugauauucccaugacaggaccauuaguggcuggagggcuucucacuguguguuacgugcucaccggaaggucggcugacuuggaacuggaaagagcugcugacguaagaugggaagaacaggcagagauaucaggaaguaguccaauucugucgauaacaauaucggaagaugguagcaugucgauaaagaaugaagaagaagaacagacacugaccauacucaucagaacaggacuacuggugauaucaggacuuuuuccugugucaauaccaaucacggcagcugcaugguaccuuugggaagugaaaaaacaacgagcaggaguauugugggaugucccuucacccccaccugugggaaaggccgaacuggaagauggagccuauagaaucaagcagaaagggauccuaggauacucacagauuggagccggaguuuacaaagaaggaacauuccacacaauguggcaugucacacguggugcuguccuaaugcauaaagggaagagaauugaaccaucaugggcggacgucaagaaagaccuaauaucguauggaggaggcuggaagcuggaaggagaauggaaggaaggagaagaaguccagguccuggcauuagagcccggaaagaauccaagagccguccaaacaaaacccggucuuuuuaaaaccaacacuggaaccauaggcgccgugucucuggacuuuucuccuggaacgucaggaucuccaaucgucgauaaaaaaggaaaaguugugggccuuuauggcaacggugucgucacaaggaguggaacauaugugagugccauagcccagacugaaaaaagcaucgaagacaauccagagauugaagaugacaucuuuagaaagaaaagauugaccaucauggaccuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagcuaucagagcugagcacacugggcgggagauuguggaucuaaugugucaugccacauuuaccaugaggcuauuaucaccaauuagagugccaaauuacaaccugaucaucauggaugaagcccauuucacagacccagcaagcauagcagcuagaggauacauuucaacucgaguagagaugggugaagcagcugggauuuucaugacagccaccccuccuggaagcagagacccauuuccccagagcaacgcaccaaucauggaugaagaaaaagaaaucccugagcguucguggaacucuggacaugaguggguuacggauuuuaaagggaagacuguuugguuuguuccaaguauaaaagcagggaaugauauagcagcuugccugagaaagaauggaaagaaagugauacaacucagcaggaaaacuuuugauucugaauauaucaagacuaggaccaaugauugggacuuuguggucacgacagacauuucagaaaugggugcuaacuucaaggcugagaggguuauagaccccagacgcugcaugaaaccagucauauuaacagacggugaagagcgggugaucuuggcaggacccaugccagugacccauucuagugcagcacaaagaagagggagaguaggaagaaauccaaaaaaugaaaaugaccaguacauauacaugggggaaccucuggaaaaugaugaagauugugcacacuggaaagaagcuaagaugcucuuggauaacauuaacacgccugaaggaaucauucccagcauguucgaaccagagcgugaaaagguggaugccauugauggugaauaccgcuugagaggagaagcgaggaaaacuuuuguggaccuaaugagaagaggagauuuaccagucuggcuagccuacagaguggcggcugaaggcaucaacuacgcagacagaagauggugcuuugauggagucaagaacaaccaaaucuuggaagaaaauguggaaguagaaauuuggacaaaagaaggagaaaggaagaaauuaaaacccagaugguuggaugcuaggaucuacucugacccauuggcgcucaaagaauucaaggaauucgcagcuggaagaaagucccugacccugaaucuaaucacagagauggguagacucccaaccuucaugacccagaaagcaaagaaugcacucgacaacuuagcaguccugcauacggcugaagcaggcggaagggcguacaaucaugcucuuagugaacugccggagacucuggagacauugcuuuuacugacacuuuuggccacagucacgggcggaaucuuccuguucuugaugagcggaaaagguauagggaagaugacccugggaaugugcugcauaaucacggcuaguauccucuuaugguaugcacaaauacagccacacuggauagcagcuucaauaauacuggaguuuuuucucauagucuugcucauuccagaaccagaaaaacagagaacaccccaagauaaccaguuaacuuauguugucauagccauccuuacaguaguggccgcaaccauggcaaacgagauggguuuccuggaaaaaacaaagaaagauuucggauugggaagcauuacaacccagcaaccugagaguaacauccuggacauagaucuacguccugcaucagcuuggacucuauaugccguggcaacaacuuucaucacaccaauguugaggcauagcauugaaaacuccucagugaaugugucccuaacagccauugccaaccaagccacaguguuaaugggucuugggaaaggauggccauugucaaaaauggacaucggaguuccccuucucgcuaucgggugcuauucacaagucaaccccauaacucucacugcagcccuucucuuauugguagcccauuaugccaucauagggccaggacuccaagcgaaagcaacuagagaggcucagaaaagagcagcagcgggcaucaugaaaaacccaacuguggauggaaugacagugauugaccuagauccaauacccuaugauccaaaguuugaaaagcaguugggacaaguaaugcucuuaguccucugcgugacccaaguauugaugaugaggacuacaugggcuuuaugugaagcucuaaccuuagcaaccgggcccaucucuacacugugggaaggaaauccagggagauuuuggaauacaacuauugcagugucaauggcuaacauuuuuagagggaguuaccuggccggagccggacuucucuuuucuaucaugaaaaacacggccaacacaagaaggggaacuggcaacacaggagagacgcuuggggagaaauggaaaaaccgguugaaugcauuagggaagagugaauuccagaucuacaagaaaaguggaauccaggaaguggacagaaccuuagcaaaagaaggcaucaaaagaggagaaacggaccaucacgcugugucgcgaggcucagcgaaacugagaugguucgucgagagaaaccuggucacaccagaagggaaaguaguggaccuuggcugcggcagggggggcuggucauacuauugugggggacuaaagaauguaaaagaagucaaaggccuaacaaaaggaggaccaggacacgaagaacccauucccaugucaacauaugguuggaaucuggugcgccuucaaaguggaguugauguuuucuucacuccgccagaaaagugugacacacugcugugugacauaggggagucgucaccaaaccccacgguugaggcaggacgaacacucagaguucuaaacuuaguggaaaauuggcugaacaacaacacccaauuuugcauaaagguucuuaacccauacaugcccucaguuauagaaaaaauggaagcacuacaaaggaaauacggaggagcuuuggugaggaauccacucucacgaaauuccacacacgagauguacuggguauccaaugcuuccgggaauauagugucaucagugaacaugauuucaagaauguugauuaacagauucacaaugagacacaagaaagccacauacgagccagauguugaccucggaaguggaacccgcaacaucggaauugaaagugagacaccaaauuuagacauaauugggaaaagaauagaaaaaauaaaacaagagcaugaaacaucauggcacuaugaccaagaccacccauacaaaacgugggccuaccauggcagcuacgaaacaaaacagacuggaucagcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccgaaagaaggcacgaaaaaacuaaugaaaauuacugcagaauggcucuggaaagaacuaggaaagaaaaagacaccuaggaugugcaccagagaagaauucacaagaaaggugagaagcaaugcagccuuaggugccauauucacugaugagaacaaguggaagucggcacgugaggcuguugaagacaguggauuuugggaauugguugacaaggaaaggaaucuccaucuugaaggaaagugugaaacaugcguguauaacaugaugggaaagagagagaagaagcuaggggaguucggcaaagcaaaaggcagcagagccauaugguacauguggcuuggagcacgcuucuuagaguuugaagcucuaggauucuugaacgaagaucacugguuuuccagagagaacucccugaguggaguggaaggagaagggcuacacaagcuaggcuacauuuuaagagacgugaguaagaaagaaggaggagcaauguaugcugaugacaccgcaggaugggacacaagaaucacacuagaggacuugaaaaaugaagaaauggugacaaaccacauggaaggagaacacaagaaacuugcugaagccauuuucaaauuaacguaccaaaacaagguggugcgugugcaaagaccaacaccaagaggcacaguaauggacauuauaucgagaagagaccaaagagguaguggacaaguugucaccuacggccucaauacuuucaccaauauggaagcccaacugaucagacagauggagggagaaggaguuuucaaaagcauccagcaacugacaguaaaagaagaaauugcagugaaagacugguuaauaagaguggggcgugagagguuaucaagaauggccaucaguggagaugauuguguugugaaacccuuagaugacagguuugcaagugcucuaacagcucuaaaugacaugggaaagguuaggaaagacauacaacaaugggaaccuucaagaggauggaacgauuggacacaagugcccuuuuguucacaccauuuccaugaguuaaucaugaaggacggucgugugcucguaguuccaugcagaaaccaagaugaacugauuggcagggcccgaauuucccagggagccgggugguccuugcgggaaacagccugucuggggaaguccuacgcccaaauguggagccugauguacuuccacagacgugaccuuaggcuggcggcaaaugccauuugcucggcagucccaucacauuggauuccaacaagucgaacaaccugguccauacacgccacacaugaguggaugacaacagaagacauguugacagucuggaacaggguguggauucaagaaaacccauggauggaagacaaaacuccaguagaaucaugggaggaaaucccguauuuggggaaaagagaagaccaauggugcggcucauugauugggcuaacaagcagggccaccugggcaaagaacauccaaacagcaauaaaucaaguuagaucccuaauaggcaaugaggaauacacagacuacaugccaucuaugaaaagauucagaagagaagaggaagaggcaggagucuugugguag

SEQ ID NO: 6460 - RNA, 9876 nt, Artificial Sequence
  derived and/or modified CDS sequence (wt) from DENV-2__KM279570__SS-prME
acugcagguauaauuauuaugaugaucccaacagugauggcguuccauuuaaccacacgcaacggagaaccacacaugaucguuaguagacaagagaaagggaaaagucuccuguuuaaaacagagaacggugugaacauguguacccucauggccauggaccuuggugaacugugugaagacacaaucacuuauaauuguccucuucucaggcagaaugaaccagaagacauagacuguuggugcaacuccacgucuacauggguaacuuaugggacaugcaccgccacaggagaacacagaagggaaaaaagaucaguggcacucguuccacaugugggaaugggacuggagacacgaacugaaacauggaugucaucagaaggggccuggaaacaugcccagagaauugaaacuuggauccugagacauccaggcuucaccauaauggcagcaauccuggcauacaccauaggaacaacauauuuccaaagaguccugauuuucauuuuacugacagcugucacuccuucaauggcaaugcguuguauaggaauaucaaauagagacuuuguggaagggguuucaggaggaagcuggguugauauagucuuggaacauggaagcugugugacgacgauggcgaaaaauaaaccaacguuggauuuugaacugauaaaaacagaagccaaacaucucgccacucuaaggaaguauuguguagaggcaaagcugaccaauacaacaacagcaucucguugcccaacacaaggagaaccuagccuaaacgaagaacaggacaaaagauucgucugcaaacacuccaugguagacagaggauggggaaauggaugcggauuauuuggaaagggaggcaucgugaccugugcaauguucacaugcaaaaagaacauggaaggaaaagucgugcaaccagaaaacuuggaguacaccaucgugauaacaccucacucaggggaagagaaugcagucggaaaugacacaggaaaacauggcaaggaaauuaaaguaacaccacagaguuccaucacagaagcagaacuaacaggcuacggcacugucacgauggaaugcucuccgagaacgggccucgacuucaaugagaugguguugcugcaaauggaaaacaaggcuuggcuggugcacaggcaaugguucuuagaccugccguuaccauggcugcccggagcagacacacaaggaucaaauuggauacagaaggagacacuggucacuuucaaaaauccccaugcaaagaaacaggauguuguuguuuuagguucccaagaaggggccaugcacacggcacucacaggggccacggaaauccagaugucaucaggaaacuuacuguucacaggacaucuuaagugcaggcugagaauggacaaacuacagcucaaaggaaugucauauuccauguguacaggaaaguucaaaguugugaaggaaauagcagaaacacaacauggaacaauaguuauuagaguacaauaugaaggggacgguuccccgugcaagaucccuuuugaaauaauggacuuggaaaaaaggcaugucuuaggucgcuugauuaccgucaacccaauugucacagaaaaagacagcccagucaacauagaagcagaaccuccauuuggagacaguuacaucauuauaggaguagaaccaggacaacugaagcucagcugguuuaagaaaggaaguucuauuggccaaauguuugagacaacaaugagaggagcgaagagaauggccauucuaggugacacagcuugggauuuuggaucccugggaggaguguucacaucuauaggaaaggcccuccaccaagucuuuggagcuaucuauggggcugccuucagugggguuucauggacuaugaaaauccucauaggagucgucaucacauggauaggaaugaauucacgcagcacuucacugucugugucacuaguauuagugggggucgugacauuguauuugggaguuauggugcaggccgauagugggugcguugugaguuggaaaaacaaagaacugaaaugugguagugggauuuuuaucacagacaacgugcacacauggacagaacaauacaaauuccaaccagaauccccuucaaagcuggcuucagcuauccagaaggcucaugaagaaggcauuuguggaauccgcucagugacaagacuggagaaucugauguggaaacaaauaacaccagaauugaaucacauucuaacagaaaaugaaguaaaguugacuaucaugacaggagacaucaaaggaaucaugcaggcaggaaaacgaucccugcggccucaacccacugagcugaaguacuccuggaaggcauggggcaaagcgaaaaugcuuuccacagagcuucauaaccacaccuuucucauugauggccccgaaacagcagaaugucccaacacaaacagagcuuggaacucacuagaaguugaagacuauggcuuuggaguauucaccacuaacauauggcugaaauugaaagaaaggcaggauguguuuugugacucaaaacucaugucagcagccauaaaggacaauagagccguccacgccgauauggguuauuggauagaaagcgcacucaacgacacauggaagauugagaaagccucuuuuauugaaguuaaaagcugccacuggccaaagucacacacucucuggaguaauggagugcuggaaagugagaugauaauuccaaagaauuuugcaggaccaguuucacaacacaauuacagaccaggcuaccacacacaaacggcaggacccuggcaucuagguaggcuugagauggacuuugauuucugcgaaggaaccacaguggcggugacugaggacuguggaaauagaggacccuccuuaagaacaacuacugcuucuggaaaacucauaacagaguggugcugccgaucuugcacauuaccaccgcuaagguacagaggugaggauggaugcugguaugguauggaaaucaggccauugaaagagaaagaagagaaccuggucaacucuuuggucacagccggacauggacagauugacaacuucucacuaggagucuugggaauggcauuguuccuggaagagaugcucaggacucgaguaggaacgaaacaugcaauauuacuaguugcagucucuuucgugacauugaucacagggaacauguccuuucgagauuuggggagagugauggucauggugggcgcuacuaugacggaugacauaggcaugggcgugacuuaucuugcccuauuagcagccuuuaaagucagaccaaccuuugcggcuggacuacucuuaagaaagcugaccuccaaggaauugaugaugaccaccauaggaaucguacuccucucucagaguaccauaccagagagcauacuugaacugacugacgcguuggcuuuggggaugaugguucucaaaauagugagaaacauggaaaaguaucagcuagcagugacuaucauggcaaucuugugcgucccaaaugcagugauauugcaaaaugcauggaaagugagcugcacaacacuggcagugguguccguuuccccacugcuuuuaacauccucacagcagaaagcggauuggauaccacuggcguugacgaucaaaggccucaauccaacagccauuuucuuaacaacucucucaagaacuagcaagaaaaggagcuggccacuaaaugaggcuauuauggcagucgggauggugagcauucuagcuaguucucucuuaaagaaugauauucccaugacaggaccauuaguggcuggagggcuucucacuguguguuacgugcucacuggaaggucggcugacuuggaacuggaaagagcugcugacguaagaugggaagaacaggcagagauaucaggaaguaguccaauucugucgauaacaauaucggaagaugguagcaugucgauaaagaaugaagaagaagaacagacacugaccauacucaucagaacaggacuacuggugauaucaggacuuuuuccugugucaauaccaaucacggcagcugcaugguaccuuugggaagugaaaaaacaacgagcaggaguauugugggaugucccuucacccccaccugugggaaaggccgaacuggaagauggagccuauagaaucaagcagaaagggauccuaggauacucacagauuggagccggaguuuacaaagaaggaacauuccacacaauguggcaugucacacguggugcuguccuaaugcauaaagggaagagaauugaaccaucaugggcggacgucaagaaagaccuaauaucguauggaggaggcuggaagcuggaaggagaauggaaggaaggagaagaaguccagguccuggcauuagagccuggaaagaauccaagagccguccaaacaaaacccggccuuuuuaaaaccaacacuggaaccauaggcgccgugucucuggacuuuucuccuggaacgucaggaucuccaaucgucgauaaaaaaggaaaaguugugggccucuauggcaacggugucgucacaaggaguggaacauaugugagugccauagcccagacugaaaaaagcaucgaagacaauccagagauugaagaugacaucuuuagaaagaaaagauugaccaucauggaccuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagcuaucagagcugagcacacugggcgggagauuguggaucugaugugucaugccacauuuaccaugaggcuauuaucaccaauuagagugccaaauuacaaccugaucaucauggaugaagcccauuucacagacccagcaagcauagcagcuagaggauacauuucaacucgaguagagaugggugaagcagcugggauuuucaugacagccaccccuccuggaagcagagacccauuuccccagagcaacgcaccaaucauggaugaagaaagagaaaucccugagcguucguggaacucuggacaugaguggguuacggauuuuaaagggaagacuguuugguuuguuccaaguauaaaagcagggaaugauauagcagcuugccugagaaagaauggaaagaaagugauacaacucagcaggaaaacuuuugauucugaauauaucaagacuaggaccaaugauugggacuuuguggucacgacagacauuucagaaaugggugcuaacuucaaggcugagaggguuauagaccccagacgcugcaugaaaccagucauauuaacagacggugaagaacgggugaucuuggcaggacccaugccagugacccauucuagugcagcacaaagaagagggagaguaggaagaaauccaaaaaaugaaaaugaccaguacauauacaugggggaaccucuggaaaaugaugaagacugugcacacuggaaagaagcuaagaugcucuuggauaacaucaacacgccugaaggaaucauucccagcauguucgaaccagagcgugaaaagguggaugccauugauggugaauaccgcuugagaggagaagcgaggaaaacuuuuguggaccuaaugagaagaggagauuuaccagucuggcuagccuacagaguggcggcugaaggcaucaacuacgcagacagaagauggugcuuugauggagucaagaacaaccaaaucuuggaagaaaauguggaaguagaaauuuggacaaaagaaggagaaaggaagaaauuaaaacccagaugguuggaugcuaggaucuacucugacccauuggcgcucaaagaauucaaggaauucgcagcuggaagaaagucccugacccugaaucuaaucacagagauggguagacucccaaccuucaugacccagaaagcaaagaaugcacucgacaacuuagcaguccugcauacggcugaagcaggcggaagggcguacaaucaugcucuuagugaacugccggagacucuggaaacauugcuuuuacugacacuuuuggccacagucacgggcggaaucuuccuguucuugaugagcggaaaggguauagggaagaugacccugggaauguguugcauaaucacggcuaguauccucuuaugguaugcacaaauacagccacacuggauagcagccucaauaauacuggaguuuuuucucauagucuugcucauuccagaaccagaaaaacagagaacaccccaagauaaccaguuaacuuauguugucauagccauccuuacaguaguggccgcaaccauggcaaacgagauggguuuccuggaaaaaacaaagaaagauuucggauugggaagcauuacaacccagcaaccugagaguaacauccuggacauagaucuacguccugcaucagcuuggacucuauaugccguggcaacaacuuucaucacaccaauguugaggcauagcauugaaaacuccucagugaaugugucccuaacagccauugccaaccaagccacaguguuaaugggucuugggaaaggauggccauugucaaaaauggacaucggaguuccccuucucgcuaucgggugcuauucacaagucaaccccauaacucucacugcagcccuccucuuauugguagcccauuaugccaucauagggccaggacuccaagcgaaagcaacuagagaggcucagaaaagagcagcagcgggcaucaugaaaaacccaacuguggauggaaugacagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcaaccgggcccaucucuacacugugggaaggaaauccagggagauuuuggaauacaacuauugcagugucaauggcuaacauuuuuagagggaguuaccuggccggagccggacuucucuuuucuaucaugaaaaacacggccaacacaagaaggggaacuggcaacacaggagagacgcuuggggagaaauggaaaaaccgguugaaugcauuagggaagagugaauuccagaucuacaagaaaaguggaauccaggaaguggacagaaccuuagcaaaagaaggcaucaaaagaggagaaacggaccaucacgcugugucgcgaggcucagcgaaacugagaugguucgucgagagaaaccuggucacaccagaagggaaaguaguggaccuuggcugcggcagggggggcuggucauacuauugugggggacuaaagaauguaaaagaagucaaaggccuaacaaaaggaggaccaggacacgaagaacccauucccaugucaacauaugguuggaaucuggugcgccuucaaaguggaguugauguuuuuuuuacuccgccagaaaagugugacacacugcugugugacauaggggagucgucaccaaaccccacgguugaggcaggacgaacacucagaguucuaaacuuaguggaaaauuggcugaacaacaacacccaauuuugcauaaagguucuuaacccauacaugcccucaguuauagaaaaaauggaagcacuacaaaggaaauacggaggagcuuuggugaggaauccacucucacgaaauuccacacacgagauguacuggguauccaaugcuuccgggaauauagugucaucagugaacaugauuucaagaauguugauuaacagauucacaaugagacacaagaaagccacauacgagccagauguugaccucggaaguggaacccgcaacaucggaauugaaagugagacaccaaauuuagacauaauugggaaaagaauagaaaaaauaaaacaagagcaugaaacaucauggcacuaugaccaagaccacccauacaaaacgugggccuaccauggcagcuacgaaacaaaacagacuggaucagcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccgaaagaaggcacgaaaaaacuaaugaaaauuacugcagaauggcucuggaaagaacuaggaaagaaaaagacaccuaggaugugcaccagagaagaauucacaagaaaggugagaagcaaugcagccuuaggugccauauucacugaugagaacaaguggaagucggcacgugaggcuguugaagacaguggauuuugggaauugguugacaaggaaaggaaucuccaucuugaaggaaagugugaaacauguguguauaacaugaugggaaagagagagaagaagcuaggggaguucggcaaagcaaaaggcagcagagccauaugguacauguggcuuggagcacgcuucuuagaguuugaagcucuaggauucuugaacgaagaucacugguuuuccagagagaacucccugaguggaguggaaggagaagggcuacacaagcuaggcuacauuuuaagagacgugaguaagaaagaaggaggagcaauguaugcugaugacaccgcaggaugggacacaagaaucacacuagaggacuuaaaaaaugaagaaauggugacaaaccacauggaaggagaacacaagaaacuugcugaagccauuuucaaauuaacguaccaaaacaagguggugcgugugcaaagaccaacaccaagaggcacaguaauggacauuauaucgagaagagaccaaagagguaguggacaaguugucaccuacggccucaauacuuucaccaauauggaagcccaacugaucagacagauggagggagaaggaguuuucaaaagcauccagcaacugacaguaaaagaagaaauugcagugaaaaacugguuaauaagaguggggcgugagagguuaucaagaauggccaucaguggagaugauuguguugugaaacccuuagaugacagguuugcaagugcucuaacagcucuaaaugacaugggaaagguuaggaaagacauacaacaaugggaaccuucaagaggauggaacgauuggacacaagugcccuuuuguucacaccauuuccaugaguuaaucaugaaggacggucgugugcucguaguuccaugcagaaaccaagaugaacugauuggcagggcccgaauuucccagggagccgggugguccuugcgggaaacagccugucuggggaaguccuacgcccaaauguggagccugauguacuuccacagacgugaccuuaggcuggcggcaaaugccauuugcucggcagucccaucacauuggauuccaacaagucgaacaaccugguccauacacgccacacaugaguggaugacaacagaagacauguugacagucuggaacaggguguggauucaagaaaacccauggauggaagacaaaacuccaguagaaucaugggaggaaaucccguauuuggggaaaagagaagaccaauggugcggcucauugauugggcuaacaagcagggccaccugggcaaagaacauccaaacagcaauaaaucaaguuagaucccuaauaggcaaugaggaauacacagacuacaugccaucuaugaaaagauucagaagagaagaggaagaggcaggagucuugugguag

SEQ ID NO: 6461 - RNA, 9876 nt, Artificial Sequence
  derived and/or modified CDS sequence (wt) from DENV-2__KM279596__SS-prME
acugcagguauaauuauuaugaugaucccaacagugauggcguuccauuuaaccacacgcaacggagaaccacacaugaucguuaguagacaagagaaagggaaaagucuccuguuuaaaacagagaacggugugaacauguguacccucauggccauggaccuuggugaacugugugaagacacaaucacuuauaauuguccucuucucaggcagaaugaaccagaagacauagacuguuggugcaacuccacgucuacauggguaacuuaugggacaugcaccgccacaggagaacacagaagggaaaaaagaucaguggcacucguuccacaugugggaaugggacuggagacacgaacugaaacauggaugucaucagaaggggccuggaaacaugcccagagaauugaaacuuggauccugagacauccaggcuucaccauaauggcagcaauccuggcauacaccauaggaacaacauauuuccaaagaguccugauuuucauuuuacugacagcugucacuccuucaauggcaaugcguuguauaggaauaucaaauagagacuuuguggaagggguuucaggaggaagcuggguugauauagucuuggaacauggaagcugugugacgacgauggcgaaaaauaaaccaacguuggauuuugaacugauaaaaacagaagccaaacaucucgccacucuaaggaaguauuguguagaggcaaagcugaccaauacaacaacagcaucucguugcccaacacaaggagaaccuagccuaaacgaagaacaggacaaaagauucgucugcaaacacuccaugguagacagaggauggggaaauggaugcggauuauuuggaaagggaggcaucgugaccugugcaauguucacaugcaaaaagaacauggaaggaaaagucgugcaaccagaaaacuuggaguacaccaucgugauaacaccucacucaggggaagagaaugcagucggaaaugacacaggaaaacauggcaaggaaauuaaaguaacaccacagaguuccaucacagaagcagaacuaacaggcuacggcacugucacgauggaaugcucuccgagaacgggccucgacuucaaugagaugguguugcugcaaauggaaaacaaggcuuggcuggugcacaggcaaugguucuuagaccugccguuaccauggcugcccggagcagacacacaaggaucaaauuggauacagaaggagacacuggucacuuucaaaaauccccaugcaaagaaacaggauguuguuguuuuagguucccaagaaggggccaugcacacggcacucacaggggccacggaaauccagaugucaucaggaaacuuacuguucacaggacaucuuaagugcaggcugagaauggacaaacuacagcucaaaggaaugucauauuccauguguacaggaaaguucaaaguugugaaggaaauagcagaaacacaacauggaacaauaguuauuagaguacaauaugaaggggacgguuccccgugcaagaucccuuuugaaauaauggacuuggaaaaaaggcaugucuuaggucgcuugauuaccgucaacccaauugucacagaaaaagacagcccagucaacauagaagcagaaccuccauuuggagacaguuacaucauuauaggaguagaaccaggacaacugaagcucagcugguuuaagaaaggaaguucuauuggccaaauguuugagacaacaaugagaggagcgaagagaauggccauucuaggugacacagcuugggauuuuggaucccugggaggaguguucacaucuauaggaaaggcccuccaccaagucuuuggagcuaucuauggggcugccuucagugggguuucauggacuaugaaaauccucauaggagucgucaucacauggauaggaaugaauucacgcagcacuucacugucugugucacuaguauuagugggggucgugacauuguauuugggaguuauggugcaggccgauagugggugcguugugaguuggaaaaacaaagaacugaaaugugguagugggauuuuuaucacagacaacgugcacacauggacagaacaauacaaauuccaaccagaauccccuucaaagcuggcuucagcuauccagaaggcucaugaagaaggcauuuguggaauccgcucagugacaagacuggagaaucugauguggaaacaaauaacaccagaauugaaucacauucuaacagaaaaugaaguaaaguugacuaucaugacaggagacaucaaaggaaucaugcaggcaggaaaacgaucccugcggccucaacccacugagcugaaguacuccuggaaggcauggggcaaagcgaaaaugcuuuccacagagcuucauaaccacaccuuucucauugauggccccgaaacagcagaaugucccaacacaaacagagcuuggaacucacuagaaguugaagacuauggcuuuggaguauucaccacuaacauauggcugaaauugaaagaaaggcaggauguguuuugugacucaaaacucaugucagcagccauaaaggacaauagagccguccacgccgauauggguuauuggauagaaagcgcacucaacgacacauggaagauugagaaagccucuuuuauugaaguuaaaagcugccacuggccaaagucacacacucucuggaguaauggagugcuggaaagugagaugauaauuccaaagaauuuugcaggaccaguuucacaacacaauuacagaccaggcuaccacacacaaacggcaggacccuggcaucuagguaggcuugagauggacuuugauuucugcgaaggaaccacaguggcggugacugaggacuguggaaauagaggacccuccuuaagaacaacuacugcuucuggaaaacucauaacagaguggugcugccgaucuugcacauuaccaccgcuaagguacagaggugaggauggaugcugguaugguauggaaaucaggccauugaaagagaaagaagagaaccuggucaacucuuuggucacagccggacauggacagauugacaacuucucacuaggagucuugggaauggcauuguuccuggaagagaugcucaggacucgaguaggaacgaaacaugcaauauuacuaguugcagucucuuucgugacauugaucacagggaacauguccuuucgagauuuggggagagugauggucauggugggcgcuacuaugacggaugacauaggcaugggcgugacuuaucuugcccuauuagcagccuuuaaagucagaccaaccuuugcggcuggacuacucuuaagaaagcugaccuccaaggaauugaugaugaccaccauaggaaucguacuccucucucagaguaccauaccagagagcauacuugaacugacugacgcguuggcuuuggggaugaugguucucaaaauagugagaaacauggaaaaguaucagcuagcagugacuaucauggcaaucuugugcgucccaaaugcagugauauugcaaaaugcauggaaagugagcugcacaacacuggcagugguguccguuuccccacugcuuuuaacauccucacagcagaaagcggauuggauaccacuggcguugacgaucaaaggccucaauccaacagccauuuucuuaacaacucucucaagaacuagcaagaaaaggagcuggccacuaaaugaggcuauuauggcagucgggauggugagcauucuagcuaguucucucuuaaagaaugauauucccaugacaggaccauuaguggcuggagggcuucucacuguguguuacgugcucacuggaaggucggcugacuuggaacuggaaagagcugcugacguaagaugggaagaacaggcagagauaucaggaaguaguccaauucugucgauaacaauaucggaagaugguagcaugucgauaaagaaugaagaagaagaacagacacugaccauacucaucagaacaggacuacuggugauaucaggacuuuuuccugugucaauaccaaucacggcagcugcaugguaccuuugggaagugaaaaaacaacgagcaggaguauugugggaugucccuucacccccaccugugggaaaggccgaacuggaagauggagccuauagaaucaagcagaaagggauccuaggauacucacagauuggagccggaguuuacaaagaaggaacauuccacacaauguggcaugucacacguggugcuguccuaaugcauaaagggaagagaauugaaccaucaugggcggacgucaagaaagaccuaauaucguauggaggaggcuggaagcuggaaggagaauggaaggaaggagaagaaguccagguccuggcauuagagccuggaaagaauccaagagccguccaaacaaaacccggccuuuuuaaaaccaacacuggaaccauaggcgccgugucucuggacuuuucuccuggaacgucaggaucuccaaucgucgauaaaaaaggaaaaguugugggccucuauggcaacggugucgucacaaggaguggaacauaugugagugccauagcccagacugaaaaaagcaucgaagacaauccagagauugaagaugacaucuuuagaaagaaaagauugaccaucauggaccuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagcuaucagagcugagcacacugggcgggagauuguggaucugaugugucaugccacauuuaccaugaggcuauuaucaccaauuagagugccaaauuacaaccugaucaucauggaugaagcccauuucacagacccagcaagcauagcagcuagaggauacauuucaacucgaguagagaugggugaagcagcugggauuuucaugacagccaccccuccuggaagcagagacccauuuccccagagcaacgcaccaaucauggaugaagaaagagaaaucccugagcguucguggaacucuggacaugaguggguuacggauuuuaaagggaagacuguuugguuuguuccaaguauaaaagcagggaaugauauagcagcuugccugagaaagaauggaaagaaagugauacaacucagcaggaaaacuuuugauucugaauauaucaagacuaggaccaaugauugggacuuuguggucacgacagacauuucagaaaugggugcuaacuucaaggcugagaggguuauagaccccagacgcugcaugaaaccagucauauuaacagacggugaagaacgggugaucuuggcaggacccaugccagugacccauucuagugcagcacaaagaagagggagaguaggaagaaauccaaaaaaugaaaaugaccaguacauauacaugggggaaccucuggaaaaugaugaagacugugcacacuggaaagaagcuaagaugcucuuggauaacaucaacacgccugaaggaaucauucccagcauguucgaaccagagcgugaaaagguggaugccauugauggugaauaccgcuugagaggagaagcgaggaaaacuuuuguggaccuaaugagaagaggagauuuaccagucuggcuagccuacagaguggcggcugaaggcaucaacuacgcagacagaagauggugcuuugauggagucaagaacaaccaaaucuuggaagaaaauguggaaguagaaauuuggacaaaagaaggagaaaggaagaaauuaaaacccagaugguuggaugcuaggaucuacucugacccauuggcgcucaaagaauucaaggaauucgcagcuggaagaaagucccugacccugaaucuaaucacagagauggguagacucccaaccuucaugacccagaaagcaaagaaugcacucgacaacuuagcaguccugcauacggcugaagcaggcggaagggcguacaaucaugcucuuagugaacugccggagacucuggaaacauugcuuuuacugacacuuuuggccacagucacgggcggaaucuuccuguucuugaugagcggaaaggguauagggaagaugacccugggaauguguugcauaaucacggcuaguauccucuuaugguaugcacaaauacagccacacuggauagcagccucaauaauacuggaguuuuuucucauagucuugcucauuccagaaccagaaaaacagagaacaccccaagauaaccaguuaacuuauguugucauagccauccuuacaguaguggccgcaaccauggcaaacgagauggguuuccuggaaaaaacaaagaaagauuucggauugggaagcauugcaacccagcaaccugagaguaacauccuggacauagaucuacguccugcaucagcuuggacucuauaugccguggcaacaacuuucaucacaccaauguugaggcauagcauugaaaacuccucagugaaugugucccuaacagccauugccaaccaagccacaguguuaaugggucuugggaaaggauggccauugucaaaaauggacaucggaguuccccuucucgcuaucgggugcuauucacaagucaaccccauaacucucacugcagcccuccucuuauugguagcccauuaugccaucauagggccaggacuccaagcgaaagcaacuagagaggcucagaaaagagcagcagcgggcaucaugaaaaacccaacuguggauggaaugacagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcaaccgggcccaucucuacacugugggaaggaaauccagggagauuuuggaauacaacuauugcagugucaauggcuaacauuuuuagagggaguuaccuggccggagccggacuucucuuuucuaucaugaaaaacacggccaacacaagaaggggaacuggcaacacaggagagacgcuuggggagaaauggaaaaaccgguugaaugcauuagggaagagugaauuccagaucuacaagaaaaguggaauccaggaaguggacagaaccuuagcaaaagaaggcaucaaaagaggagaaacggaccaucacgcugugucgcgaggcucagcgaaacugagaugguucgucgagagaaaccuggucacaccagaagggaaaguaguggaccuuggcugcggcagggggggcuggucauacuauugugggggacuaaagaauguaaaagaagucaaaggccuaacaaaaggaggaccaggacacgaagaacccauucccaugucaacauaugguuggaaucuggugcgccuucaaaguggaguugauguuuuuuuuacuccgccagaaaagugugacacacugcugugugacauaggggagucgucaccaaaccccacgguugaggcaggacgaacacucagaguucuaaacuuaguggaaaauuggcugaacaacaacacccaauuuugcauaaagguucuuaacccauacaugcccucaguuauagaaaaaauggaagcacuacaaaggaaauacggaggagcuuuggugaggaauccacucucacgaaauuccacacacgagauguacuggguauccaaugcuuccgggaauauagugucaucagugaacaugauuucaagaauguugauuaacagauucacaaugagacacaagaaagccacauacgagccagauguugaccucggaaguggaacccgcaacaucggaauugaaagugagacaccaaauuuagacauaauugggaaaagaauagaaaaaauaaaacaagagcaugaaacaucauggcacuaugaccaagaccacccauacaaaacgugggccuaccauggcagcuacgaaacaaaacagacuggaucagcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccgaaagaaggcacgaaaaaacuaaugaaaauuacugcagaauggcucuggaaagaacuaggaaagaaaaagacaccuaggaugugcaccagagaagaauucacaagaaaggugagaagcaaugcagccuuaggugccauauucacugaugagaacaaguggaagucggcacgugaggcuguugaagacaguggauuuugggaauugguugacaaggaaaggaaucuccaucuugaaggaaagugugaaacauguguguauaacaugaugggaaagagagagaagaagcuaggggaguucggcaaagcaaaaggcagcagagccauaugguacauguggcuuggagcacgcuucuuagaguuugaagcucuaggauucuugaacgaagaucacugguuuuccagagagaacucccugaguggaguggaaggagaagggcuacacaagcuaggcuacauuuuaagagacgugaguaagaaagaaggaggagcaauguaugcugaugacaccgcaggaugggacacaagaaucacacuagaggacuuaaaaaaugaagaaauggugacaaaccacauggaaggagaacacaagaaacuugcugaagccauuuucaaauuaacguaccaaaacaagguggugcgugugcaaagaccaacaccaagaggcacaguaauggacauuauaucgagaagagaccaaagagguaguggacaaguugucaccuacggccucaauacuuucaccaauauggaagcccaacugaucagacagauggagggagaaggaguuuucaaaagcauccagcaacugacaguaaaagaagaaauugcagugaaaaacugguuaauaagaguggggcgugagagguuaucaagaauggccaucaguggagaugauuguguugugaaacccuuagaugacagguuugcaagugcucuaacagcucuaaaugacaugggaaagguuaggaaagacauacaacaaugggaaccuucaagaggauggaacgauuggacacaagugcccuuuuguucacaccauuuccaugaguuaaucaugaaggacggucgugugcucguaguuccaugcagaaaccaagaugaacugauuggcagggcccgaauuucccagggagccgggugguccuugcgggaaacagccugucuggggaaguccuacgcccaaauguggagccugauguacuuccacagacgugaccuuaggcuggcggcaaaugccauuugcucggcagucccaucacauuggauuccaacaagucgaacaaccugguccauacacgccacacaugaguggaugacaacagaagacauguugacagucuggaacaggguguggauucaagaaaacccauggauggaagacaaaacuccaguagaaucaugggaggaaaucccguauuuggggaaaagagaagaccaauggugcggcucauugauugggcuaacaagcagggccaccugggcaaagaacauccaaacagcaauaaaucaaguuagaucccuaauaggcaaugaggaauacacagacuacaugccaucuaugaaaagauucagaagagaagaggaagaggcaggagucuugugguag

SEQ ID NO: 6462 - RNA, 9876 nt, Artificial Sequence
  derived and/or modified CDS sequence (wt) from DENV-2__FJ850072__SS-prME
acagcaggcgugauuauuauguugauuccaacagcaauggcguuccauuuaaccacacguaauggagaaccacacaugaucguugguaggcaagagaaagggaaaagucuucuguuuaaaacagaggauggugucaacaugugcacccucauggccauggaccuuggugaauugugugaagauacaaucacguacaaguguccccuccucaggcaaaaugaaccagaagacauagauuguuggugcaacucuacauccacauggguaacuuaugggacauguaccaccacaggagaacacagaagagaaaaaagaucaguggcacucguuccacauguggguaugggacuggagacacgaacugaaacauggaugucaucagaaggggccuggaaacauguucagagaauugaaaccuggaucuugagacauccaggcuuugccauaauggcagcaauccuggcauauaccauaggaacgacacauuuccaaagggccuugauuuuuaucuuacugacagcugucgcuccuucaaugacaaugcguugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaauacaacaacagaaucucguugcccaacacaaggggaacccagucuaaaugaagagcaggacaaaagguucaucugcaaacacuccaugguagacagaggauggggaaauggauguggauuauuuggaaaaggaggcauugugaccugugcuauguucacaugcaaaaagaacauggaaggaaaagucgugcugccagaaaaucuggaauacaccaucgugauaacaccucacucaggagaagagcacgcuguagguaaugacacaggaaaacauggcgaggaaaucaaaauaacaccacagaguuccaucacagaagcagaacugacaggcuauggcacugucacgauggagugcucuccgagaacgggccucgacuucaaugagauggugcugcugcagauggaagagaaagcuuggcuggugcacaggcaaugguuccuagaccugccguuaccauggcuacccggagcggacacacaaggaucaaauuggauacagaaagagacauuggucacuuucaaaaauccccaugcgaagaaacaggaugucguuguuuuaggaucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacggcucuccaugcaagaucccuuuugagauaauggauuuggaaaaaagacacgccuuaggucgccugauuacaguuaacccaaucguaacagaaaaagauagcccagucaacauagaagcagaaccuccauucggagacagcuacaucaucauaggaguagagcccggacaauugaaacucaauugguuuaagaagggaaguuccaucggccaaauguuugagacaacaaugagaggagcgaagagaauggccauauuaggugacacagccugggauuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguaguaccucacugucugugucacuaguauuggugggagucgugacacuguaccugggagcuauggugcaggcugauagugguugcguugugagcuggaaaaacaaagaauugaaauguggcagcgggauauucauuacagauaacgugcacacauggacagagcaauauaaguuccaaccagaauccccuucaaagcuagcuucagcuauccaaaaagcucaugaagagggcauuuguggaauccgcucaguaacaagauuggagaauuugauguggaaacaaauaacaccagaauugaaucacauccuaucagaaaaugagguaaaguugaccauuaugacaggagacaucaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucguuggaaguugaagacuaugguuuuggaguuuuuaccaccaauauauggcuaaaacugagagaaaaacaggauguauuuugugacucaaaacucaugucagcggccauaaaagacaacagagccguccaugccgauauggguuauuggauagaaagugcacucaaugacacauggaagauggagaaagccucuuucauugaagucaaaagcugccacuggccaaagucccacacccucuggagcaauggaguauuggaaagugagaugauaauuccaaaaaauuuugccgggccagugucacaacacaacuacagaccagguuaccacacacaaacagcaggaccuuggcaucuagguaagcuugagauggacuucgauuucugcgaaggaaccacagugguggugacugaggacuguggaaauagaggacccucuuuaagaacgaccacugccucuggaaaacuuauaacagaauggugcugccgaucuugcacacuaccaccucuaagauacagaggugaggauggaugcugguacgggauggaaaucagaccauugaaagagaaagaggagaauuuggucaacuccuuggucacagccggacaugggcagauugacaacuuuucgcuaggagucuugggaauggcacuguuucuggaagaaaugcucaggacccgaguaggaacgaaacaugcaauacugcuagucgcaguaucuuuugugacauugaucacugggaacauguccuuuagagacuugggaagagugaugguuauggugggcguugccaugacggaugauauagguaugggagugacuuaccuugcccuauuagcagcuuucaaaguuagaccaacuuucgcagcuggacuacucuugagaaaacugaccuccaaggaauuaaugauggccaccauaggaauuacacuccuuucccaaagcaccauaccagaaaccauucuugaacugacugaugcguuagccuugggcaugaugguccuaaaaauagugagaaauauggaaaaguaccaauuggcagugaccaucaugacuaucucgugugucccaaaugcaaugauacugcuaaacgcauggaaggugaguugcacaauauuggcagugguguccguuucuccauugcuccuaacauccucacagcagaaaacggauuggauaccacuagcauugacgauaaaaggucucaauccaacagccaucuuucuaacaacccuuucgagaaccagcaagaaaaggagcuggccgcuaaaugaagcugucauggcagucgggauggugagcauuuuagccaguucucuccuaaagaaugacauuccuaugacagguccauuaguggcuggagggcuccuuacuguguguuacgugcucacuggacgaucggccgauuuggaacuggagagagcuaccgauguaaaaugggaagaucaggcagaaauaucaggaagcagcccaauccugucaauaacaauaucagaagauggcagcaugucgauaaagaaugaagaggaagaacaaacacugaccauacucaucagaacgggauugcuggugaucucaggaguuuuuccaguaucgauaccaauuacggcagcagcaugguaccugugggaagugaagaaacaacgggcuggaguauugugggacgucccuucaccuccaccaguggaaaaagccgaacuggaagauggagcuuauagaaucaagcaaagagggauucuuggauauucucagauuggagccggaguuuacaaagaaggaacauuccacacaauguggcacgucacacguggugcuguucugaugcauagagggaaaaggauugaaccaucaugggcagacgucaagaaagaccuaauaucauauggaggaggcuggaagcuagaaggagaauggaaagaaggagaggaaguccaaguccuggcauuggaaccuggaaaaaauccaagagccguccaaacgaaaccuggacuuuucaaaaccaacaccggaaccauaggcgccgugucucuggacuuuuccccuggaacgucaggaucuccaauugucgauagaaaaggaaaaguugugggccuuuacggcaaugguguugucacaagaaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagaguuguggcggcugaaauggaggaagcucuuagaggacuuccaauaagauaccaaaccccagccauuagagccgagcacaccgggcgggagauuguggacuuaaugugucaugccacauuuacuaugaggcugcuaucaccagucagagugccaaauuacaaccugauuaucauggacgaagcccacuucacagauccagcaaguauagcagcuagaggauauauuucaacucgaguagaaaugggugaagcagcugggauuuucaugacagccacuccuccgggaaguagagacccauuuccucagagcaaugcaccaaucauggaugaggaaagagaaaucccugagcgcucguggaauucaggacaugaaugggucacggauuuuaaagggaagacuguuugguuuguuccaaguauaaaagcaggaaaugacauagcagcuugucucagaaaaaauggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccagucauacuaacagauggcgaagagcgagugauuuuggcaggaccuaugccagugacccacucuagugcagcacaaagaagagggagaguaggaagaaauccaaaaaaugaaaaugaccaguacauauacaugggggaaccucuggaaaaugaugaagacugugcacauuggaaagaagcuaaaaugcuccuagauaacaucaacacaccugaaggaaucauuccuaguauguucgaaccagagcgugaaaagguggaugccauugauggugaauaccguuugagaggagaagcaaggaaaaccuuuguggaccuaaugagaagaggggacuuaccagucugguuggccuacagaguggcagcugagggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagaaacgcacuggacaacuuagcugugcugcauacggcugaggcagguggaagggcguacaaucaugcucucagugaacugccggagacccuggagacacugcuuuuacugacacuccuggccacagucacaggaggaaucuucuuauucuuaaugagcggaaaagguauagggaagaugacucugggaauguguugcauaaucacggcuaguauccuccuaugguaugcacagauacaaccacacuggauagcagcuucaauaauacuggaguuuuuccucauaguuuugcucauuccagaaccagaaaaacagagaacaccccaagacaaccaauugaccuacguagucauagccauccucacagugguggccgcaaccauggcaaaugagauggguuuccuggaaaaaaccaagaaagaccucggacugggaagcauuacaacccaggaaucugagagcaacauccuggacauagaucuacguccugcaucagcauggacgcuguaugccguggcuacaacauuuaucacaccaauguugagacauagcauugaaaauuccucagugaaugucucccuaacagccauugcuaaccaagccacagugcuaaugggucuugggaaaggauggccauugucaaagauggacaucggaguuccccuccuugccauuggaugcuauucacaagucaacccuauaacccucacagcagcucuucuuucauugguagcacauuaugccauuauagggccaggacuucaagcaaaggcaaccagagaagcucagaaaagagcagcagcaggcaucaugaaaaacccaacagucgaugggauaacagugauugaccuagaaccaauacccuaugauccaaaauuugaaaagcaguuaggacaaguaaugcuccuaauccucugcgugacucaaguauuaaugaugaggacuacaugggcucugugugaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaagaacacaacaaacacaagaagaggaacuggcaacauaggagagacacuuggagaaaaauggaaaagucgauuaaacgcacugggaaaaagugaauuucagaucuacaagagaaguggaauccaggaaguggauagaaccuuggcaaaagaaggcaucaaaagaggagaaacggaccaccacgcugugucgcgaggcucagcaaaacugagaugguucgucgagagaaauauggucacaccagaagggaaggugguggaccucgguugcggcagagguggcuggucauacuauugugggggacuaaaaaauguaagagaagucaaaggccugacaaaaggaggaccaggacacgaagaacccauccccaugucaacauauggguggaaucuagugcgucugcaaaguggaguugacgucuucuucaccccgccagaaaagugugauacauuguugugugacauaggggagucgucaccaaaucccacgauagaagcaggacggacacucagaguccucaacuuaguagaaaauugguugaacaacaacacccaauuuugcauaaagguucucaacccauauaugcccucagucauagaaaaaauggaaacacuacaaaggaaauauggaggagcuuuagugaggaauccacucucacgaaacuccacacaugagauguacuggguauccaaugccaccgggaacauagugucaucagugaacaugauuucaaggauguugauuaacagauucacaaugaaacacaagaaagccaccuacgagccagauguugaccuaggaagcggaacccgcaacauuggaauugaaagugagauaccaaaucuagacauaauaggaaagagaauagagaaaauaaagcaagagcaugaaacaucauggcacuaugaccaagaccacccauacaaaacaugggcuuaccaugguagcuaugaaacaaaacaaacugggucagcaucaucuauggugaacggaguggucagacugcugacaaaaccuugggacgucgucccaauggugacacagauggcaaugacagacacgacuccauuuggacaacaacgcgucuucaaagagaaaguggacacgagaacccaagaaccgaaggaaggcacaaagaaacugaugagaauuacggcagaguggcuuuggaaagaacuaggaaagaaaaagacaccuaggauguguaccagagaagaauucacaagaaaggugagaagcaaugcagccuugggggccauauucacugaugaaaacaaauggaaaucggcucgugaggcuguugaagacaguagguuuugggagcugguugacagggaaagaaaucuccaucuugaaggaaagugugaaacauguguguacaacaugaugggaaaaagagagaagaagcuaggggaguucggcaaggcaaaagguagcagagccauaugguacauguggcuuggagcacgcuuuuuagaguuugaagcccuaggauucuuaaaugaagaucacugguucuccagagggaacucccugaguggaguggaaggagaagggcugcacaggcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagagcacaagaaacuagccgaggccguauucaaauuaacguaccaaaacaagguggugcgugugcaaagaccaacaccaagaggcacaguaauggauaucauaucgagaagagaccaaagaggcagcgggcaagucggcaccuauggccuuaauacuuucaccaacauggaagcccaauuaauuagacagauggagggagaaggaaucuucaaaagcauucagcaccugacagucacagaagaaaucgcuguacagaacugguuagcaagaguggggcgugaaaggcuaucaagaauggccaucaguggagaugauuguguuguaaaacccuuagaugacagauuugcaagugcuuuaacagcucuaaaugacaugggaaaaguuaggaaagauauacaacaaugggaaccuucaagaggauggaacgacuggacacaagugccuuucuguucacaccacuuucaugaguuagucaugaaagauggucgcaugcucguagucccaugcagaaaccaagaugaacugauugguagagcccgaauuucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaauaggguguggauccaagaaaauccguggauggaagacaaaacuccaguggaaucaugggaagaagucccauacuuggggaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaaaagguucagaagggaagaggaagaggcagguguccugugguag

SEQ ID NO: 6463 - RNA, 9876 nt, Artificial Sequence
  derived and/or modified CDS sequence (wt) from DENV-2__JN819419__SS-prME
acagcaggcgugauuguuauguugauuccaacagcgauggcguuucauuuaaccacacgcaauggagaaccacacaugaucguugguaggcaggagaaagggaaaagucuucuguucaaaacagaggauggugucaacaugugcacccucauggccauagaccuuggugaauugugugaagauacaaucacguacaaguguccucuccucagacaaaaugaaccagaagacauagauuguuggugcaacucuacguccacauggguaacuuaugggacauguaccacuacaggagaacacagaagagaaaaaagaucaguggcgcucguuccacauguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucauuuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacuaauaaaaacagaagccaaacaaccugccacucuuaggaaguacuguguagaagcaaagcugaccaacacaacaacagaaucucgcugcccaacacaaggggaacccagucuaaaugaagagcaggacaaaagguucauuugcaaacacuccaugguagacagaggauggggaaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcuguagguaaugacacaggaaagcauggcaaggaaaucaaaauaacaccacagaguuccaucacagaagcagaacugacaggcuaugguacugucacgauggagugcucuccgagaacgggccucgacuucaaugagauggugcugcugcagauggaagacaaagcuuggcugguacacaggcaaugguuccuagaccugccguuaccauggcuacccggagcggacacacaaggaucaaauuggauacagaaagagacauuggucacuuucaaaaauccccacgcgaagaaacaggaugucguuguuuuagggucucaagaaggggccaugcauacggcacucacaggggccacagaaauccagaugucaucaggaaacuuacuguucacaggacaucucaagugcaggcugagaauggacaaacuacagcucaaaggaaugucauacucuaugugcacaggaaaguuuaaaauugugaaggaaauagcagaaacgcaacauggaacaauaguuaucagaguacaauaugaaggggacgguucuccauguaagaucccuuuugagauaauggauuuggaaaaaagacacgucuuaggucgccugaucacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacgaugagaggagcaaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggagucgugacacuauaccugggagcuauggugcaggcugacagugguugcguugugagcuggaaaaauaaagaacugaaauguggcagcgggaucuucaucacagacaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgaucuuugcggccccagcccacagaguugaaauacucauggaaaacauggggaaaggcgaaaaugcucuccacagagucucacaaucagaccuuucuuauugauggccccgaaacagcagaaugccccaacacaaacagagcuuggaacucgcuggaagucgaagacuaugguuuuggaguuuuuaccaccaauauauggcuaaaguugagagaaaaacaggauguauuuugugacucaaaacucaugucagcggccauuaaagacaacagagccguccaugcugauauggguuauuggauagaaagugcacucaaugacacauggaagauggagaaagccuccuucauugaaguuaaaagcugccacuggccaaagucacacacccucuggagcaauggaguauuagaaagugagaugauaauuccaaaaaauuuugccgggccagugucacaacacaacuacagaccaggcuaccauacacaaacagcaggaccuuggcaucuaggcaagcuugagauggacuuugauuucugcgaaggaacuacagugguggugacugaggacuguggaaauagaggaccuucuuuaagaacgaccacugccucuggaaaacucauaacagaauggugcugccgauccugcacacuaccaccucuaagauacagaggugaggauggaugcugguacgggauggaaaucagaccauugaaagagaaagaggagaauuuggucaauuccuuggucacagccggacaugggcagauugacaacuuuucacuaggagucuugggaauggcacuguuccuggaagaaaugcucaggacccgaguaggaacgaaacaugcaauacugcuaguugcaguaucuuuugugacauugauuacugggaacaugucuuuuagagaccugggaagagugaugguuauggugggcgcuaccaugacggaugacauagguaugggagugacuuaucuugcccuacuagcagcuuucaaaguuagaccaacuuuugcagcuggacuacucuugagaaaacugacuuccaaggaauuaaugauggccaccauaggagucgcucuccuuucccaaagcaccauaccagagaccauucuugaacugacugaugcguuagccuugggcaugauggcucucaaaauagugaaaaauauggaaaaguaccaauuggcagugacuaucauggccauuucgugugucccaaaugcagugauauugcaaaacgcauggaaggugaguugcacaauauuggcagcgguguccguuucuccacugcucuuaacauccucacagcagaaagcggauuggauaccacuggcauugacgauaaaaggucucaauccaacagccauuuuucuaacgacucuuucgagaaccagcaagaaaaggagcuggccacuaaaugaagcuaucauggcaguugggauggugagcauuuuagccaguucucuccugaagaaugauauucccaugacagguccauuaguggcuggagggcuccuuacaguauguuaugugcucacuggacgaucggccgauuuggaacuagagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaagugaagaaacaacgggcuggaguauugugggacgucccuucacccccaccaguaggaaaagcugaacuggaagauggagccuauagaaucaagcaaagagggauucuaggguauucucagauuggagccggaguuuacaaagaaggaacauuccauacaauguggcacgucacacguggugcuguucugaugcauagagggaagaggauugaaccaucaugggcagaugucaagaaagaccuagugucauauggaggaggcuggaagcuagaaggagaauggaaggaaggagaggaaguccaaguccuggcauuagaaccuggaaaaaauccaagagccguccaaacgaaaccuggaauuuucaaaaccaacaccggaaacauaggcgccguaucccuggacuuuuccccuggaacgucaggaucuccaaucguugacagaaaaggaaaaguugugggucuuuacgguaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccaccagagucguggcagcugaaauggaagaagcucuuagaggacuuccaauaagauaccaaaccccagccaucagagccgagcacaccgggcgggagaucguggacuuaaugugucaugccacauuuacuaugaggcugcuaucaccagucagagugccaaauuacaaccugaucaucauggacgaagcccacuucacagacccagcaagcauagcagcuagaggauacauuucaacucggguggagaugggugaagcagcugggauuuucaugacagccacuccuccgggaaguagagacccauuuccucagagcaaugcaccaaucauggaugaggaaagagaaaucccugagcguucguggaauucaggacaugaaugggucacggauuuuaaagggaagacuguuugguuuguuccaaguauaaaagcaggaaaugacaucgcagcuugucuuaggaaaaauggaaagaaagugauacaacucaguagaaagacuuuugacucugaguauguuaagacuagagccaaugauugggauuuuguggucacaacugacauuucagaaaugggugccaacuucaaggcugagaggguuauagaccccagacguugcaugaaaccaguuauacuaacagauggcgaagagcgggugauccuggcaggaccuaugccagugacccacucuagugcagcgcaaagaagagggagaauaggaagaaauccaaaaaaugaaaaugaccaguacauauacaugggggaaccucucgaaaaugacgaagacugugcacauuggaaagaagccaaaaugcuccuagauaacaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccagucugguuagccuacaaaguggcagcugaaggcaucaacuacgcagacagaaggugguguuuugauggaauuaagaauaaucaaauacuggaagaaaauguggaaguggaaaucuggacgaaagaaggggaaaggaaaaaauugaaacccagaugguuggaugcuaggaucuauucugacccacuggcacuaaaagaauucaaggaauuugcagcugggagaaaaucuuugacccugaaccuaaucacagaaauggguaggcuuccaacuuucaugacucagaaggcaagaaacgcauuggacaacuuggcugugcugcauacggcugaggcagguggaaaggcguacaaucaugcucucagugaacugccggagacccuggagacacugcuucuacugacacuccuggcaacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccucaagacaaccaauugaccuacguugucauagccauccucacaguaguggccgcaaccauggcgaacgagauggguuuccuggaaaaaaccaagaaagaccucggauugggaagcauuacaacccaggaaucugagagcaacaucuuggacauagaucuacguccugcaucagcauggacgcuguaugccguggcuacaacauuugucacaccaauguugaggcauaguauugaaaauuccucagugaaugucucccuaacagccauugcuaaccaagcuacagugcugaugggucuugggaaaggauggccauugucaaagauggacaucggagcuccccuccucgccauuggaugcuacucacaagucaacccuauaacucucacagcagcucuucucuuauugguagcacauuaugccaucauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugcgaggcucuaaccuuagcgaccgggcccaucuccacauugugggaaggaaauccagggagguuuuggaacacuacuauugcagugucaauggcuaacaucuuuagggggagcuacuuggccggagcuggacuucucuuuuccaucaugaagaacacaacaaacacaagaagaggaacuggcaacauaggagagacacuuggagaaaaauggaaaagccgauuaaacgcacuaggaaaaagugaauuucagaucuacaagaaaaguggaauccaggaaguggauagaacccuggcaaaagaaggcaucaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacacgaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguccucaacccauauaugcccucaguaauagaaaaaauggaaacacuacaaaggaaauauggaggagccuuagugaggaauccacucucacgaaacuccacgcaugagauguauuggguaucuaaugccaccgggaacauagugucaucagugaacaugauuucaaggauguugauuaacagauucacaaugaaacacaagaaagccaccuacgagccagauguugacuuaggaaguggaacucgcaacauuggaauugaaagugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacagcgcguuuucaaagagaaaguggacacgagaacccaagaaccgaaggaaggcacaaagaaacugaugaaaauuacggcagaguggcuuuggaaagaacuaggaaagaaaaagauaccuaggauguguaccagagaagaauucacaagaaaggugagaagcaaugcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuccugaaugaagaucacugguucuccagagggaacucccugaguggaguggaaggagaagggcugcacaggcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaaaguggugcgugugcaaagaccaacaccaagaggcacaguaauggauaucauaucgagaagagaccaaagaggcagugggcaagucggcaccuauggccuuaauacuuucaccaauauggaagcccaauuaaucagacagauggagggagaaggaaucuucaaaagcauucagcaccugacagucacagaagaaaucgcuguacagaacuggcuagcaagaguggggcgugaaaggcuaacaagaauggccaucaguggagaugauuguguuguaaaaccuauagaugacagauuugcaaaugcuuuaacagcucuaaaugacaugggaaaaguuaggaaagauauacaacaaugggaaccuucaagaggauggaacgauuggacacaagugccuuucuguucacaccauuuucaugaguuagucaugaaagauggucgcgugcucguagucccaugcagaaaccaagaugaacugauugguagagcccgaauuucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccauacuuggggaaaagagaagaccaaugguguggcucauugauugggcuaacaagcagggcuaccugggcaaagaacauccaaacagcaauaaaccaagucagaucccuuauaggcaaugaggaauauacagacuacaugccauccaugaagagauucagaagggaagaggaagaggcagguguccugugguag

SEQ ID NO: 6464 - RNA, 9876 nt, Artificial Sequence
  derived and/or modified CDS sequence (wt) from DENV-2__FJ850074__SS-prME
acagcaggugugauuguuauguugauuccaacagugauggcguuucauuuaaccacacgcaauggagaaccacacaugaucguuggcaggcaggagaaagggaaaagucuucuguucaaaacagaggauggugucaacaugugcacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugaaacauggaugucaucagaaggggccuggaaacauguucagagaauugaaaccuggaucuugagacauccaggcuuuaccaugauggcagcaauccuggcauacaccauaggaacgacacauuuccaaagggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacuaauaaaaacagaagccaaacaaccugccacucuuaggaaguacuguguagaagcaaagcugaccaacacaacaacagaaucucguugcccaacacaaggggaacccagucuaaaugaagagcaggacaaaagguucauuugcaaacacuccaugguagacagaggauggggaaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcuguagguaaugacacaggaaagcauggcaaggaaaucaaaauaacaccacagaguucuaucacagaagcagaacugacaggcuaugguacugucacgauggagugcucuccgagaacgggccucgacuucaaugagauggugcugcugcagauggaagacaaagcuuggcugguacacaggcaaugguuccuagaccugccguuaccauggcuacccggagcggacacacaaggaucaaauuggauacagaaagagacauuggucacuuucaaaaauccccacgcgaagaaacaggaugucguuguuuuagggucucaagaaggggccaugcauacggcacucacaggggccacagaaauccagaugucaucaggaaacuuacuguucacaggacaucucaagugcaggcugagaauggacaaacuacagcucaaaggaaugucauauucuaugugcacaggaaaguuuaaaauugugaaggaaauagcagaaacgcaacauggaacaauaguuaucagaguacaauaugaaggggacgguucuccauguaagaucccuuuugagauaauggaucuggaaaaaagacacgucuuaggccgccugaucacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacgaugagaggagcaaagagaauggccauuuuaggugacacagcuugggauuuuggaucccugggaggaguguuuacaucuauaggaaaggcucuccaccaaguuuucggagcaaucuauggggcugcuuuuaguggggucucauggacuaugaaaauccucauuggagucaucaucacauggauaggaaugaauucacguagcaccucacugucugugucgcuaguauuggugggagucgugacacuauaccugggagcuauggugcaggcugacagugguugcguugugagcuggaaaaauaaagaacugaaauguggcagcgggaucuucauuacagacaacgugcacacauggacagaacaauauaaguuccaaccagaauccccuucaaagcuagcuucagcuauccagaaagcucaugaagagggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgaucuuugcggccccagcccacagaguugaaauacucauggaaaacauggggaaaggcgaaaaugcuccccacagagucucacaaucagaccuuucuuauugauggccccgaaacagcagaaugccccaacacaaacagagcuuggaacucgcuggaagucgaagacuaugguuuuggaguuuuuaccaccaauauauggcuaaaguugagagaaaaacaggauguauuuugugacucaaaacucaugucagcggccauuaaagacaacagagccguccaugcugauauggguuauuggauagaaagugcacucaaugacacauggaagauggagaaagccuccuucauugaaguuaaaagcugccacuggccaaagucacacacccucuggagcaauggaguauuagaaagugagaugauaauuccaaaaaauuuugccgggccagugucacaacacaacuacagaccaggcuaccauacacaaacagcaggaccuuggcaucuaggcaagcuugagauggacuuugauuucugcgaaggaacuacagugguggugacugaggauuguggaaauagaggaccuucuuuaagaacgaccacugccucuggaaaacucauaacagaauggugcugccgauccugcacacuaccaccucuaagauacagaggugaggauggaugcugguacgggauggaaaucagaccauugaaagagaaagaggagaauuuggucaauuccuuggucacagccggacaugggcagauugacaacuuuucacuaggagucuugggaauggcacuguuccuggaagaaaugcucaggacccgaguaggaacgaaacaugcaauacugcuaguugcaguaucuuuugugacauugauuacugggaacaugucuuuuagagaccugggaagagugaugguuauggugggcgcuaccaugacggaugacauagguaugggagugacuuaucuugcccuacuagcagcuuucaaaguuagaccaacuuuugcagcuggacuacucuugagaaaacugacuuccaaggaauuaaugauggccaccauaggagucgcucuccuuucccaaagcaccauaccagagaccauucuugaacugacugaugcguuagccuugggcaugauggcucucaaaauagugaaaaauauggaaaaguaccaauuggcagugacuauuauggccauuucgugugucccaaaugcagugauauugcaaaacgcauggaaggugaguugcacaauauuggcagcgguguccguuucuccacugcucuuaacauccucacagcagaaagcggauuggauaccacuggcauugacgauaaaaggucucaauccaacagccauuuuucuaacgacucuuucgagaaccagcaagaaaaggagcuggccacuaaaugaagcuaucauggcaguugggauggugagcauuuuagccaguucucuccugaagaaugauauucccaugacagguccauuaguggcuggagggcuccuuacaguauguuaugugcucacuggacgaucggccgauuuggaacuagagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaagugaagaaacaacgggccggaguauugugggacgucccuucacccccaccaguaggaaaagcugaacuggaagauggagccuauagaaucaagcaaagagggauucuaggauauucucagauuggagccggaguuuacaaagaaggaacauuccauacaauguggcacgucacacguggugcuguucugaugcauagagggaagaggauugaaccaucaugggcagaugucaagaaagaccuagugucauauggaggaggcuggaagcuagaaggagaauggaaggaaggagaggaaguccaaguccuggcauuagaaccuggaaaaaauccaagagccguccaaacgaaaccuggaauuuucaaaaccaacaccggaaccauaggcgccguaucucuggacuuuuccccuggaacgucaggaucuccaauuguugacagaaaaggaaaaguugugggucuuuacgguaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccaccagagucguggcagcugaaauggaagaagcucuuagaggacuuccaauaagauaccaaaccccagccaucagagccgagcacaccgggcgggagaucguggaccuaaugugucaugccacauuuacuaugaggcugcuaucaccagucagagugccaaauuacaaccugaucaucauggacgaagcccacuucacagacccagcaagcauagcagcuagaggauacauuucaacucggguagagaugggugaagcagcugggauuuucaugacagccacuccuccgggaaguagagacccauuuccucagagcaaugcaccaaucauggaugaggaaagagaaaucccugagcguucguggaauucaggacaugaaugggucacggauuuuaaagggaagacuguuugguuuguuccaaguauaaaagcaggaaaugacaucgcagcuugucuuaggaaaaauggaaagaaagugauacaacucaguagaaagacuuuugauucugaguauguuaagacuagauccaaugauugggauuuuguggucacaacugacauuucagaaaugggugccaacuucaaggcugagaggguuauagaccccagacgcugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucucgaaaaugacgaagacugugcacauuggaaagaagccaaaaugcuccuagauaacaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccugucugguuagccuacaaaguggcagcugaaggcaucaacuacgcagacagaaggugguguuuugauggaauuaagaauaaucaaauacuggaagaaaauguggaaguggaaaucuggacgaaagaaggggaaaggaaaaaauuaaaacccagaugguuggaugcuaggaucuauucugacccacuggcacuaaaagaauucaaggaauuugcagcugggagaaaaucuuugacccugaaccuaaucacagaaauggguaggcucccaacuuucaugacucagaaggcaagaaacgcacuggacaacuuggcugugcugcauacggcugaggcagguggaaaggcguacaaucaugcucucagugaacugccggagacccuggagacacugcuucuacugacacuccuggcaacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccucaagacaaccaauugaccuacguugucauagccauccucacaguaguggccgcaaccauggcgaacgagauggguuuccuggaaaaaacuaagaaagaccucggauugggaagcauuacaacccaggaaucugagagcaacaucuuggacauagaucuacguccugcaucagcauggacgcuguaugccguggcuacaacauuugucacaccaauguugaggcauagcauugaaaauuccucagugaaugucucccuaacagccauugcuaaccaagcuacagugcugaugggucuugggaaaggauggccauugucaaagauggacaucggaguuccccuccucgccauuggaugcuacucacaagucaacccuauaacucucacagcagcucuucucuuauugguagcacacuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugcgaggcucuaaccuuagcgaccgggcccaucuccacauugugggaaggaaauccagggagguuuuggaacacuacuauugcagugucaauggcuaacaucuuuagggggagcuacuuggccggagcuggacuucucuuuuccaucaugaagaacacaacaaacacaagaagaggaacuggcaacauaggagagacacuuggagaaaaauggaaaagccgauuaaacgcacugggaaaaagugaauuucagaucuacaagaaaaguggaauccaggaaguggauagaacccuggcaaaagaaggcaucaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaaaaauguaagagaagucaaaggccuaacaaaaggaggaccaggacacgaagaaccuauccccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguccucaacccauauaugcccucaguaauagaaaaaauggaaacacuacaaaggaaauauggaggagccuuagugaggaauccacucucacgaaacuccacgcaugagauguauuggguaucuaaugccaccgggaacauagugucaucagugaacaugaucucaaggauguugaucaacagauucacaaugaaacacaagaaagccaccuacgagccagauguugaccuaggaaguggaacucgcaacauuggaauugaaagugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacagcgcguuuucaaagagaaaguggauacgagaacccaagaaccgaaggaaggcacaaagaaacugaugaaaauuacggcagaguggcuuuggaaagaacuaggaaagaaaaagacaccuaggauguguaccagagaggaauucacaagaaaggugagaagcaaugcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuccugaaugaagaucacugguucuccagagggaacucccugaguggaguggaaggagaagggcugcacaggcuaggcuacauuuuaagagacgugagcaagaaggaagggggagcaauguacgccgaugauacggcaggaugggacacaagaaucacacuagaagacuuaaaaaaugaagaaaugguaacaaaccacaugaaaggagaacacaagaaacuagccgaggccauauucaaauuaacguaccaaaacaaaguggugcgugugcaaagaccaacaccaagaggcacaguaauggauaucauaucgagaagagaccaaagaggcagugggcaagucggcaccuauggccuuaauacuuucaccaacauggaagcccaauuaaucagacagauggagggagaaggaaucuucaaaagcauucagcaccugacagucacagaagaaaucgcuguacagaacuggcuagcaagaguggggcgugaaaggcuaacaagaauggccaucaguggagaugauuguguuguaaaaccuauagaugacagauuugcaaaugcuuuaacagcucuaaaugacaugggaaaaguuaggaaagauauacaacaaugggaaccuucaagaggauggaacgauuggacacaagugccuuucuguucacaccauuuucaugaguuagucaugaaagauggucgcgugcucguagucccaugcagaaaccaagaugaacugauugguagagcccgaauuucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccauacuuggggaaaagagaagaccaaugguguggcucauugauugggcuaacaagcagggcuaccugggcaaagaacauccaaacagcaauaaaccaagucagaucccuuauagguaaugaggaauauacagacuacaugccauccaugaagagauucagaagggaagaggaagaggcagguguccugugguag

SEQ ID NO: 6465 - RNA, 9876 nt, Artificial Sequence
  derived and/or modified CDS sequence (wt) from DENV-2__FJ850076__SS-prME
acagcaggugcgauuguuauguugauuccaacagugauggcguuucauuuaaccacacgcaauggagaaccacacaugaucguuggcaggcaggagaaagggaaaagucuucuguucaaaacagaggauggugucaacaugugcacccucauggccauagaccuuggugaauugugugaagauacaaucacguacaaguguccucuccucagacaaaaugaaccagaagacauagauuguuggugcaacucuacguccacauggguaacuuaugggacauguaccacuacaggagaacacagaagagaaaaaagaucaguggcgcucguuccacauguggguaugggacuggagacacgaacugaaacauggaugucaucagaaggggccuggaaacauguucagagaauugaaaccuggaucuugagacauccaggcuuuaccaugauggcagcaauccuggcauacaccauaggaacgacacauuuccaaagggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacuaauaaaaacagaagccaaacaaccugccacucuuaggaaguacuguguagaagcaaagcugaccaacacaacaacagaaucucguugcccaacacaaggggaacccagucuaaaugaagagcaggacaaaagguucauuugcaaacacuccaugguagacagaggauggggaaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcuguagguaaugacacaggaaagcauggcaaggaaaucaaaauaacaccacagaguucuaucacagaagcagaacugacaggcuaugguacugucacgauggagugcucuccgagaacgggccucgacuucaaugagauggugcugcugcagauggaagacaaagcuuggcugguacacaggcaaugguuccuagaccugccguuaccauggcuacccggagcggacacacaaggaucaaauuggauacagaaagagacauuggucacuuucaaaaauccccacgcgaagaaacaggaugucguuguuuuagggucucaagaaggggccaugcauacggcacucacaggggccacagaaauccagaugucaucaggaaacuuacuguucacaggacaucucaagugcaggcugagaauggacaaacuacagcucaaaggaaugucauacucuaugugcacaggaaaguuuaaaauugugaaggaaauagcagaaacgcaacauggaacaauaguuaucagaguacaauaugaaggggacgguucuccauguaagaucccuuuugagauaauggauuuggaaaaaagacacgucuuaggccgccugaucacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacgaugagaggagcaaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauuggagucaucaucacauggauaggaaugaauucacguagcaccucacugucugugucgcuaguauuggugggagucgugacacuauaccugggagcuauggugcaggcugacagugguugcguugugagcuggaaaaauaaagaacugaaauguggcagcgggaucuucauuacagacaacgugcacacauggacagaacaauauaaguuccaaccagaauccccuucaaagcuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgaucuuugcggccccagcccacagaguugaaauacucauggaaaacauggggaaaggcgaaaaugcuccccacagagucccacaaucagaccuuucuuauugauggccccgaaacagcagaaugccccaacacaaacagagcuuggaacucgcuggaagucgaagacuaugguuuuggaguuuuuaccaccaauauauggcuaaaguugagagaaaaacaggauguauuuugugacucaaaacucaugucagcggccaucaaagacaacagagccguccaugcugauauggguuauuggauagaaagugcacucaaugacacauggaagauggagaaagccuccuucauugaaguuaaaagcugccacuggccaaagucacacacccucuggagcaauggaguauuagaaagugagaugauaauuccaaaaaacuuugccgggccagugucacaacacaacuacagaccaggcuaccauacacaaacagcaggaccuuggcaucuaggcaagcuugagauggacuuugauuucugcgaaggaacuacagugguggugacugaggauuguggaaauagaggaccuucuuuaagaacgaccacugccucuggaaaacucauaacagaauggugcugccgauccugcacacuaccaccucuaagauacagaggugaggauggaugcugguacgggauggaaaucagaccauugaaagagaaagaggagaauuuggucaauuccuuggucacagccggacaugggcagauugacaacuuuucacuaggagucuugggaauggcacuguuccuggaagaaaugcucaggacccgaguaggaacgaaacaugcaauacugcuaguugcaguaucuuuugugacauugauuacugggaacaugucuuuuagagaccugggaagagugaugguuauggugggcgcuaccaugacggaugacauagguaugggagugacuuaucuugcccuacuagcagcuuucaaaguuagaccaacuuuugcagcuggacuacucuugagaaaacugacuuccaaggaauuaaugauggccaccauaggagucgcucuccuuucccaaagcaccauaccagaaaccauucuugaacugacugaugcguuagccuugggcaugauggcucucaaaauagugaaaaauauggaaaaguaccaauuggcagugacuauuauggccauuucgugugucccaaaugcagugauauugcaaaacgcauggaaggugaguugcacaauauuggcagcgguguccguuucuccacugcucuuaacauccucacagcagaaagcggauuggauaccacuggcauugacgauaaaaggucucaauccgacagccauuuuucuaacgacucuuucgagaaccagcaagaaaaggagcuggccacuaaaugaagcuaucauggcaguugggauggugagcauuuuagccaguucucuccugaagaaugauguucccaugacagguccauuaguggcuggagggcuccuuacaguauguuaugugcucacuggacgaucggccgauuuggaacuagagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaagugaagaaacaacgggccggaguauugugggacgucccuucacccccaccaguaggaaaagcugaacuggaagauggagccuauagaaucaagcaaagagggauucuaggauauucucagauuggagccggaguuuacaaagaaggaacauuccauacaauguggcacgucacacguggugcuguucugaugcauagagggaagaggauugaaccaucaugggcagaugucaagaaagaccuagugucauauggaggaggcuggaagcuagaaggagaauggaaggaaggagaggaaguccaaguccuggcauuagaaccuggaaaaaauccaagagccguccaaacgaaaccuggaauuuucaaaaccaacaccggaaccauaggcgccguaucucuggacuuuuccccuggaacgucaggaucuccaauuguugacagaaaaggaaaaguugugggucuuuacgguaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccaccagagucguggcagcugaaauggaagaagcucuuagaggacuuccaauaagauaccaaaccccagccaucagagccgagcacaccgggcgggagaucguggaccuaaugugucaugccacauuuacuaugaggcugcuaucaccagucagagugccaaauuacaaccugaucaucauggacgaagcccacuucacagacccagcaagcauagcagcuagaggauacauuucaacucggguagagaugggugaagcagcugggauuuucaugacagccacuccuccgggaaguagggacccauuuccucagagcaaugcaccaaucauggaugaggaaagagaaaucccugagcguucguggaauucaggacaugaaugggucacggauuuuaaagggaagacuguuugguuuguuccaaguauaaaagcaggaaaugacaucgcagcuugucuuaggaaaaauggaaagaaagugauacaacucaguagaaagacuuuugauucugaguauguuaagacuagauccaaugauugggauuuuguggucacaacugacauuucagaaaugggugccaacuucaaggcugagaggguuauagaccccagacgcugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucucgaaaaugacgaagacugugcacauuggaaagaagccaaaaugcuccuagauaacaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccugucugguuagccuacaaaguggcagcugaaggcaucaacuacgcagacagaaggugguguuuugauggaauuaagaauaaucaaauacuggaagaaaauguggaaguggaaaucuggacgaaagaaggggaaaggaaaaaauuaaaacccagaugguuggaugcuaggaucuauucugacccacuggcacuaaaagaauucaaggaauuugcagcugggagaaaaucuuugacccugaaccuaaucacagaaauggguaggcucccaacuuucaugacucagaaggcaagaaacgcacuggacaacuuggcugugcugcauacggcugaggcagguggaaaggcguacaaucaugcucucagugaacugccggagacccuggagacacugcuucuacugacacuccuggcaacagucacaggaggaaucuucuuauucuuaaugaguggaaaagguauagggaagaugacccugggaauguguugcauaaucacggcuagcauccuccuaugguaugcacagauacaaccacacuggauagcagcuucaauaauacuggaguuuuuucucauaguuuugcucauuccagaaccagaaaaacagagaacaccucaagacaaccaauugaccuacguugucauagcuauccucacaguaguggccgcaaccauggcgaacgagauggguuuccuggaaaaaacuaagaaagaccucggauugggaagcauuacaacccaggaaucugagagcaacaucuuggacauagaucuacguccugcaucagcauggacgcuguaugccguggcaacaacauuugucacaccaauguugaggcauagcauugaaaauuccucagugaaugucucccuaacagccauugcuaaccaagcuacagugcugaugggucuugggaaaggauggccauugucaaagauggacaucggaguuccccuccucgccauuggaugcuacucacaagucaacccuauaacucucacagcagcucuucucuuauugguagcacacuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugcgaggcucuaaccuuagcgaccgggcccaucuccacauugugggaaggaaauccagggagguuuuggaacacuacuauugcagugucaauggcuaacaucuuuagggggagcuacuuggccggagcuggacuucucuuuuccaucaugaaaaacacaacaaacacaagaagaggaacuggcaacauaggagagacacuuggagaaaaauggaaaagccgauuaaacgcacugggaaaaagugaauuucagaucuacaagaaaaguggaauccaggaaguggauagaacccuggcaaaagaaggcaucaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaaaaauguaagagaagucaaaggccuaacaaaaggaggaccaggacacgaagaaccuauccccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguccucaacccauauaugcccucaguaauagaaaaaauggaaacacuacaaaggaaauauggaggagccuuagugaggaauccacucucacgaaacuccacgcaugagauguauuggguaucuaaugccaccgggaacauagugucaucagugaacaugaucucaaggauguugaucaacagauucacaaugaaacacaagaaagccaccuacgagccagauguugaccuaggaaguggaacucgcaacauuggaauugaaagugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacggacacgacuccauuuggacaacagcgcguuuucaaagagaaaguggauacgagaacccaagaaccgaaggaaggcacaaagaaacugaugaaaauuacggcagaguggcuuuggaaagaacuaggaaagaaaaagacaccuaggauguguaccagagaggaauucacaagaaaggugagaagcaaugcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuccugaaugaagaucacugguucuccagagggaacucccugaguggaguggaaggagaagggcugcacaggcuaggcuacauuuuaagagacgugagcaagaaggaagggggagcaauguacgccgaugauacggcaggaugggacacaagaaucacacuagaagacuuaaaaaaugaagaaaugguaacaaaccacaugaaaggagaacacaagaaacuagccgaggccauauucaaauuaacguaccaaaacaaaguggugcgugugcaaagaccaacaccaagaggcacaguaauggauaucauaucgagaagagaccaaagaggcagugggcaagucggcaccuauggccuuaauacuuucaccaacauggaagcccaauuaaucagacagauggagggagaaggaaucuucaaaagcauucagcaccugacagucacagaagaaaucgcuguacagaacuggcuagcaagaguggggcgugaaaggcuaacaagaauggccaucaguggagaugauuguguuguaaaaccuauagaugacagauuugcaaaugcuuuaacagcucuaaaugacaugggaaaaguuaggaaagauauacaacaaugggaaccuucaagaggauggaacgauuggacacaagugccuuucuguucacaccauuuucaugaguuagucaugaaagauggucgcgugcucguagucccaugcagaaaccaagaugaacugauugguagagcccgaauuucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccauacuuggggaaaagagaagaccaaugguguggcucauugauugggcuaacaagcagggcuaccugggcaaagaacauccaaacagcaauaaaccaagucagaucccuuauagguaaugaggaauauacagacuacaugccauccaugaagagauucagaagggaagaggaagaggcagguguccugugguag

SEQ ID NO: 6466 - RNA, 9876 nt, Artificial Sequence
  derived and/or modified CDS sequence (wt) from DENV-2__GQ868640__SS-prME
acagcaggugcgauuguuauguugauuccaacagugauggcguuucauuuaaccacacgcaauggagaaccacacaugaucguuggcaggcaggagaaagggaaaagucuucuguucaaaacagaggauggugucaacaugugcacccucauggccauagaccuuggugaauugugugaagauacaaucacguacaaguguccucuccucagacaaaaugaaccagaagacauagauuguuggugcaacucuacguccacauggguaacuuaugggacauguaccacuacaggagaacacagaagagaaaaaagaucaguggcgcucguuccacauguggguaugggacuggagacacgaacugaaacauggaugucaucagaaggggccuggaaacauguucagagaauugaaaccuggaucuugagacauccaggcuuuaccaugauggcagcaauccuggcauacaccauaggaacgacacauuuccaaagggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacuaauaaaaacagaagccaaacaaccugccacucuuaggaaguacuguguagaagcaaagcugaccaacacaacaacagaaucucguugcccaacacaaggggaacccagucuaaaugaagagcaggacaaaagguucauuugcaaacacuccaugguagacagaggauggggaaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcuguaggcaaugacacaggaaagcauggcaaggaaaucaaaauaacaccacagaguucuaucacagaagcagaacugacaggcuaugguacugucacgauggagugcucuccgagaacgggccucgacuucaaugagauggugcugcugcagauggaagacaaagcuuggcugguacacaggcaaugguuccuagaccugccguuaccauggcuacccggagcggacacacaaggaucaaauuggauacagaaagagacauuggucacuuucaaaaauccccacgcgaagaaacaggaugucguuguuuuagggucucaagaaggggccaugcauacggcacucacaggggccacagaaauccagaugucaucaggaaacuuacuguucacaggacaucucaagugcaggcugagaauggacaaacuacagcucaaaggaaugucauacucuaugugcacaggaaaguuuaaaauugugaaggaaauagcagaaacgcaacauggaacaauaguuaucagaguacaauaugaaggggacgguucuccauguaagaucccuuuugagauaauggauuuggaaaaaagacacgucuuaggccgccugaucacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacgaugagaggagcaaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauuggagucaucaucacauggauaggaaugaauucacguagcaccucacugucugugucgcuaguauuggugggagucgugacacuauaccugggagcuauggugcaggcugacagugguugcguugugagcuggaaaaauaaagaacugaaauguggcagcgggaucuucauuacagacaacgugcacacauggacagaacaauauaaguuccaaccagaauccccuucaaagcuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgaucuuugcggccccagcccacagaguugaaauacucauggaaaacauggggaaaggcgaaaaugcuccccacagagucccacaaucagaccuuucuuauugauggccccgaaacagcagaaugccccaacacaaacagagcuuggaacucgcuggaagucgaagacuaugguuuuggaguuuuuaccaccaauauauggcuaaaguugagagaaaaacaggauguauuuugugacucaaaacucaugucagcggccaucaaagacaacagagccguccaugcugauauggguuauuggauagaaagugcacucaaugacacauggaagauggagaaagccuccuucauugaaguuaaaagcugccacuggccaaagucacacacccucuggagcaauggaguauuagaaagugagaugauaauuccaaaaaacuuugccgggccagugucacaacacaacuacagaccaggcuaccauacacaaacagcaggaccuuggcaucuaggcaagcuugagauggacuuugauuucugcgaaggaacuacagugguggugacugaggauuguggaaauagaggaccuucuuuaagaacgaccacugccucuggaaaacucauaacagaauggugcugccgauccugcacacuaccaccucuaagauacagaggugaggauggaugcugguacgggauggaaaucagaccauugaaagagaaagaggagaauuuggucaauuccuuggucacagccggacaugggcagauugacaacuuuucacuaggagucuugggaauggcacuguuccuggaagaaaugcucaggacccgaguaggaacgaaacaugcaauacugcuaguugcaguaucuuuugugacauugauuacugggaacaugucuuuuagagaccugggaagagugaugguuauggugggcgcuaccauuacggaugacauagguaugggagugacuuaucuugcccuacuagcagcuuucaaaguuagaccaacuuuugcagcuggacuacucuugagaaaacugacuuccaaggaauuaaugauggccaccauaggagucgcucuccuuucccaaagcaccauaccagagaccauucuugaacugacugaugcguuagccuugggcaugauggcucucaaaauagugaaaaauauggaaaaguaccaauuggcagugacuauuauggccauuucgugugucccaaaugcagugauauugcaaaacgcauggaaggugaguugcacaauauuggcagcgguguccguuucuccacugcucuuaacauccucacagcagaaagcggauuggauaccacuggcauugacgauaaaaggucucaauccgacagccauuuuucuaacgacucuuucgagaaccagcaagaaaaggagcuggccacuaaaugaagcuaucauggcaguugggauggugagcauuuuagccaguucucuccugaagaaugauguucccaugacagguccauuaguggcuggagggcuccuuacaguauguuaugugcucacuggacgaucggccgauuuggaacuagagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaagugaagaaacaacgggccggaguauugugggacgucccuucacccccaccaguaggaaaagcugaacuggaagauggagccuauagaaucaagcaaagagggauucuaggauauucucagauuggagccggaguuuacaaagaaggaacauuccauacaauguggcacgucacacguggugcuguucugaugcauagagggaagaggauugaaccaucaugggcagaugucaagaaagaccuagugucauauggaggaggcuggaagcuagaaggagaauggaaggaaggagaggaaguccaaguccuggcauuagaaccuggaaaaaauccaagagccguccaaacgaaaccuggaauuuucaaaaccaacaccggaaccauaggcgccguaucucuggacuuuuccccuggaacgucaggaucuccaauuguugacagaaaaggaaaaguugugggucuuuacgguaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccaccagagucguggcagcugaaauggaagaagcucuuagaggacuuccaauaagauaccaaaccccagccaucagagccgagcacaccgggcgggagaucguggaccuaaugugucaugccacauuuacuaugaggcugcuaucaccagucagagugccaaauuacaaccugaucaucauggacgaagcccacuucacagacccagcaagcauagcagcuagaggauacauuucaacucggguagagaugggugaagcagcugggauuuucaugacagccacuccuccgggaaguagggacccauuuccucagagcaaugcaccaaucauggaugaggaaagagaaaucccugagcguucguggaauucaggacaugaaugggucacggauuuuaaagggaagacuguuugguuuguuccaaguauaaaagcaggaaaugacaucgcagcuugucuuaggaaaaauggaaagaaagugauacaacucaguagaaagacuuuugauucugaguauguuaagacuagauccaaugauugggauuuuguggucacaacugacauuucagaaaugggugccaacuucaaggcugagaggguuauagaccccagacgcugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucucgaaaaugacgaagacugugcacauuggaaagaagccaaaaugcuccuagauaacaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccugucugguuagccuacaaaguggcagcugaaggcaucaacuacgcagacagaaggugguguuuugauggaauuaagaauaaucaaauacuggaagaaaauguggaaguggaaaucuggacgaaagaaggggaaaggaaaaaauuaaaacccagaugguuggaugcuaggaucuauucugacccacuggcacuaaaagaauucaaggaauuugcagcugggagaaaaucuuugacccugaaccuaaucacagaaauggguaggcucccaacuuucaugacucagaaggcaagaaacgcacuggacaacuuggcugugcugcauacggcugaggcagguggaaaagcguacaaucaugcucucagugaacugccggagacccuggagacacugcuucuacugacacuccuggcaacagucacaggaggaaucuucuuauucuuaaugaguggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccucaagacaaccaauugaccuacguugucauagcuauccucacaguaguggccgcaaccauggcgaacgagauggguuuccuggaaaaaacuaagaaagaccucggauugggaagcauuacaacccaggaaucugagagcaacaucuuggacauagaucuacguccugcaucagcauggacgcuguaugccguggcaacaacauuugucacaccaauguugaggcauagcauugaaaauuccucagugaaugucucccuaacagccauugcuaaccaagcuacagugcugaugggucuugggaaaggauggccauugucaaagauggacaucggaguuccccuccucgccauuggaugcuacucacaagucaacccuauaacucucacagcagcucuucucuuauugguagcacacuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugcgaggcucuaaccuuagcgaccgggcccaucuccacauugugggaaggaaauccagggagguuuuggaacacuacuauugcagugucaauggcuaacaucuuuagggggagcuacuuggccggagcuggacuucucuuuuccaucaugaaaaacacaacaaacacaagaagaggaacuggcaacauaggagagacacuuggagaaaaauggaaaagccgauuaaacgcacugggaaaaagugaauuucagaucuacaagaaaaguggaauccaggaaguggauagaacccuggcaaaagaaggcaucaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaaaaauguaagagaagucaaaggccuaacaaaaggaggaccaggacacgaagaaccuauccccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguccucaacccauauaugcccucaguaauagaaaaaauggaaacacuacaaaggaaauauggaggagccuuagugaggaauccacucucacgaaacuccacgcaugagauguauuggguaucuaaugccaccgggaacauagugucaucagugaacaugaucucaaggauguugaucaacagauucacaaugaaacacaagaaagccaccuacgagccagauguugaccuaggaaguggaacucgcaacauuggaauugaaagugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacagcgcguuuucaaagagaaaguggauacgagaacccaagaaccgaaggaaggcacaaagaaacugaugaaaauuacggcagaguggcuuuggaaagaacuaggaaagaaaaagacaccuaggauguguaccagagaggaauucacaagaaaggugagaagcaaugcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuccugaaugaagaucacugguucuccagagggaacucccugaguggaguggaaggagaagggcugcacaggcuaggcuacauuuuaagagacgugagcaagaaggaagggggagcaauguacgccgaugauacggcaggaugggacacaagaaucacacuagaagacuuaaaaaaugaagaaaugguaacaaaccacaugaaaggagaacacaagaaacuagccgaggccauauucaaauuaacguaccaaaacaaaguggugcgugugcaaagaccaacaccaagaggcacaguaauggauaucauaucgagaagagaccaaagaggcagugggcaagucggcaccuauggccuuaauacuuucaccaacauggaagcccaauuaaucagacagauggagggagaaggaaucuucaaaagcauucagcaccugacagucacagaagaaaucgcuguacagaacuggcuagcaagaguggggcgugaaaggcuaacaagaauggccaucaguggagaugauuguguuguaaaaccuauagaugacagauuugcaaaugcuuuaacagcucuaaaugacaugggaaaaguuaggaaagauauacaacaaugggaaccuucaagaggauggaacgauuggacacaagugccuuucuguucacaccauuuucaugaguuagucaugaaagauggucgcgugcucguagucccaugcagaaaccaagaugaacugauugguagagcccgaauuucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccauacuuggggaaaagagaagaccaaugguguggcucauugauugggcuaacaagcagggcuaccugggcaaagaacauccaaacagcaauaaaccaagucagaucccuuauagguaaugaggaauauacagacuacaugccauccaugaagagauucagaagggaagaggaagaggcagguguccugugguag

SEQ ID NO: 6467 - RNA, 9876 nt, Artificial Sequence
  derived and/or modified CDS sequence (wt) from DENV-2__FJ850078__SS-prME
acagcaggugugauuguuauguugauuccaacagugauggcguuucauuuaaccacacgcaauggagaaccacacaugaucguuggcaggcaggagaaagggaaaagucuucuguucaaaacagaggauggugucaacaugugcacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugaaacauggaugucaucagaaggggccuggaaacauguucagagaauugaaaccuggaucuugagacauccaggcuuuaccaugauggcagcaauccuggcauacaccauaggaacgacacauuuccaaagggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacuaauaaaaacagaagccaaacaaccugccacucuuaggaaguacuguguagaagcaaagcugaccaacacaacaacagaaucucguugcccaacacaaggggaacccagucuaaaugaagagcaggacaaaagguucauuugcaaacacuccaugguagacagaggauggggaaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcaugcuguagguaaugacacaggaaagcauggcaaggaaaucaaaauaacaccacagaguucuaucacagaagcagaacugacaggcuaugguacugucacgauggagugcucuccgagaacgggccucgacuucaaugagauggugcugcugcagauggaagacaaagcuuggcugguacacaggcaaugguuccuagaccugccguuaccauggcuacccggagcggacacacaaggaucaaauuggauacagaaagagacauuggucacuuucaaaaauccccacgcgaagaaacaggaugucguuguuuuagggucucaagaaggggcuaugcauacggcacucacaggggccacagaaauccagaugucaucaggaaacuuacuguucacaggacaucucaagugcaggcugagaauggacaaacuacagcucaaaggaaugucauacucuaugugcacaggaaaguuuaaaauugugaaggaaauagcagaaacgcaacauggaacaauaguuaucagaguacaauaugaaggggacgguucuccauguaagaucccuuuugagauaauggaucuggaaaaaagacacgucuuaggccgccugaucacaguuaacccaaucguaacagaaaaagauagcccagucaacauagaagcagaaccuccauucggagacagcuacaucaucguaggaguagagccgggacaauugaaacucaauugguuuaagaagggaaguuccaucggccaaauguuugagacaacgaugagaggagcaaagagaauggccauuuuaggugacacagccugggauuuuggaucccugggaggaguguuuacaucuauaggaaaggcucuccaccaaguuuuuggagcaaucuauggggcugcuuuuaauggggucucauggacuaugaaaauccucauuggagucaucaucacauggauaggaaugaauucacguagcaccucacugucugugucgcuaguauuggugggagucgugacacuauaccugggagcuauggugcaggcugacagugguugcguugugagcuggaaaaauaaagaacugaaauguggcagcgggaucuucauuacagacaacgugcacacauggacagaacaauauaaguuccaaccagaauccccuucaaagcuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgaucuuugcggccccagcccacagaguugaaauacucauggaaaacauggggaaaggcgaaaaugcuccccacagagucucacaaucagaccuuucucauugauggccccgaaacagcagaaugccccaacgcaaacagagcuuggaacucgcuggaagucgaagacuaugguuuuggaguuuuuaccaccaauauauggcuaaaguugagagaaaaacaggauguauuuugugacucaaaacucaugucagcggccauuaaagacaacagagccguccaugcugauauggguuauuggauagaaagugcacucaaugacacauggaagauggagaaagccuccuucauugaaguuaaaagcugccacuggccaaagucacacacccucuggagcaauggaguauuagaaagugagaugauaauuccaaaaaauuuugccgggccagugucacaacacaacuacagaccaggcuaccauacacaaacagcaggaccuuggcaucuaggcaagcuugagauggacuuugauuucugcgaaggaacuacagugguggugacugaggauuguggaaauagaggaccuucuuuaagaacgaccacugccucuggaaaacucauaacagaauggugcugccgauccugcacacuaccaccucuaagauacagaggugaggauggaugcugguacgggauggaaaucagaccauugaaagagaaagaggagaauuuggucaauuccuuggucacagccggacaugggcagauugacaacuuuucacuaggagucuugggaauggcacuguuccuggaagaaaugcucaggacccgaguaggaacgaaacaugcaauacugcuaguugcaguaucuuuugugacauugauuacugggaacaugucuuuuagagaccugggaagagugaugguuauggugggcgcuacuaugacggaugacauagguaugggagugacuuaucuugcccuacuagcagcuuucaaaguuagaccaacuuuugcagcuggacuacucuugagaaaacugacuuccaaggaauuaaugauggccaccauaggagucgcucuccuuucccaaagcaccauaccagagaccauucuugaacugacugaugcguuagccuugggcaugauggcucucaaaauagugaaaaauauggaaaaguaccaauuggcagugacuauuauggccauuucgugugucccaaaugcagugauauugcaaaacgcauggaaggugaguugcacaauauuggcagcgguguccguuucuccacugcucuuaacauccucacagcagaaagcggauuggauaccacuggcauugacgauaaaaggucucaauccaacagccauuuuucuaacgacucuuucgagaaccagcaagaaaaggagcuggccacuaaaugaagcugucauggcaguugggauggugagcauuuuagccaguucucuccugaagaaugauauucccaugacagguccauuaguggcuggagggcuccuuacaguauguuaugugcucacuggacgaucggccgauuuggaacuagagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaagugaagaaacaacgggccggaguauugugggacgucccuucacccccaccaguagaaaaagcugaacuggaagauggagccuauagaaucaagcaaagagggauucuaggauauucucagauuggagccggaguuuacaaagaaggaacauuccauacaauguggcacgucacacguggugcuguucugaugcauagagggaagaggauugaaccaucaugggcagaugucaagaaagaccuagugucauauggaggaggcuggaagcuagaaggagaauggaaagaaggagaggaaguccaaguccuggcauuagaaccuggaaaaaauccaagagccguccaaacgaaaccuggaauuuucaaaaccaacaccggaaccauaggcgccguaucucuggacuuuuccccuggaacgucaggaucuccaauuguugacagaaaaggaaaaguugugggucuuuacgguaaugguguugucacaaggaguggagcauacguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccaccagagucguggcagcugaaauggaagaagcucuuagaggacuuccaauaagauaccaaaccccagccaucagagccgagcacaccgggcgggagaucguggaccuaaugugucaugccacauuuacuaugaggcugcuaucaccagucagagugccaaauuacaaccugaucaucauggacgaagcccacuucacagacccagcaagcauagcagcuagaggauacauuucaacucggguagagaugggugaagcagcugggauuuucaugacagccacuccuccgggaaguagagacccauuuccucagagcaaugcaccaaucauggaugaggaaagagaaaucccugagcguucguggaauucaggacaugaaugggucacggauuuuaaagggaagacuguuugguuuguuccaaguauaaaagcaggaaaugacaucgcagcuugucuuaggaaaaauggaaagaaagugauacaacucaguagaaagacuuuugauucugaguauguuaagacuagauccaaugauugggauuuuguggucacaacugacauuucagaaaugggugccaacuucaaggcugagaggguuauagaccccagacgcugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucucgaaaaugacgaagacugugcacauuggaaagaagccaaaaugcuccuagauaacaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccugucugguuagccuacaaaguggcagcugaaggcaucaacuacgcagacagaaggugguguuuugauggaauuaagaauaaucaaauacuggaagaaaauguggaaguggaaaucuggacgaaagaaggggaaaggaaaaaauuaaaacccagaugguuggaugcuaggaucuauucugacccacuggcacuaaaagaauucaaggaauuugcagcugggagaaaaucuuugacccugaaccuaaucacagaaauggguaggcucccaacuuucaugacucagaaggcaagaaacgcacuggacaacuuggcugugcugcauacggcugaggcagguggaaaggcguacaaucaugcucucagugaacugccggagacccuggagacacugcuucuacugacacuccuggcaacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccucaagacaaccaauugaccuacguugucauagccauccucacaguaguggccgcaaccauggcgaacgagauggguuuccuggaaaaaacuaagaaagaccucggauugggaagcauuacaacccaggaaucugagagcaacaucuuggacauagaucuacguccugcaucagcauggacgcuguaugccguggcuacaacauuugucacaccaauguugaggcauagcauugaaaauuccucagugaaugucucccuaacagccauugcuaaccaagcuacagugcugaugggucuugggaaaggauggccauugucaaagauggacaucggaguuccccuccucgccauuggaugcuacucacaagucaacccuauaacucucacagcagcucuucucuuauugguagcacacuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugcgaggcucuaaccuuagcgaccgggcccaucuccacauugugggaaggaaauccagggagguuuuggaacacuacuauugcagugucaauggcuaacaucuuuagggggagcuacuuggccggagcuggacuucucuuuuccaucaugaagaacacaacaaacacaagaagaggaacuggcaacauaggagagacacuuggagaaaaauggaaaagccgauuaaacgcacugggaaaaagugaauuucagaucuacaagaaaaguggaauccaggaaguggauagaacccuggcaaaagaaggcaucaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaaaaauguaagagaagucaaaggccuaacaagaggaggaccaggacacgaagaaccuauccccaugucaacauauggguggaaucuagugcgucugcaaaguggaguugacguuuucuucaccccgccagaaaagugugauacauuguugugugacauaggggagucgucaccaaaucccacaauagaagcaggacgaacacucagaguccucaaccuaguggaaaauugguugaacaauaacacccaauuuugcauaaagguccucaacccauauaugcccucaguaauagaaaaaauggaaacacuacaaaggaaauauggaggagccuuagugaggaauccacucucacgaaacuccacgcaugagauguauuggguaucuaaugccaccgggaacauagugucaucagugaacaugaucucaaggauguugaucaacagauucacaaugaaacacaagaaggccaccuacgagccagauguugaccuaggaaguggaacucgcaacauuggaauugaaagugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacagcgcguauucaaagaaaaaguggauacgagaacccaagaaccgaaggaaggcacaaagaaacugaugaaaauuacggcagaguggcuuuggaaagaacuaggaaagaaaaagacaccuaggauguguaccagagaggaauucacaagaaaggugagaagcaaugcagccuugggggccauauucacugaugagaacaaauggaaaucggcacgugaggcuguugaagauggcagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuccugaaugaagaucacugguucuccagagggaacucccugaguggaguggaaggagaagggcugcacaggcuaggcuacaucuuaagagacgugagcaagaaggaagggggagcaauguacgcugaugauacggcaggaugggacacaagaaucacacuagaagacuuaaaaaaugaagaaaugguaacaaaccacaugaaaggagaacacaagaaacuagccgaggccauauucaaauuaacguaccaaaacaaaguggugcgugugcaaagaccaacaccaagaggcacaguaauggauaucauaucgagaagagaccaaagaggcaguggacaagucggcaccuauggccuuaauacuuucaccaacauggaagcccaauuaaucagacagauggagggagaaggaaucuucaaaagcauucagcaccugacagucacagaagaaaucgcuguacagaacuggcuagcaagaguggggcgugaaaggcuaacaagaauggccaucaguggagaugauuguguuguaaaaccuauagaugacagauuugcaaaugcuuuaacagcucuaaaugacaugggaaaaguuaggaaagauauacaacaaugggaaccuucaagaggauggaacgauuggacacaagugccuuucuguucacaccauuuucaugaguuagucaugaaagauggucgcgugcucguagucccaugcagaaaccaagaugaacugauugguagagcccgaauuucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagccgaacaaccugguccauacacgcuaagcaugaauggaugacgacggaagacaugcuggcagucuggaacaggguguggauccaagaaaacccguggauggaagacaaaacuccaguggaaucaugggaagaagucccauacuuggggaaaagagaagaccaaugguguggcucauugauugggcuaacaaguagggcuaccugggcaaagaacauccaaacagcaauaaaccaagucagaucccuuauagguaaugaggaauauacagacuacaugccauccaugaagagauucagaagggaagaggaagaggcagguguccugugguag

SEQ ID NO: 6468 - RNA, 9876 nt, Artificial Sequence
  derived and/or modified CDS sequence (wt) from DENV-2__FJ850082__SS-prME
acaguaggcgugauuguuauguugauuccaacagcgauggcguuucauuuaaccacacgcaauggagaaccacacaugaucguugguaggcaggagaaagggaaaagucuucuguucaaaacagagaauggugucaacaugugcacccucauggccauagaccuuggugaauugugugaagauacaaucacguacaaguguccucuccucagacaaaaugaaccagaagacauagauuguuggugcaacucuacguccacauggguaacuuaugggacauguaccacuacaggagaacacagaagagaaaaaagaucaguggcgcucguuccacauguagguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaauaucaaauagagacuucguagaagggguuucaggaggaagcuggguugacauagucuuagaacauggaagcugugugacgacgauggcaaaaaacaaaccaacauuggauuuugaacuaauaaaaacagaagccaaacaaccugccacucuuaggaaguacuguguagaagcaaagcugaccaacacaacaacagaaucucguugcccaacacaaggggaacccagucuaaaugaagagcaggacaaaagguucauuugcaaacacuccaugguagacagaggauggggaaauggauguggauuauuuggaaagggaggcauugugaccugugcuauguuuacaugcaaaaagaacauggaaggaaaagucgugcagccagagaauuuggaauacaccaucgugauaacaccucacucaggagaagagcacgcuguagguaaugacacaggaaagcauggcaaggaaaucaagauaacaccacagaguuccaucacagaagcagaacugacaggcuaugguacugucacgauggagugcucuccgagaacgggccucgacuucaaugagauggugcugcugcagauggaagacaaagcuuggcugguacacaggcaaugguuccuagaccugccguuaccauggcuacccggagcggacacacaaggaucaaauuggauacagaaagagacauuggucacuuucaaaaauccccacgcgaagaaacaggaugucguugucuuagggucucaagaaggggccaugcauacggcacucacaggggccacagaaauccagaugucaucaggaaacuuacuguucacaggacaucucaagugcaggcugagaauggacaaacuacagcucaaaggaaugucauacucuaugugcacaggaaaguuuaaaauugugaaggaaauagcagaaacgcaacauggaacaauaguuaucagaguacaauaugaaggggacgguucuccauguaagaucccuuuugagauaauggauuuggaaaaaagacacgucuuaggucgccugaucacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacgaugagaggagcaaagagaauggccauuuuaggugacacagccugggauuuuggaucccugggaggaguguucacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggagucgugacacuauaccugggagcuauggugcaggcugacagugguugcguugugagcuggaaaaauaaagaacugaaauguggcagcgggaucuucauuacagacaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgaucuuugcggccccagcccacagaguugaaauacucauggaaaacauggggaaaggcgaaaaugcucuccacagagucucacaaucagaccuuucuuauugauggccccgaaacagcagaaugccccaacacaaacagagcuuggaacucgcuggaagucgaggacuaugguuuuggaguuuuuaccaccaauauauggcuaaaguugagagaaaaacaggauguauuuugugauucaaaacucaugucagcggccguuaaagacaacagagccguccaugcugauauggguuauuggauagaaagugcacucaaugacacauggaagauggagaaagccuccuucauugaaguuaaaagcugccacuggccaaagucacacacucucuggagcaauggaguauuagaaagugagaugauaauuccgaaaaauuuugccgggccagugucacaacacaacuacagaccaggcuaccauacacaaacagcaggaccuuggcaccuaggcaagcuugagauggacuuugauuucugcgaaggaacuacagugguggugacugaggacuguggaaauagaggaccuucucuaagaacgaccacugccucuggaaaacucauaacagaauggugcugccgauccugcacacuaccaccucuaagauacagaggugaggauggaugcugguacgggauggaaaucagaccauugaaagagaaagaggagaauuuggucaauuccuuggucacagccggacaugggcagauugacaacuuuucacuaggagucuugggaauggcacuguuccuggaagaaaugcucaggacccgaguaggaacgaaacaugcaauacugcuaguugcaguaucuuuugugacauugauuacugggaacaugucuuuuagagaccugggaagagugaugguuauggugggcgcuaccaugacggaugacauagguaugggagugacuuaucuugcccuacuagcagcuuucaaaguuagaccaacuuuugcagcuggacuacucuugagaaaacugacuuccaaggaauuaaugauggccaccauaggagucgcucuccuuucccaaagcaccauaccagagaccauucuugaacugacugaugcguuagccuugggcaugauggcucucaaaauagugaaaaauauggaaaaguaccaauuggcagugacuaucauggccauuucgugugucccaaaugcagugauauugcaaaacgcauggaaggugaguugcacaauauuggcagcgguguccguuucuccacugcucuuaacauccucacagcaaaaagcggauuggauaccacuggcauugacgauaaaaggucucaauccaacagccauuuuuuuaacgacucuuucgagaaccagcaagaaaaggagcuggccacuaaaugaagcuaucauggcaguugggauggugagcauuuuagccaguucucuccugaagaaugauauucccaugacagguccauuaguggcuggagggcuccuuacaguauguuaugugcucacuggacgaucggccgauuuggaacuagagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacagcagcagcaugguaccugugggaagugaagaaacaacgggcuggaguauugugggacgucccuucacccccaccaguaggaaaagcugaacuggaagaaggagcuuauagaaucaagcaaagagggauucuaggauauucucagauuggagcuggaguuuacaaagaaggaacauuccauacaauguggcacgucacacguggugcuguucugaugcauagagggaagaggauugaaccaucaugggcagaugucaagaaagaccuagugucauauggaggaggcuggaagcuagaaggagaauggaaggaaggagaggaaguccaaguccuggcauuagaaccuggaaaaaauccaagagccguccaaacgaaaccuggaauuuucaaaaccaacacuggaaccauaggcgccguaucucuggacuuuuccccuggaacgucaggaucuccaauuguugacagaaaaggaaaaguugugggucuuuacgguaaugguguugucacaaggaguggagcauauguaagugcuauagcccagaccgauaaaagcauugaagacaauccagagaucgaagaugacauuuuucgaaagaaaagauugaccaucauggaccuccauccaggagcaggaaagacaaaaagauaccuuccagccauaguuagagaagccauaaaacguggcuugagaacauuaauccuggcucccaccagagucguggcagcugaaauggaagaagcucuuagaggacuuccaauaagguaccaaaccccagccaucagagccgagcacaccgggcgggagaucguggacuuaaugugucaugccacauuuacuaugaggcugcuaucaccagucagagugccaaauuacaaccugaucaucauggacgaagcccacuucacagacccagcaagcauagcagcuagaggauacauuucaacucggguagagaugggugaagcagcugggauuuucaugacagccacuccuccgggaaguagagacccauuuccucagagcaaugcaccaaucauggaugaggaaagagaaaucccugagcguucguggaauucaggacaugaaugggucacggauuuuaaagggaagacuguuugguuuguuccaaguauaaaagcaggaaaugacaucgcagcuugucuuaggaagaauggaaagaaagugauacaacucaguagaaagacuuuugacucugaguauguuaagacuagagccaaugauugggauuuuguggucacaacugacauuucagaaaugggugccaacuucaaggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucucgaaaaugacgaagacugugcacauuggaaagaagccaaaaugcuccuagauaacaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccagucugguuagccuacaaaguggcagcugaaggcaucaacuacgcagacagaaggugguguuuugauggaauuaagaauaaucaaauacuggaagaaaauguggaaguggaaaucuggacgaaagaaggggaaaggaaaaaauuaaaacccagaugguuggaugcuaggaucuauucugacccacuagcacuaaaagaauucaaggaauuugcagcugggagaaaaucuuugacccugaaccuaaucacagaaauggguaggcuuccaacuuucaugacucagaaggcaagaaacgcacuggacaacuuggcugugcugcauacggcugaggcagguggaaaggcguacaaucaugcucucagugaacugccggagacccuggagacacugcuucuacugacacuccuggcaacagucacaggaggaaucuucuuauucuuaaugagcggaaaagguauagggaagaugacccugggaauguguugcauaaucacagcuaguauccuacuaugguaugcacagauacaaccacacuggauagcagcuucaauaauacuggaguuuuuucucauaguuuugcucauuccagaaccagaaaaacagagaacaccucaagacaaccaauugaccuacguugucauagccauccucacaguaguggccgcaacaauggcgaacgagauggguuuccuggaaaaaaccaagaaagaucucggauugggaagcauuacaacccaggaaucugagagcaacaucuuggacauagaucuacguccugcaucagcauggacgcuguaugccguggcuacaacauuugucacaccaauguugaggcauagcauugaaaauuccucagugaaugucucccuaacagccauugcuaaccaagcuacagugcugaugggucucgggaaaggauggccauugucaaagauggacaucggaguuccccuccucgccauuggaugcuacucacaagucaacccuauaacucucacagcagcucuucucuuauugguagcacauuaugccauuauagggccaggacuucaagcaaaagcaaccagagaagcucagaagagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugcgaggcucuaaccuuagcgaccgggcccaucuccacauugugggaaggaaauccagggagguuuuggaacacuacuauugcagugucaauggcuaacaucuuuagggggagcuacuuggccggagcuggacuucucuuuuccaucaugaagaacacaacaaacacaagaagaggaacuggcaacauaggagagacacuuggagaaaaauggaaaagccgauuaaacgcacugggaaaaagugaauuucagaucuacaagaaaaguggaauccaggaaguggauagaacccuggcaaaagaaggcaucaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacacgaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguccucaacccauauaugcccucaguaauagaaaaaauggaaacacuacaaaggaaauauggaggagcccuagugaggaauccacucucacgaaacuccacgcaugagauguauuggguaucuaaugccaccgggaacauagugucaucagugaacaugauuucaaggauguugauuaacagauucacaaugaaacacaagaaagccaccuacgagccagauguugaccuaggaaguggaacucgcaacauuggaauugaaagugagguaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacagcgcguuuucaaagagaaaguagacacgagaacccaagaaccgaaggaaggcacaaagaaacugaugaaaauuacggcagaguggcuuuggaaagaacuaggaaagaaaaagauaccuaggauguguaccagagaagaauucacaagaaaggugagaagcaaugcagccuugggggccauauucacugaugagaacaaauggaaaucggcacgugaggcuguugaagaugguagguuuugggagcugguugacagggaaagaaaucuccaucuugagggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuccugaaugaagaucacugguucuccagagggaacucccugaguggaguggaaggagaagggcugcacaggcuaggcuacauuuuaagagacgugagcaagaaggaagggggagcaauguacgccgaugauacagcaggaugggacacaagaaucacacuagaagacuuaaaaaaugaagaaaugauaacaaaccacaugaaaggagaacacaagaaacuagccgaggccauauucaaauuaacguaccaaaacaaaguggugcgugugcaaagaccaacaccaagaggcacaguaauggauaucauaucgagaagagaccaaagaggcagugggcaagucggcaccuauggccuuaauacuuucaccaauauggaagcccaauuaaucagacagauggagggagaaggaaucuucaaaagcauucagcaccugacagucacagaagaaaucgcuguacagaacuggcuagcaagaguggggcgugaaaggcuaacaagaauggccaucaguggagaugauuguguuguaaaaccuauagaugacagauuugcaaaugcuuuaacagcucuaaaugacaugggaaaaguuaggaaagauauacaacaaugggaaccuucaagaggauggaacgauuggacacaagugccuuucuguucacaccauuuucaugaguuagucaugaaagauggucgcgugcucguagucccaugcagaaaccaagaugaacugauugguagagcccgaauuucccagggagccggguggucucugaaggagacggccuguuuggggaagucuuacgcccaaauguggacccugauguacuuccacagacgugaccucagacuggcggcaaaugccauuugcucggcaguuccgucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccauacuuggggaaaagagaagaccaaugguguggcucauugauuggguuaacaagcagggcuaccugggcaaagaacauccaaacagcaauaaaccaagucagaucccucauaggcaaugagggauauacagacuacaugccauccaugaagagauucagaagggaagaggaagaggcagguguccugugguag

SEQ ID NO: 6469 - RNA, 9876 nt, Artificial Sequence
  derived and/or modified CDS sequence (wt) from DENV-2__FJ850085__SS-prME
acaguaggcgugauuguuauguugauuccaacagcgauggcguuucauuuaaccacacgcaauggagaaccacacaugaucguugguaggcaggagaaagggaaaagucuucuguucaaaacagagaauggugucaacaugugcacccucauggccauagaccuuggugaauugugugaagauacaaucacguacaaguguccucuccucagacaaaaugaaccagaagacauagauuguuggugcaacucuacguccacauggguaacuuaugggacauguaccacuacaggagaacacagaagagaaaaaagaucaguggcgcucguuccacauguagguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaauaucaaauagagacuucguagaagggguuucaggaggaagcuggguugacauagucuuagaacauggaagcugugugacgacgauggcaaaaaacaaaccaacauuggauuuugaacuaauaaaaacagaagccaaacaaccugccacucuuaggaaguacuguguagaagcaaagcugaccaacacaacaacagaaucucguugcccaacacaaggggaacccagucuaaaugaagagcaggacaaaagguucauuugcaaacacuccaugguagacagaggauggggaaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcuguagguaaugacacaggaaagcauggcaaggaaaucaagauaacaccacagaguuccaucacagaagcagaacugacaggcuaugguacugucacgauggaaugcucuccgagaacgggccucgacuucaaugagauggugcugcugcagauggaagacaaagcuuggcugguacacaggcaaugguuccuagaccugccguuaccauggcuaccuggagcggacacacaaggaucaaauuggauacagaaagagacauuggucacuuucaaaaauccccacgcgaagaaacaggaugucgucgucuuagggucucaagaaggggccaugcauacggcacucacaggggccacagaaauccagaugucaucaggaaacuuacuguucacaggacaucucaagugcaggcugagaauggacaaacuacagcucaaaggaaugucauacucuaugugcacaggaaaguuuaaaauugugaaggaaauagcagaaacgcaacauggaacaauaguuaucagaguacaauaugaaggggacgguucuccauguaagaucccuuuugagauaauggauuuggaaaaaagacacgucuuaggucgccugaucacaguuaacccaaucguagcagaaaaagauagcccagucaacauagaagcagaaccuccauucggagacagcuacaucaucauaggaguagagccgggacaauugaaacucaauugguuuaagaagggaaguuccaucggccaaauguuugagacaacgaugagaggagcaaagagaauggccauucuaggugacacagccugggauuuuggaucccugggaggaguguucacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggagucgugacacuauaccugggagcuauggugcaggcugacagugguugcguugugagcuggaaaaacaaagaacugaaauguggcagcgggaucuucauuacagacaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgaucuuugcggccccagcccacagaguugaaauacucauggaaaacauggggaaaggcgaaaaugcucuccacagagucucacaaucagaccuuucuuauugauggccccgaaacagcagaaugccccaacacaaacagagcuuggaacucgcuggaagucgaggacuaugguuuuggaguuuuuaccaccaauauauggcuaaaguugagagaaaaacaggauguauuuugugacucaaaacucaugucagcggccguuaaagacaacagagccguccaugcugauauggguuauuggauagaaagugcacucaaugacacauggaagauggagaaagccuccuucauugaaguuaaaagcugccacuggccaaagucacacacucucuggagcaauggaguauuagaaagugagaugauaauuccgaaaaauuucgccgggccagugucacaacacaacuacagaccaggcuaccauacacaaacagcaggaccuuggcaccuaggcaagcuugagauggacuuugauuucugcgaaggaacuacagugguggugacugaggacuguggaaauagaggaccuucucuaagaacgaccacugccucuggaaaacucauaacagaauggugcugccgauccugcacacuaccaccucuaagauacagaggugaggauggaugcugguacgggauggaaaucagaccauugaaagagaaagaggagaauuuggucaauuccuuggucacagccggacaugggcagauugacaacuuuucacuaggagucuugggaauggcacuguuccuggaagaaaugcucaggacccgaguaggaacgaaacaugcaauacugcuaguugcaguaucuuuugugacauugauuacugggaacaugucuuuuagagaccugggaagagugaugguuauggugggcgcuaccaugacggaugacauagguaugggagugacuuaucuugcccuacuagcagcuuucaaaguuagaccaacuuuugcagcuggacuacucuugagaaaacugacuuccaaggaauuaaugauggccaccauaggagucgcucuccuuucccaaagcaccauaccagagaccauucuugaacugacugaugcguuagccuugggcaugauggcucucaaaauagugaaaaauauggaaaaguaccaauuggcagugacuaucauggccauuucgugugucccaaaugcagugauauugcaaaacgcauggaaggugaguugcacaauauuggcagcgguguccguuucuccacugcucuuaacauccucacagcaaaaagcggauuggauaccacuggcauugacgauaaaaggucucaauccaacagccauuuuuuuaacgacucuuucgagaacuagcaagaaaaggagcuggccacuaaaugaagcuaucauggcaguugggauggugagcauuuuagccaguucucuccugaagaaugauauucccaugacagguccauuaguggcuggagggcuccuuacaguauguuaugugcucacuggacgaucggccgauuuggaacuagagagagcugccgauguaaaaugggaagaucaggcagaaauaucaggaagcagcccaauccugucaauaacaauaucagaagauggcagcaugucgauaaaaaaugaagaggaagaacaaacacugaccauacucauuagaacgggauuguuggugaucucaggagucuuuccaguaucgauaccaauuacggcagcagcaugguaccugugggaagugaagaaacaacgggcuggaguauugugggacgucccuucacccccaccaguaggaaaagcugaacuggaagaaggagcuuauagaaucaagcaaagagggauucuaggauauucucagauuggagcuggaguuuacaaagaaggaacauuccauacaauguggcacgucacacgcggugcuguucugaugcauagagggaagaggauugaaccaucaugggcagaugucaagaaagaccuagugucauauggaggaggcuggaagcuagaaggagaauggaaggaaggagaggaaguccaaguccuggcauuagaaccuggaaaaaauccaagagccguccaaacgaaaccuggaauuuucaaaaccaacacuggaaccauaggcgccguaucucuggacuuuuccccuggaacgucaggaucuccaauuguugacagaaaaggaaaaguugugggucuuuacgguaaugguguugucacaaggaguggagcauauguaagugcuauagcccagaccgauaaaagcauugaagacaauccagagaucgaagaugacauuuuucgaaagaaaagauugaccaucauggaccuccauccaggagcaggaaagacaaaaagauaccuuccagccauaguuagagaagccauaaaacguggcuugagaacauuaauccuggcucccaccagagucguggcagcugaaauggaagaagcucuuagaggacuuccaauaagguaccaaaccccagccaucagagccgagcacaccgggcgggagaucguggacuuaaugugucaugccacauuuacuaugaggcugcuaucaccagucagagugccaaauuacaaccugaucaucauggacgaagcccacuucacagacccagcaagcauagcagcuagaggauacauuucaacucggguagagaugggugaagcagcugggauuuucaugacagccacuccuccgggaaguagagacccauuuccucagagcaaugcaccaaucauggaugaggaaagagaaaucccugagcguucguggaauucaggacaugaaugggucacggauuuuaaagggaagaccguuugguuuguuccaaguauaaaagcaggaaaugacaucgcagcuugucuuaggaagaauggaaagaaagugauacaacucaguagaaagacuuuugacucugaguauguuaagacuagagccaaugauugggauuuuguggucacaacugacauuucagaaaugggugccaacuucaaggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucucgaaaaugacgaagacugugcacauuggaaagaagccaaaaugcuccuagauaacaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccagucugguuagccuacaaaguggcagcugaaggcaucaacuacgcagacagaaggugguguuuugauggaauuaagaauaaucaaauacuggaagaaaauguggaaguggaaaucuggacgaaagaaggggaaaggaaaaaauuaaaacccagaugguuggaugcuaggaucuauucugacccacuagcacuaaaagaauucaaggaauuugcagcugggagaaaaucuuugacccugaaccuaaucacagaaauggguaggcuuccaacuuucaugacucagaaggcaagaaacgcacuggacaacuuggcugugcugcauacggcugaggcagguggaaaggcguacaaucaugcucucagugaacugccggagacccuggagacacugcuucuacugacacuccuggcaacagucacaggaggaaucuucuuauucuuaaugagcggaaaagguauagggaagaugacccugggaauguguugcauaaucacagcuaguauccuacuaugguaugcacagauacaaccacacuggauagcagcuucaauaauacuggaguuuuuucucauaguuuugcucauuccagaaccagaaaaacagagaacaccucaagacaaccaauugaccuacguugucauagccauccucacaguaguggccgcaacaauggcgaacgagauggguuuccuggaaaaaaccaagaaagaucucggauugggaagcauuacaacccaggaaucugagagcaacaucuuggacauagaucuacguccugcaucagcauggacgcuguaugccguggcuacaacauuugucacaccaauguugaggcauagcauugaaaauuccucagugaaugucucccuaacagccauugcuaaccaagcuacagugcugaugggucucgggaaaggauggccauugucaaagauggacaucggaguuccccuccucgccauuggaugcuacucacaagucaacccuauaacucucacagcagcucuucucuuauugguagcacauuaugccauuauagggccaggacuucaagcaaaagcaaccagagaagcucagaagagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuuaugcgaggcucuaaccuuagcgaccgggcccaucuccacauugugggaaggaaauccagggagguuuuggaacacuacuauugcagugucaauggcuaacaucuuuagggggagcuacuuggccggagcuggacuucucuuuuccaucaugaagaacacaacaaacacaagaagaggaacuggcaacauaggagagacacuuggagaaaaauggaaaagccgauuaaacgcacugggaaaaagugaauuucagaucuacaagaaaaguggaauccaggaaguggauagaacccuggcaaaagaaggcaucaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacacgaagaaccuauccccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguccucaacccauauaugcccucaguaauagaaaaaauggaaacacuacaaaggaaauauggaggagcccuagugaggaauccacucucacgaaacuccacgcaugagauguauuggguaucuaaugccaccgggaacauagugucaucagugaacaugauuucaaggauguugauuaacagauuuacaaugaaacacaagaaagccaccuacgagccagauguugaccuaggaaguggaacucgcaacauuggaauugaaagugagguaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacagcgcguuuucaaagagaaaguggacacgagaacccaagaaccgaaggaaggcacaaagaaacugaugaaaauuacggcagaguggcuuuggaaagaacuaggaaagaaaaagauaccuaggauguguaccagagaagaauucacaagaaaggugagaagcaaugcagccuugggggccauauucacugaugagaacaaauggaaaucggcacgugaggcuguugaagaugguagguuuugggagcugguugacagggaaagaaaucuccaucuugagggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuccugaaugaagaucacugguucuccagagggaacucccugaguggaguggaaggagaagggcugcacaggcuaggcuacauuuuaagagacgugagcaagaaggaagggggagcaauguacgccgaugauacagcaggaugggacacaagaaucacacuagaagacuuaaaaaaugaagaaaugauaacaaaccacaugaaaggagaacacaagaaacuagccgaggccauauucaaauuaacguaccaaaacaaaguggugcgugugcaaagaccaacaccaagaggcacaguaauggauaucauaucgagaagagaccaaagaggcagugggcaagucggcaccuauggccuuaauacuuucaccaauauggaagcccaauugaucagacagauggagggagaaggaaucuucaaaagcauucagcaccugacagucacagaagaaaucgcuguacagaacuggcuagcaagaguggggcgugaaaggcuaacaagaauggccaucaguggagaugauuguguuguaaaaccuauagaugacagauuugcaaaugcuuuaacagcucuaaaugacaugggaaaaguuaggaaagauauacaacaaugggaaccuucaagaggauggaacgauuggacacaagugccuuucuguucacaccauuuucaugaguuagucaugaaagauggucgcgugcucguagucccaugcagaaaccaagaugaacugauugguagagcccgaauuucccagggagccggguggucucugaaggagacggccuguuuggggaagucuuacgcccaaauguggacccugauguacuuccacagacgugaccucagacuggcggcaaaugccauuugcucggcaguuccgucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccauacuuggggaaaagagaagaccaaugguguggcucauugauuggguuaacaagcagggcuacuugggcaaagaacauccaaacagcaauaaaccaagucagaucccucauaggcaaugagggauauacagacuacaugccauccaugaagagauucagaagggaagaggaagaagcagguguccugugguag

SEQ ID NO: 6470 - RNA, 9876 nt, Artificial Sequence
  derived and/or modified CDS sequence (wt) from DENV-2__FJ850088__SS-prME
acagcaggugugauuguuauguugauuccaacagugauggcguuucauuuaaccacacgcaauggagaaccacacaugaucguuggcaggcaggagaaagggaaaagucuccuguuuaaaacagaggauggugucaacaugugcacccucauggccauagaccuuggugaauugugugaagauacaaucacguacaaguguccucuccucagacaaaaugaaccagaagacauagauuguuggugcaacucuacauccacauggguaacuuaugggacauguaccaccacaggagaacacagaagagagaaaagaucaguggcgcucguuccacauguggguaugggacuggagacacgaacugaaacauggaugucaucagaaggggccuggaaacauguucagagaauugaaaccuggaucuugagacauccaggcuuuaccaugauggcagcaauccuggcauacaccauaggaacgacacauuuccaaagggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacuaauaaaaacagaagccaaacaaccugccacucuuaggaaguacuguguagaagcaaagcugaccaacacaacaacagaaucucguugcccaacacaaggggaacccagucuaaaugaagagcaggacaaaagguucauuugcaaacacuccaugguagacagaggauggggaaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcaugcuguagguaaugacacaggaaagcauggcaaggaagucaaaauaacaccacagaguucuaucacagaagcagaacugacaggcuaugguacugucacgauggagugcucuccgagaacgggccucgacuucaaugagauggugcugcugcagauggaagacaaagcuuggcugguacacaggcaaugguuccuagaccugccguuaccauggcuacccggagcggacacacaaggaucaaauuggauacaaaaagagacauuggucacuuucaaaaauccccacgcgaagaaacaggaugucguuguuuuagggucucaggaaggggcuaugcauacggcacucacaggggcuacagaaauccagaugucaucaggaaacuuacuguucacaggacaucucaaaugcaggcugagaauggacaaacuacagcucaaaggaaugucauacucuaugugcacaggaaaguuuaaaauugugaaggaaauagcagaaacgcaacauggaacaauaguuaucagaguacaauaugaaggggacgguucuccauguaagaucccuuuugagauaauggaucuggaaaaaagacacgucuuaggccgccugaucacaguuaacccaaucguaacagaaaaagauagcccagucaacauagaagcagaaccuccauucggagacagcuacaucaucguaggaguagagccgggacaauugaaacucaauugguuuaagaagggaaguuccaucggccaaauguuugagacaacgaugagaggagcaaagagaauggccauuuuaggugacacagccugggauuuuggaucccugggaggaguguuuacaucuauaggaaaggcucuccaccaaguuuucggagcaaucuauggggcugcuuuuaauggggucucauggacuaugaaaauccucauuggagucaucaucacauggauaggaaugaauucacguagcaccucacugucugugucgcuaguauuggugggagucgugacacuauaccugggagcuauggugcaggcugacagugguugcguugugagcuggaaaaauaaagaacugaaauguggcagcgggaucuucauuacagacaacgugcacacauggacagaacaauauaaguuccaaccagaauccccuucaaagcuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgaucuuugcggccccagcccacagaguugaaauacucauggaaaacauggggaaaggcgaaaaugcuccccacagagucucacaaucagaccuuucucauugauggccccgaaacagcagaaugccccaacgcaaacagagcuuggaacucgcuggaagucgaagacuaugguuuuggaguuuuuaccaccaauauauggcuaaaguugagagaaaaacaggauguauuuugugacucaaaacucaugucagcggccauuaaagacaacagagccguccaugcugauauggguuauuggauagaaagugcacucaaugacacauggaagauggagaaagccuccuucauugaaguuaaaagcugccacuggccaaagucacacacccucuggagcaauggaguauuagaaagugagaugauaauuccaaaaaauuuugccgggccagugucacaacacaacuacagaccaggcuaccauacacaaacagcaggaccuuggcaucuaggcaagcuugagauggacuuugauuucugcgaaggaacuacagugguggugacugaggauuguggaaauagaggaccuucuuuaagaacgaccacugccucuggaaaacucauaacagaauggugcugccgauccugcacacuaccaccucuaagauacagaggugaggauggaugcugguacgggauggaaaucagaccauugaaagagaaagaggagaauuuggucaauuccuuggucacagccggacaugggcagauugacaacuuuucacuaggagucuugggaauggcacuguuccuggaagaaaugcucaggacccgaguaggaacgaaacaugcaauacugcuaguugcaguaucucuugugacauugauuacugggaacaugucuuuuagagaccugggaagagugaugguuauggugggcgcuacuaugacggaugacauagguaugggagugacuuaucuugcccuacuagcagcuuucaaaguuagaccaacuuuugcagcuggacuacucuugagaaaacugacuuccaaggaauuaaugauggccaccauaggagucgcucuccuuucccaaagcaccauaccagagaccauucuugaacugacugaugcguuagccuugggcaugauggcucucaaaguagugaaaaauauggaaaaguaucaauuggcagugacuaucauggccauuucgugcgucccaaaugcagugauauugcaaaacgcauggaaggugaguugcacaauauuggcagcgguguccguuucuccacugcucuuaacauccucacagcagaaagcggauuggauaccacuggcauugacgauaaaaggucucaauccaacagccauuuuucuaacgacucuuucgagaaccagcaagaaaaggagcuggccacuaaaugaagcugucauggcaguugggauggugagcauuuuagccaguucucuccugaagaaugauauucccaugacagguccauuaguggcuggagggcuccuuacaguauguuaugugcucacuggacgaucggccgauuuggaacuagagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaagugaagaaacaacgggccggaguauugugggacgucccuucacccccaccaguagaaaaagcugaacuggaagauggagccuauagaaucaagcaaagagggauucuaggauauucucagauuggagccggaguuuacaaagaaggaacauuccauacgauguggcacgucacacguggugcuguucugaugcauagagggaagaggauugaaccaucaugggcagaugucaagaaagaccuagugucauauggaggaggcuggaagcuagaaggagaauggaaagaaggagaggaaguccaaguccuggcauuagaaccuggaaaaaauccaagagccguccaaacgaaaccuggaauuuucaaaaccaacaccggaaccauaggcgccguaucucuggacuuuuccccuggaacgucaggaucuccaauuguugacagaaaaggaaaaguugugggucuuuacgguaaugguguugucacaaggaguggagcauacguaagugcuauagcccagaccgaaaaaagcauugaagacaauccagagaucgaagaugacauuuuccgaaagaaaagacugaccaucauggaccuccauccaggagcaggaaagacaaaaagauaccuuccagccauaguuagagaagccauaaaacguggcuugagaacauuaauccuggcucccaccagagucguggcagcugaaauggaagaagcucuuagaggacuuccaauaagauaccaaaccccagccaucagagccgaacacaccgggcgggagaucguggaccuaaugugucaugccacauuuacuaugaggcugcuaucaccagucagagugccaaauuacaaccugaucaucauggacgaagcccacuucacagacccagcaagcauagcagcuagaggauauauuucaacucggguagagaugggugaagcagcugggauuuucaugacagccacuccuccgggaaguagagacccauuuccucagagcaaugcaccaaucauggaugaggaaagagaaaucccugagcguucguggaauucaggacaugaaugggucacggauuuuaaagggaagacuguuugguuuguuccaaguauaaaagcaggaaaugacaucgcagcuugucuuaggaaaaauggaaagaaagugauacaacucaguagaaagacuuuugauucugaguauguuaagacuagauccaaugauugggauuuuguggucacaacugacauuucagaaaugggugccaacuucaaggcugagaggguuauagaccccagacgcugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucucgaaaaugacgaagacugugcacauuggaaagaagccaaaaugcuccuagauaauaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccugucugguuagccuacaaaguggcagcugaaggcaucaacuacgcagacagaaggugguguuuugauggaauuaagaauaaucaaauacuggaagaaaauguggaaguggaaaucuggacgaaagaaggggaaaggaaaaaauuaaaacccagaugguuggaugcuaggaucuauucugacccacuggcacuaaaagaauucaaggaauuugcagcugggagaaaaucuuugacccugaaccuaaucacagaaauggguaggcucccaacuuucaugacucagaaggcaagaaacgcacuggacaacuuggcugugcugcauacggcugaggcagguggaaaggcguacaaucaugcucucagugaacugccggagacccuggagacacugcuucuacuggcacuccuggcaacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcuuauuccagaaccagaaaaacagagaacaccucaagacaaccaauugaccuacguugucauagccauccucacaguaguggccgcaaccauggcgaacgagauggguuuccuggaaaaaacuaagaaagaccucggauugggaagcauuacaacccaggaaucugagagcaacaucuuggacauagaucuacguccugcaucagcauggacguuguaugccguggcuacaacauuugucacaccaauguugaggcauagcauugaaaauuccucagugaaugucucccuaacagccauugcuaaccaagcuacagugcugaugggucuugggaaaggauggccauugucaaagauggacaucggaguuccccuccucgccauuggaugcuacucacaagucaacccuauaacucucacagcagcucuucucuuauugguagcacacuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugcgaggcucuaaccuuagcgaccgggcccaucuccacauugugggaaggaaauccagggagguuuuggaacacuacuauugcagugucaauggcuaacaucuuuagggggagcuacuuggccggagcuggacuucucuuuuccgucaugaagaacacaacaaacacaagaagaggaacuggcaacauaggagagacacuuggagaaaaauggaaaagccgauuaaacgcacugggaaaaagugaauuucagaucuacaagaagaguggaauccaggaaguggauagaacccuggcaaaagaaggcaucaaaagaggagaaacggaccaccaugcugugucgcgagguucagcaaaacugagaugguucgucgagagaaauauggucacaccggaagggaaggugguggaucucgguugcggcagagggggcuggucauacuacugugggggacuaaaaaauguaagagaagucaaaggccuaacaagaggaggaccaggacacgaagaaccuauccccaugucaacauauggguggaaucuagugcgucugcaaaguggaguugacguuuucuucaccccgccagaaaagugugauacauuguugugugacauaggggagucgucaccaaaucccacaauagaagcaggacgaacacucagaguccucaaccuaguggaaaauugguugaacaauaauacccaauuuugcauaaagguccucaacccauauaugcccucaguaauagaaaaaauggaaacacuacaaaggacauauggaggagccuuagugaggaauccacucucacgaaacuccacgcaugagauguauuggguaucuaaugccaccgggaacauagugucaucagugaacaugaucucaaggauguugaucaacagauucacaaugaaacacaagaaggccaccuacgagccagauguugaccuaggaaguggaacucgcaacauuggaauugaaagugagauaccaaaucuagacauaauaggaaagagaauagagaaaauaaagcaagagcaugagacaucauggcacuaugaucaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacagcgcguauucaaagaaaaaguggauacgagaacccaagaaccgaaggaaggcacaaagaaacugaugaaaauuacggcagaguggcuuuggaaagaacuaggaaagaaaaagacaccuaggauguguaccagagaggaauucacaagaaaggugagaagcaaugcagccuugggggccauauucacugaugagaacaaauggaaaucggcacgugaggcuguugaagauggcagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagccuuaggauuccugaaugaagaucacugguucuccagagggaacucccugaguggaguggaaggagaagggcugcacaggcuaggcuacaucuuaagagacgugagcaggaaggaagggggagcaauguacgcugaugauacggcaggaugggacacaagaaucacacuagaagacuuaaaaaaugaagaaaugguaacaaaccacaugaaaggagaacacaagaaacuagccgaggccauauucaaauuaacguaccaaaacaaaguggugcgugugcaaagaccaacaccaagaggcacaguaauggauaucauaucgagaagagaccaaagaggcaguggacaagucggcacuuacggccuuaauacuuucaccaacauggaagcccaauuaaucagacagauggagggagaaggaaucuucaaaagcauucagcaccugacagucacagaagaaaucgcuguacagaacuggcuagcaagaguggggcgugaaaggcuaacaagaauggccaucaguggagaugauuguguuguaaaaccuauagaugacagauuugcaaaugcuuuaacagcucuaaaugacaugggaaaaguuaggaaagauauacaacaaugggaaccuucaagaggauggaacgauuggacacaagugccuuucuguucacaccauuuucaugaguuagucaugaaagauggucgcgugcucguagucccaugcagaaaccaagaugaacugauugguagagcccgaauuucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagccgaacaaccugguccauacacgcuaagcaugaauggaugacgacggaagacaugcuggcagucuggaacaggguguggauccaagaaaacccguggauggaagacaaaacuccaguggaaucaugggaagaagucccauacuuggggaaaagagaagaccaaugguguggcucauugauugggcuaacaaguagggcuaccugggcaaagaacauccaaacagcaauaaaccaagucagaucccucauagguaaugaggaauauacagacuacaugccauccaugaagagauucagaagggaagaggaagaggcagguguccugugguag

SEQ ID NO: 6471 - RNA, 9876 nt, Artificial Sequence
  derived and/or modified CDS sequence (wt) from DENV-2__FJ850091__SS-prME
acagcaggcguaauuguuauguugauuccaacagcgauggcguuccauuuaaccacacgcaauggagaaccacacaugaucguugguaggcaggagaaagggaaaagucuucuguucaaaacagaggaugguguuaacauguguacccucauggccauggaccuuggugaguugugugaagauacaaucacguacaaguguccccuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugaaacauggaugucaucggaaggggccuggaagcauguucagagaauugaaaccuggaucuugagacauccagguuuuaccauaauggcagcgauccuggcauacaccauaggaacgacacacuuccaaagggccuugauuuucaucuuacugacagcugucgcuccuucaaugacaaugcgcugcauaggaauaucaaauagagacuucguagaagggguuucaggaggaagcuggguugacaucguuuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaaaucguacagccagaaaauuuggaauacaccaucgugauaacaccucacucaggagaagagcacgcuguagguaaugacacaggaaagcauggcaaggaaaucaaaauaacaccacagaguuccaccacagaagcagaacugacaggcuauggcacugucacgauggagugcucuccgagaacgggccucgacuucaaugagauggugcugcugcagauggaagacaaagcuuggcuggugcacaggcaaugguuccuagaccugccguugccauggcuacccggagcggauacacaaggaucaaauuggauacagaaagagacauuggucacuuucaaaaauccccacgccaagaaacaggaugucguugucuuagggucucaagaaggggccaugcacacggcacucacaggggcuacagaaauccagaugucaucaggaaacuuacuguucacgggacaucucaagugcaggcugagaauggacaaacuacagcucaaaggaaugucauacucuauguguacaggaaaguuuaaaaucgugaaggaaauagcagaaacacaacauggaacaauaguuaucagaguacaauaugaaggggacgguucuccauguaagaucccuuuugagauaacagauuuggaaaaaagacacgucuuaggacgccugauuacaguuaacccaaucguaacagaaaaagauagcccagucaacauagaagcagaacccccauucggagacagcuacaucaucguaggaguagagccgggacaacugaaacucaauugguuuaagaagggaagcuccaucggccaaauguuugagacaacaaugagaggagcaaagagaauggccauuuuaggugacacagccugggauuuuggaucccugggaggaguguuuacaucuauaggaaaggcucuccaucaaguuuucggagcaaucuauggggcugcuuuuaguggggucucauggacuaugaaaauccucauaggagucaucaucacauggauaggaaugaauucacguagcaccucacugucugugucgcuaguauuggugggagucgugacacuguaccugggagcuauggugcaggcugauagugguugcauugugagcuggaaaaauaaagaacugaaauguggcagcgggaucuucauuacagauaacguacacacauggacagagcaauauaaguuccaaccagaauccccuucaaaauuagcuucagcuauccaaaaagcucaugaagaaggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgauccuugcggccucagcccacugagcugaaguacucauggaaaacauggggaaaggcgaaaaugcucucuacagagucucacaaucagaccuuucuuauugauggcccugaaacagcagaaugccccaacacaaacagagcuuggaacucacuggaaguugaagacuaugguuuuggaguuuuuaccaccaauauauggcuaaaauugagagaaaaacaggauguauuuugugacucaaaacucaugucagcggccauuaaagacaacagagccguccaugccgauauggguuauuggauagaaagugcacucaaugacacauggaagauggagaaagccuccuucauugaaguuaaaagcugccacuggccaaagucacacacccucuggagcaauggaguauuagaaagugagaugauaauuccaaaaaauuuugccgggccagugucacaacacaacuacagaccaggcuaccauacacaaacagcaggaccuuggcaucuagguaagcuugagauggacuuugauuucugcgaaggaacuacagugguggugacugaggacuguggaaauaggggacccucuuuaagaacgaccacugccucuggaaagcucauaacagaauggugcugccgauccugcacacuaccaccucuaagauacagaggugaggauggaugcugguacgggauggaaaucagaccuuugaaagagaaagaagagaacuuggucaacuccuuggucacagccggacaugggcagauugacaacuuuucacuaggagucuugggaauggcacuguuccuggaagaaaugcuuaggacccgaguaggaacgaaacaugcaauacugcuaguugcacuaucuuucgugacauugauuacugggaacaugucuuuuagagaccugggaagagugauggucauggugggcgcuaccaugacggaugacauagguaugggagugacuuaucuugcccuacuagcagcuuucaaaguuagaccaacuuuugcagcuggacuacucuugagaaaacugaccuccaaggaauugaugauggccaccauaggaaucgcacuccuuucccaaagcaccuugccagagaccauucuagaacugacugaugcguuagccuugggcaugauggcccucaaaauagugagaaauauggaaaaauaccaauuggcagugacuaucauggcuauuucgugugucccaaaugcagugauauugcaaaacgcauggaaggugaguugcacaauauuggcagcgguguccguuucuccacugcuccuaacauccucacagcagaaagcggauuggauaccacuggcauugacgauaaaaggucucaacccaacagccauuuuucuaacaacucuuucgagaaccagcaagaaaaggagcuggccgcuaaaugaagcuaucauggcagucgggauggugagcauuuuagccaguucucuccuaaagaaugauauuccuaugacagguccauuaguggcuggagggcuccucaccguauguuacgugcucacuggacgagcggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucauuagaacgggauuguuggugaucucaggagucuuuccaguaucgauaccaauuacggcagcagcaugguaccugugggaagugaagaaacaacgggcuggaguauugugggacgucccuucacccccaccagugggaaaagccgaacuggaagauggagccuauagaaucaagcaaagagggauucuuggauauucucagauuggagccggaguuuacaaagaaggaacauuccauacaauguggcacgucacacguggugcuguucugaugcauagagggaagaggauugaaccaucaugggcagaugucaagaaagaucuaauaucauaugggggaggcuggaagcuagaaggagaauggaaggaaggagaggaaguccaaguccuggcauuggaaccuggaaaaaaucccagagcuguccaaacgaaaccuggaauuuucaaaaccaacaccggaaccauaggcgcuguaucucuggacuuuuccccuggaacgucaggaucuccaauugucgacagaaaaggaaaaguugugggucuuuacgguaaugguguugucacaaggaguggagcauacguaagugccauagcccagaccgaaaaaagcauugaagacaauccagagaucgaagaugacauuuuccgaaagaaaagauugaccaucauggaccuccauccaggggcaggaaagacaaaaagauaccuuccagccauaguuagagaagccauaaaacguggcuugagaacauuaauccuggcucccacuagagucguggcagcugaaauggaggaagcucuuagaggacuuccaauaagauaccaaaccccagccaucagagccgagcacaccgggcgagagaucguggaccuaaugugucaugccacauuuacuaugaggcugcuaucaccagucagagugccaaauuacaaccugauuaucauggacgaagcccacuucacagacccagcaagcauagcagcuagaggauacauuucaacucgaguagagaugggugaagcagccgggauuuuuaugacagccacuccuccgggaagcagagacccauuuccucagagcaaugcaccaaucauggaugaggaaagagaaaucccugagcguucauggaauucaggacaugaaugggucacggauuuuaaagggaagacuguuugguuuguuccaaguauaaaagcaggaaaugacauagcagcuugucuuaggaaaaauggaaagaaagugauacaacucaguaggaagacuuuugacucugaguaugcuaagacuagagccaaugauugggacuuuguggucacaacugacauuucagaaaugggugccaacuucaaggcugagaggguuauagacccuagacgcugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucucgaaaaugaugaagacugugcacacuggaaagaagcuaaaaugcuccuagauaacaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcugacagaaagugguguuuugauggaauuaagaacaaccaaauacuggaagaaaauguggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagaaacgcacuggacaacuuggcugugcugcauacggcugagguagguggaaaggcguacacucaugcucucagugaacugccggagacucuggagacacugcuucuacugacacuccuggcagcagucacaggaggaaucuucuuauucuuaaugagcggaaaagguauagggaagaugacucugggaauguguugcauaaucacagcuagcauucuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggcugcaaccauggcaaacgagauggguuuccuggaaaaaaccaagaaagaccucggauuuggaagcauuacaacccaggaaucugagagcaacauccuggacauagaucuacguccugcaucagcauggacgcuguaugccguggcuacaacauuugucacaccaauguugcgacauagcauugaaaauuccucaguaaaugucucccuaacagccauugcuaaccaagcuacagugcuaaugggucuugggaaaggauggccauugucaaagauggacaucggaguuccccuccuugccauuggaugcuacucacaagucaacccuauaacccucacagcagcucuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaacaccaccauugcagugucaauggcuaacaucuuuagggggagcuacuuggccggagcuggacuucucuuuuccaucaugaagaacacaacaaacacaagaagaggaacuggcaacguaggagagacacuuggagaaaaauggaaaagccgauuaaaugcacugggaaaaagugaauuucagaucuacaagaaaaguggaauccaggaaguggauagaacccuagcaaaagaaggcaucaaaagaggagaaacggaccaccaugcugugucacgaggaucagcaaaacugagaugguucgucgagagaaacauggucacaccggaagggaaggugguggaucuugguugcggcagagggggcuggucauacuauugugggggacuaaagaauguaagagaagucaaaggccuaacaaaaggaggaccaggacacgaagaacccauccccaugucaacauauggguggaaucuagugcgucugcaaaguggggucgacguuuucuucaccccgccagaaaagugugauacauuguugugugacauaggggagucgucaccaaaucccacgauagaagcaggacgaacacucagaguccucaacuuaguggaaaauuggcugaacaauaacacccaauuuugcauaaagguccucaauccauauaugcccucagucauagaaaaaauggaaacacuacaaaggaaauauggaggagccuuagugaggaauccacucucacgaaacuccacgcaugaaauguacuggguaucuaaugcuaccgggaacauagugucaucagugaacaugauuucaaggauguugauuaacagauucacaaugaaacauaagaaagccaccuacgagccagauguugaccuaggaaguggaacccgcaacauuggaauugaaagugagauaccaaaucuagacauaauaggaaagagaauagagaaaauaaaacaagagcaugaaacaucauggcauuaugaccaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacagcgcguuuucaaagagaaaguggacacgagaacucaagaaccgaaggaaggcacaaagaaacugaugaaaauuacggcagaguggcuuuggaaagaacuaggaaaggaaaagacaccuagaauguguaccagagaagaauucacaagaaaagugagaagcaaugcagccuugggggccguauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuucugaaugaagaucacugguucuccagagggaacucccugaguggaguggaaggagaagggcugcacaggcuaggcuacauuuuaagagaggugggcaagaaggaaggaggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaauaagguggugcgugugcaaagaccaacaccaagaggcacaguaauggauaucauaucgagaaaagaccaaagaggcagugggcaagucgguaccuauggccuuaauacuuucaccaauauggaagcccaauuaauuagacagauggaaggagaaggaaucuucaaaagcauccagcaccugaccgccacagaagaaaucgcuguacagaacugguuagcaagaguggggcgugaaaggcuaucaagaauggccaucaguggagaugacuguguuguaaaaccuauagaugacagauuugcaagugcuuuaacagcucuaaaugacaugggaaaaguuaggaaagauauacaacaaugggaaccuucaagaggauggaacgauuggacacaggugccuuucuguucacaccauuuucaugaguuagucaugaaagauggucgcgugcucguagucccaugcagaaaccaagaugaacugauuggcagagcccgaauuucccagggagccggguggucuuugaaggagacggcuuguuuggggaagucuuacgcccaaauguggacccugauguacuuccacagacgugaccucagauuggcggcaaaugccauuugcucggcagucccgucacauuggguuccaacaagucgaacaaccugguccauacacgccaagcaugaauggaugacgacggaagacaugcuggcagucuggaacaggguguggauccaagaaaacccauggauggaagacaaaacuccaguggaaucaugggaagaagucccauaccuggggaaaagggaagaccaauggugcggcucauugauugggcuaacaagcagggcuaccugggcaaagaauauccagacagcaauaaaucaagucagaucccuuauaggcaaugagggauacacagacuacaugccauccaugaagagauucagaagggaagaggaagaggcagguguccuaugguag

SEQ ID NO: 6472 - RNA, 9876 nt, Artificial Sequence
  derived and/or modified CDS sequence (wt) from DENV-2__GQ199890__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaauugugugaagauacaaucacauacaaguguccccuccucagacaaaaugaaccagaagacauagauuguuggugcaacucuacguccacauggguaacuuaugggacauguaccaccauaggagaacacagaagagaaaaaagaucaguggcgcucguuccacauguggguaugggacuggagacacgaacugaaacauggaugucaucagaaggggccuggaagcauguucagagaauugaaaccuggaucuugagacauccagguuuuaccauaauggcagcgauccuggcauacaccauaggaacgacacacuuccaaagggccuugauuuucaucuuacugacagcugucgcuccuucaaugacaaugcgcugcauaggaauaucaaauagagacuucguagaagggguuucaggaggaagcuggguugacaucguuuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaaaucguacagccagaaaauuuggaauacaccaucgugauaacaccucacucaggagaagagcgcgcuguagguaaugacacaggaaagcauggcaaggaaaucaaaauaacaccacagaguuccaccacagaagcagaacugacaggcuauggcacugucacgauggagugcucuccgagaacgggccucgacuucaaugagauggugcugcugcagauggaagacaaagcuuggcuggugcauagacaaugguuccuagaccugccguuaccauggcuacccggagcggauacacaaggaucaaauuggauacagaaggagacauuggucacuuucaaaaauccccacgccaagaaacaggauguuguugucuuagggucucaagaaggggccaugcacacggcacucacaggggcuacagaaauccagaugucaucaggaaacuuacuguucacgggacaucucaagugcaggcugagaauggacaaacuacagcucaaaggaaugucauacucuauguguacaggaaaguuuaaaaucgugaaggaaauagcagaaacacaacauggaacaauaguuaucagaguacaauaugaaggggacgguucuccauguaagauccccuuugagauaacagauuuggaaaaaagacacgucuugggacgccugauuacaguuaacccaaucguaacagaaaaagauagcccagucaacauagaagcagaaccuccauucggagacagcuacaucaucguaggaguagagccgggacaacugaaacucaauugguuuaagaagggaaguuccaucggccaaauguuugagacaacaaugagaggagcaaagagaauggccauuuuaggugacacagccugggauuuuggaucccugggaggaguguuuacaucuauaggaaaggcucuccaucaaguuuucggagcaaucuauggggcugcuuuuaguggggucucauggacuaugaaaauccucauaggagucaucauuacauggauaggaaugaauucacguagcaccucacugucugugucgcuaguauuggugggaguugugacacuguaccugggagcuauggugcaggcugauagugguugcauugugagcuggaaaaacaaagaacugaaauguggcagcgggaucuucauuacagauaacguacacacauggacagaacaauauaaguuccaaccagaauccccuucaaaacuagcuucagcuauccaaaaagcucaugaagaaggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgauccuugcggccucagcccacugagcugaaguacucauggaaaacauggggaaaggcgaaaaugcucucuacagagucucacaaucagaccuuucuuauugauggcccugaaacagcagaaugccccaacacaaacagagcuuggaacucacuggaaguugaagacuaugguuuuggaguuuuuaccaccaauauauggcuaaaauugagagagaaacaggauguauuuugugacucaaaacucaugucagcggccauuaaagacaacagagccguccaugccgauauggguuauuggauagaaagugcacucaaugacacauggaagauggagaaagccuccuucauugaaguuaaaagcugccacuggccaaagucacacacccucuggagcaauggaguauuagaaagugagaugauaauuccaaaaaauuuugccgggccagugucacaacacaacuacagaccaggcuaccauacacaaacagcaggaccuuggcaucuagguaagcuugagauggacuuugauuucugcgaaggaacuacagugguggugacugaggacuguggaaauagaggacccucuuuaagaacgaccacugccucuggaaagcucauaacagaauggugcugccgauccugcacacuaccaccucuaagauacagaggugaggauggaugcugguacgggauggaaaucagaccuuugaaagagaaagaagagaacuuggucaacuccuuggucacagccggacaugggcagauugacaacuuuucacuaggagucuugggaauggcacuguuccuggaagaaaugcuuaggacccgaguaggaacgaaacaugcaauacugcuaguugcacuaucuuucgugacauugauuacugggaacaugucuuuuagagaccugggaagagugauggucauggugggcgcuaccaugacggaugacauagguaugggagugacuuaucuugcccuacuagcagcuuucaaaguuagaccaacuuuugcagcuggacuacucuugagaaaacugaccuccaaggaauugaugauggccaccauaggaaucgcacuccuuucccaaagcaccuugccagagaccauucuagaacugacugaugcguuagccuugggcaugauggcccucaaaauagugagaaauauggaaaaauaccaauuggcagugacuaucauggcuauuucgugugucccaaaugcagugauauugcaaaacgcauggaaggugaguugcacaauauuggcagcgguguccguuucuccacugcuccuaacauccucacagcagaaagcggauuggauaccacuggcauugacgauaaaaggucucaacccaacagccauuuuucuaacaacucuuucgagaaccagcaagaaaaggagcuggccgcuaaaugaagccaucauggcagucgggauggugagcauuuuagccaguucucuccuaaagaaugauauuccuaugacagguccauuaguggcuggagggcuccucaccguauguuacgugcucacuggacgaucggccgacuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucauuagaacgggauuguuggugaucucaggagucuuuccaguaucgauaccaauuacggcagcagcaugguaccugugggaagugaagaaacaacgggcuggaguauugugggacgucccuucacccccaccagugggaaaagccgaacuggaagauggagccuauagaaucaagcaaagagggauucuuggauauucucagauuggagccggaguuuacaaagaaggaacauuccauacaauguggcacgucacacguggugcuguucugaugcauagagggaagaggauugaaccaucaugggcagaugucaagaaagaucuaauaucauauggaggaggcuggaagcuagaaggagaauggaaggaaggagaggaaguccaaguccuggcauuggaaccuggaaaaaaucccagagcuguccaaacgaaaccuggaauuuucaaaaccaacaccggaaccauaggcgcuguaucucuggacuuuuccccuggaacgucaggaucuccaauugucgacagaaaaggaaaaguugugggucuuuacgguaaugguguugucacaaggaguggagcauacguaagugccauagcccagaccgaaaaaagcauugaagacaauccagagaucgaagaugacauuuuccgaaagaaaagauugaccaucauggaccuccauccaggggcaggaaagacaaaaagauaccuuccagccauaguuagagaagcuauaaaacguggcuugagaacauuaauccuggcucccacuagagucguggcagcugaaauggaggaagcucuuagaggacuuccaauaagauaccaaaccccagccaucagagccgagcacaccgggcgagagaucguggaccuaaugugucaugccacauuuacuaugaggcugcuaucaccagucagaguaccaaauuacaaccugauuaucauggacgaagcccacuucacagacccagcaagcauagcagcuagaggauacauuucaacucgaguagagaugggugaagcagccgggauuuuuaugacagccacuccuccgggaagcagagacccauuuccucagagcaaugcaccaaucauggaugaggaaagagaaaucccugagcguucauggaauucaggacaugaaugggucacggauuuuaaagggaagacuguuugguuuguuccaaguauaaaagcaggaaaugacauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagacccuagacgcugcaugaaaccaguuauacuaacagauggcgaagagcgggugaucuuggcaggaccuaugccagugacccacucuagugcagcgcaaaggagagggagaauaggaagaaauccaaaaaaugaaaaugaccaguacauauacaugggggaaccucucgaaaaugaugaagacugugcacacuggaaagaagcuaaaaugcuccuagauaacaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauguggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagaaaugcacuggacaaccuggcugugcugcauacggcugagguagguggaaaggcguacacucaugcucucagugaacugccggagacucuggagacacugcuucuacugacacuccuggcaacaaucacaggaggaaucuucuuauucuuaaugagcggaaaagguauagggaagaugacucugggaauguguugcauaaucacagcuagcauucuccuaugguaugcacagauacaaccacacuggauagcagcuucaauaauauuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaucucggauuuggaaccauuacaacccaggaaucugagagcaacauccuggacauagaucuacguccugcaucagcauggacgcuguaugccguggcuacaacauuugucacaccaauguugcgacauagcauugaaaauuccucaguaaaugucucccuaacagccauugcuaaccaagcuacagugcuaaugggucuugggaaaggauggccauugucaaagauggacaucggaguuccccuccuugccauuggaugcuacucacaagucaacccuauaacucucacagcagcucuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaacaccaccauugcagugucaauggcuaacaucuuuagggggagcuacuuggccggagcuggacuucucuuuuccaucaugaagaacacaacaaacacaagaagaggaacuggcaacguaggagagacacuuggagaaaaauggaaaagccgauuaaaugcacugggaaaaagugaauuucagaucuacaagaaaaguggaauccaggaaguggauagaacccuagcaaaagaaggcaucaaaagaggagaaacggaccaccaugcugugucacgaggaucagcaaaacugagaugguucgucgagagaaacauggucacaccggaagggaaggugguggaucuugguugcggcagagggggcuggucauacuauugugggggacuaaagaauguaagagaagucaaaggccuaacaaaaggaggaccaggacacgaagaacccauccccaugucaacauauggguggaaucuagugcgucugcaaagcggggucgacguuuucuucaccccgccagagaagugugauacauuguugugugacauaggggagucgucaccaaaucccacgauagaagcaggacgaacacuuagaguccucaacuuaguggaaaauuggcugaacaauaacacccaauuuugcauaaagguccucaauccauauaugcccucagucauagaaaaaauggaaacacuacaaaggaaauauggaggagccuuagugaggaauccacucucacgaaacuccacgcaugaaauguacuggguaucuaaugcuaccgggaacauagugucaucagugaacaugauuucaaggauguugauuaacagauucacaaugaaacauaagaaagccaccuacgagccagauguugaccuaggaaguggaacccgcaacauuggaauugaaagugagauaccaaaucuagacauaauaggaaagagaauagagaaaauaaaacaagagcaugaaacaucauggcauuaugaccaagaccacccauacaaaacgugggcuuaccauggcagcuaugaaacaaaacaaacuggaucagcaucaucuauggugaacggaguggucagacugcugacaaaaccuugggacgucgucccuaugguaacacagauggcaaugacagacacgacuccauuuggacaacagcgcguuuucaaagagaaaguggacacgagaacucaagaaccgaaggaaggcacaaagaaacugaugaaaauuacggcagaguggcuuuggaaagaacuaggaaaggaaaagacaccuagaauguguaccagagaagaauucacaagaaaagugagaagcaaugcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuucugaaugaagaucacugguucuccagagggaacucccugaguggaguggaaggagaagggcugcacaggcuaggcuacauuuuaagagaggugggcaagaaggaaggaggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaaaagaccaaagaggcagugggcaaguugguaccuauggccuuaauacuuucaccaauauggaagcccaauuaauuagacagauggaaggagaaggaaucuucaaaagcauucagcaccugaccgccacagaagaaaucgcuguacagaacugguuagcaagaguggggcgugaaaggcuaucaagaauggccaucaguggagaugacuguguuguaaaaccuauagaugacagauuugcaagugcuuuaacagcucuaaaugacaugggaaaaguuaggaaagauauacaacaaugggaaccuucaagaggauggaacgauuggacacaggugccuuucuguucacaccauuuucaugaguuagucaugaaagauggucgcgugcucguagucccaugcagaaaccaagaugaacugauuggcagagcccgaauuucccagggagccggguggucuuugaaggagacggcuuguuuggggaagucuuacgcccaaauguggacccugauguacuuccacagacgugaccucagauuggcggcaaaugccauuugcucggcagucccgucacauuggguuccaacaagucgaacaaccugguccauacacgccaagcaugaauggaugacgacggaagacaugcuggcagucuggaacaggguguggauccaagaaaacccauggauggaagacaaaacuccaguggaaucaugggaagaagucccauaccuggggaaaagggaagaccaauggugcggcucauugauugggcuaacaagcagggcuaccugggcaaagaauauccagacagcaauaaaucaagucagaucccuuauaggcaaugagggauacacagacuacaugccauccaugaagagauucagaaaggaagaggaagaggcagguguccugugguag

SEQ ID NO: 6473 - RNA, 9876 nt, Artificial Sequence
  derived and/or modified CDS sequence (wt) from DENV-2__GQ868549__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaguugugugaagauacaaucacguacaaguguccccuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugaaacauggaugucaucagaaggggccuggaagcauguucagagaauugaaaccuggaucuugagacauccagguuuuaccauaauggcagcgauccuggcauacaccauaggaacgacacacuuccaaagggccuugauuuucaucuuacugacagcugucgcuccuucaaugacaaugcgcugcauaggaauaucaaauagagacuucguagaagggguuucaggaggaagcuggguugacaucguucuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaaaucguacagccggaaaauuuggaauacaccaucgugauaacaccucacucaggagaagagcacgcuguagguaaugacacaggaaagcauggcaaggaaaucaaaauaacaccacagaguuccaccacagaagcagaacugacaggcuauggcacugucacgauggagugcuccccgagaacgggccucgacuucaaugagauggugcugcugcagauggaagacaaagcuuggcuggugcacaggcaaugguuccuagaccugccguugccauggcuacccggagcggauacacaaggaucaaauuggauacagaaagagacauuggucacuuucaaaaauccccacgccaagaaacaggaugucguugucuuagggucucaagaaggggccaugcacacggcacucacaggggcuacagaaauccagaugucaucaggaaacuuacuguucacgggacaucucaagugcaggcugagaauggacaaacuacagcucaaaggaaugucauacucuauguguacaggaaaguuuaaaaucgugaaggaaauagcagaaacacaacauggaacaauaguuaucagaguacaauaugaaggggacgguucuccauguaagaucccuuuugagauaacagauuuggaaaaaagacacgucuuaggacgccugauuacaguuaacccaaucguaacagaaaaagauagcccagucaacauagaagcagaacccccauucggagacagcuacaucaucguaggaguagagccgggacaacugaaacucaauugguuuaagaagggaaguuccaucggccaaauguuugagacaacaaugagaggagcaaagagaauggccauuuuaggugacacagccugggauuuuggaucccugggaggaguguuuacaucuauaggaaaggcucuccaucaaguuuucggagcaaucuauggggcugcuuuuaguggggucucauggacuaugaaaauccucauaggagucaucaucacauggauaggaaugaauucacguagcaccucacugucugugucgcuaguauuggugggagucgugacacuguaccugggagcuauggugcaggcugauagugguugcauugugagcuggaaaaauaaagaacugaaauguggcagcgggaucuucauuacagauaacguacacacauggacagagcaauauaaguuccaaccagaauccccuucaaaacuagcuucagcuauccaaaaagcucaugaagaaggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgauccuugcggccucagcccacugagcugaaguacucauggaaaacauggggaaaggcgaaaaugcucucuacagagucucacaaucagaccuuucuuauugauggcccugaaacagcagaaugccccaacacaaacagagcuuggaacucacuggaaguugaagacuaugguuuuggaguuuuuaccaccaauauauggcuaaaauugagagaaaaacaggauguauuuugugacucaaaacucaugucagcggccauuaaagacaacagagccguccaugccgauauggguuauuggauagaaagugcacucaaugacacauggaagauggagaaagccuccuucauugaaguuaaaagcugccacuggccaaagucacacacccucuggagcaauggaguauuagaaagugagaugauaauuccaaaaaauuuugccgggccagugucacaacacaacuacagaccaggcuaccauacacaaacagcaggaccuuggcaucuagguaagcuugagauggauuuugauuucugcgaaggaacuacagugguggugacugaggacuguggaaauagaggacccucuuuaagaacgaccacugccucuggaaagcucauaacagaauggugcugccgauccugcacacuaccaccucuaagauacagaggugaggauggaugcugguacgggauggaaaucagaccuuugaaagagaaagaagagaacuugguuaacuccuuggucacagccggacaugggcagauugacaacuuuucacuaggagucuugggaauggcacuguuccuggaagaaaugcuuaggacccgaguaggaacgaaacaugcaauacugcuaguugcacuaucuuucgugacauugauuacugggaacaugucuuuuagagaccugggaagagugauggucauggugggcgcuaccaugacggaugacauagguaugggagugacuuaucuugcccuacuagcagcuuucaaaguuagaccaacuuuugcagcuggacuacucuugagaaaacugaccuccaaggaauugaugauggccaccauaggaaucgcacuccuuucccaaagcaccuugccagagaccauucuagaacugacugaugcguuagccuugggcaugauggcccucaaaauagugagaaauauggaaaaauaccaauuggcagugacuaucauggcuauuucgugugucccgaaugcagugauauugcaaaacgcauggaaggugaguugcacaauauuggcagcgguguccguuucuccacugcuccuaacauccucacagcagaaagcggauuggauaccacuggcauugacgauaaaaggucucaacccaacagccauuuuucuaacaacucuuucgagaaccagcaagaaaaggagcuggccgcuaaaugaagcuaucauggcagucgggauggugagcauuuuagccaguucucuccuaaagaaugauauuccuaugacagguccauuaguggcuggagggcuccucaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucauuagaacgggauuguuggugaucucaggagucuuuccaguaucgauaccaauuacggcagcagcaugguaccugugggaagugaagaaacaacgggcuggaguauugugggacgucccuucacccccaccagugggaaaagccgaacuggaagauggagccuauagaaucaagcaaagagggauucuuggauauucucagauuggagccggaguuuacaaagaaggaacauuccauacaauguggcacgucacacguggugcuguuuugaugcauagagggaaaaggauugaaccaucaugggcagaugucaagaaagaucuaauaucauauggaggaggcuggaagcuagaaggagaauggaaggaaggagaggaaguccaaguccuggcauuggaaccuggaaaaaaucccagagcuguccaaacgaaaccuggaauuuucaaaaccaacaccggaaccauaggcgcuguaucucuggacuuuuccccuggaacgucaggaucuccaauugucgacagaaaaggaaaaguugugggucuuuacgguaaugguguugucacaaggaguggagcauacguaagugccauagcccagaccgaaaaaagcauugaagacaauccagagaucgaagaugacauuuuccgaaagaaaagauugaccaucauggaccuccauccaggggcaggaaagacaaaaagauaccuuccagccauaguuagagaagccauaaaacguggcuugagaacauuaauccuggcucccacuagagucguggcagcugaaauggaggaagcucuuagaggacuuccaauaagauaccaaaccccagccaucagagccgagcacaccgggcgagagaucguggaccuaaugugucaugccacauuuacuaugaggcugcuaucaccagucagagugccaaauuacaaccugauuaucauggacgaagcccacuucacagacccagcaagcauagcagcuagaggauacauuucaacucgaguagagaugggugaagcagccgggauuuuuaugacagccacuccuccgggaagcagagacccauuuccucagagcaaugcaccaaucauggaugaggaaagagaaaucccugagcguucauggaauucaggacaugaaugggucacggauuuuaaagggaagacuguuugguuuguuccaaguauaaaagcaggaaaugacauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagacccuagacgcugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucucgaaaaugaugaagacugugcacacuggaaagaagcuaaaaugcuccuagauaacaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauguggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagaaacgcacuggacaacuuggcugugcugcauacggcugagguagguggaaaggcguacacucaugcucucagugaacugccggagacucuggagacacugcuucuacugacacuccuggcagcagucacaggaggaaucuucuuauucuuaaugagcggaaaagguauagggaagaugacucugggaauguguugcauaaucacagcuagcauucuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauuuggaagcauuacaacccaggaaucugagagcaacauccuggacauagaucuacguccugcaucagcauggacgcuguaugccguggcuacaacauuugucacaccaauguugcgacauagcauugaaaauuccucaguaaaugucucccuaacagccauugcuaaccaagcuacagugcuaaugggucuugggaaaggauggccauugucaaagauggacaucggaguuccccuccuugccauuggaugcuacucacaagucaacccuauaacccucacagcagcucuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaacaccaccauugcagugucaauggcuaacaucuuuagggggagcuacuuggccggagcuggacuucucuuuuccaucaugaagaacacaacaaacacaagaagaggaacuggcaacguaggagagacacuuggagaaaaauggaaaagccgauuaaaugcacugggaaaaagugaauuucagaucuacaagaaaaguggaauccaggaaguggauagaacccuagcaaaagaaggcaucaaaagaggagaaacggaccaccaugcugugucacgaggaucagcaaaacugagaugguucgucgagagaaacauggucacaccggaagggaaggugguggaucuugguugcggcagagggggcuggucauacuauugugggggacuaaagaauguaagagaagucaaaggccuaacaaaaggaggaccaggacacgaagaacccauccccaugucaacauauggguggaaucuagugcgucugcaaaguggggucgacguuuucuucaccccgccagaaaagugugauacauuguugugugacauaggggagucgucaccaaaucccacgauagaggcaggacgaacacucagaguccucaacuuaguggaaaauuggcugaacaauaacacccaauuuugcauaaagguccucaauccauauaugcccucagucauagaaaaaauggaaacacuacaaaggaaauauggaggagccuuagugaggaauccacucucacgaaacuccacgcaugaaauguacuggguaucuaaugcuaccgggaacauagugucaucagugaacaugauuucaaggauguugauuaacagauucacaaugaaacauaagaaagccaccuacgagccagauguugaccuaggaaguggaacccgcaacauuggaauugaaagugagauaccaaaucuagacauaauaggaaagagaauagagaaaauaaaacaagagcaugaaacaucauggcauuaugaccaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacagcgcguuuucaaagagaaaguggacacgagaacucaagaaccgaaggaaggcacaaagaaacugaugaaaauuacggcagaguggcuuuggaaagaacuaggaaaggaaaagacaccuagaauguguaccagagaagaauucacaagaaaagugagaagcaaugcagccuugggggccguauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuucugaaugaagaucacugguucuccagagggaacucccugaguggaguggaaggagaagggcugcacaggcuaggcuacauuuuaagagaggugggcaagaaggaaggaggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaaaagaccaaagaggcagugggcaagucgguaccuauggccuuaauacuuucaccaauauggaagcccaauuaauuagacagauggaaggagaaggaaucuucaaaagcauucagcaccugaccgccacagaagaaaucgcuguacagaacugguuagcaagaguggggcgugaaaggcuaucaagaauggccaucaguggagaugacuguguuguaaaaccuauagaugacagauuugcaagugcuuuaacagcucuaaaugacaugggaaaaguuaggaaagauauacaacaaugggaaccuucaagaggauggaacgauuggacacaggugccuuuuuguucacaccauuuucaugaguuagucaugaaagauggucgcgugcucguagucccaugcagaaaccaagaugaauugauuggcagagcccgaauuucccagggagccggguggucuuugaaggagacggcuuguuuggggaagucuuacgcccaaauguggacccugauguacuuccacagacgugaccucagauuggcggcaaaugccauuugcucggcagucccgucacauuggguuccaacaagucgaacaaccugguccauacacgccaagcaugaauggaugacgacggaagacaugcuggcagucuggaacaggguguggauccaagaaaacccauggauggaagacaaaacuccaguggaaucaugggaagaagucccauaccuggggaaaagggaagaccaauggugcggcucauugauugggcuaacaagcagggcuaccugggcaaagaauauccagacagcaauaaaucaagucagaucccuuaugggcaaugagggauacacagacuacaugccauccaugaagagauucagaagggaagaggaagaggcagguguccugugguag

SEQ ID NO: 6474 - RNA, 9876 nt, Artificial Sequence
  derived and/or modified CDS sequence (wt) from DENV-2__GQ868551__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaguugugugaagauacaaucacguacaaguguccccuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugaaacauggaugucaucagaaggggccuggaagcauguucagagaauugaaaccuggaucuugagacauccagguuuuaccauaauggcagcgauccuggcauacacuauaggaacgacacacuuccaaagggccuugauuuucaucuuacugacagcugucgcuccuucaaugacaaugcgcugcauaggaauaucaaauagagacuucguagaagggguuucaggaggaagcuggguugacaucguucuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaaaucguacagccggaaaauuuggaauacaccaucgugauaacaccucacucaggagaagagcacgcuguagguaaugacacaggaaagcauggcaaggaaaucaaaauaacaccacagaguuccaccacagaagcagaacugacaggcuauggcacugucacgauggagugcuccccgagaacgggccucgacuucaaugagauggugcugcugcagauggaagacaaagcuuggcuggugcacaggcaaugguuccuagaccugccguugccauggcuacccggagcggauacacaaggaucaaauuggauacagaaagagacauuggucacuuucaaaaauccccacgccaagaaacaggaugucguugucuuagggucucaagaaggggccaugcacacggcacucacaggggcuacagaaauccagaugucaucaggaaacuuacuguucacgggacaucucaagugcaggcugagaauggacaaacuacagcucaaaggaaugucauacucuauguguacaggaaaguuuaaaaucgugaaggaaauagcagaaacacaacauggaacaauaguuaucagaguacaauaugaaggggacgguucuccauguaagaucccuuuugagauaacagauuuggaaaaaagacacgucuuaggacgccugauuacaguuaacccaaucguaacagaaaaagauagcccagucaacauagaagcagaacccccauucggagacagcuacaucaucguaggaguagagccgggacaacugaaacucaauugguuuaagaagggaaguuccaucggccaaauguuugagacaacaaugagaggagcaaagagaauggccauuuuaggugacacagccugggauuuuggaucccugggaggaguguuuacaucuauaggaaaggcucuccaucaaguuuucggagcaaucuauggggcugcuuuuaguggggucucauggacuaugaaaauccucauaggagucaucaucacauggauaggaaugaauucacguagcaccucacugucugugucgcuaguauuggugggagucgugacacuguaccugggagcuauggugcaggcugauagugguugcauugugagcuggaaaaauaaagaacugaaauguggcagcgggaucuucauuacagauaacguacacacauggacagagcaauauaaguuccaaccagaauccccuucaaaacuagcuucagcuauccaaaaagcucaugaagaaggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgauccuugcggccucagcccacugagcugaaguacucauggaaaacauggggaaaggugaaaaugcucucuacagagucucacaaucagaccuuucuuauugauggcccugaaacagcagaaugccccaacacaaacagagcuuggaacucacuggaaguugaagacuaugguuuuggaguuuuuaccaccaauauauggcuaaaauugagagaaaaacaggauguauuuugugacucaaaacucaugucagcggccauuaaagacaacagagccguccaugccgauauggguuauuggauagaaagugcacucaaugacacauggaagauggagaaagccuccuucauugaaguuaaaagcugccacuggccaaagucacacacccucuggagcaauggaguauuagaaagugagaugauaauuccaaaaaauuuugccgggccagugucacaacacaacuacagaccaggcuaccauacacaaacagcaggaccuuggcaucuagguaagcuugagauggauuuugauuucugcgaaggaacuacagugguggugacugaggacuguggaaauagaggacccucuuuaagaacgaccacugccucuggaaagcucauaacagaauggugcugccgauccugcacacuaccaccucuaagauacagaggugaggauggaugcugguacgggauggaaaucagaccuuugaaagagaaagaagagaacuugguuaacuccuuggucacagccggacaugggcagauugacaacuuuucacuaggagucuugggaauggcacuguuccuggaagaaaugcuuaggacccgaguaggaacgaaacaugcaauacugcuaguugcacuaucuuucgugacauugauuacugggaacaugucuuuuagagaccugggaagagugauggucauggugggcgcuaccaugacggaugacauagguaugggagugacuuaucuugcccugcuagcagcuuucaaaguuagaccaacuuuugcagcuggacuacucuugagaaaacugaccuccaaggaauugaugauggccaccauaggaaucgcacuccuuucccaaagcaccuugccagagaccauucuagaacugacugaugcguuagccuugggcaugauggcccucaaaauagugagaaauauggaaaaauaccaauuggcagugacuaucauggcuauuucgugugucccgaaugcagugauauugcaaaacgcauggaaggugaguugcacaauauuggcagcgguguccguuucuccacugcuccuaacauccucacagcagaaagcggauuggauaccacuggcauugacgauaaaaggucucaacccaacagccauuuuucuaacaacucuuucgagaaccagcaagaaaaggagcuggccgcuaaaugaagcuaucauggcagucgggauggugagcauuuuagccaguucucuccuaaagaaugauauuccuaugacaggcccauuaguggcuggagggcuccucaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucauuagaacgggauuguuggugaucucaggagucuuuccaguaucgauaccaauuacggcagcagcaugguaccugugggaagugaagaaacaacgggcuggaguauugugggacgucccuucacccccaccagugggaaaagccgaacuggaagauggagccuauagaaucaagcaaagagggauucuuggauauucucagauuggagccggaguuuacaaagaaggaacauuccauacaauguggcacgucacacguggugcuguuuugaugcauagagggaaaaggauugaaccaucaugggcagaugucaagaaagaucuaauaucauauggaggaggcuggaagcuagaaggagaauggaaggaaggagaggaaguccaaguccuggcauuggaaccuggaaaaaaucccagagcuguccaaacgaaaccuggaauuuucaaaaccaacaccggaaccauaggcgcuguaucucuggacuuuuccccuggaacgucaggaucuccaauugucgacagaaaaggaaaaguugugggucuuuacgguaaugguguugucacaaggaguggagcauacguaagugccauagcccagaccgaaaaaagcauugaagacaauccagagaucgaagaugacauuuuccgaaagaaaagauugaccaucauggaccuccauccaggggcaggaaagacaaaaagauaccuuccagccauaguuagagaagccauaaaacguggcuugagaacauuaauccuggcucccacuagagucguggcagcugaaauggaggaagcucuuagaggacuuccaauaagauaccaaaccccagccaucagagccgagcacaccgggcgagagaucguggaccuaaugugucaugccacauuuacuaugaggcugcuaucaccagucagagugccaaauuacaaccugauuaucauggacgaagcccacuucacagacccagcaagcauagcagcuagaggauacauuucaacucgaguagagaugggugaagcagccgggauuuuuaugacagccacuccuccgggaagcagagacccauuuccucagagcaaugcaccaaucauggaugaggaaagagaaaucccugagcguucauggaauucaggacaugaaugggucacggauuuuaaagggaagacuguuugguuuguuccaaguauaaaagcaggaaaugacauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagacccuagacgcugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucucgaaaaugaugaagacugugcacacuggaaagaagcuaaaaugcuccuagauaacaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauguggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagaaacgcacuggacaacuuggcugugcugcauacggcugagguagguggaaaggcguacacucaugcucucagugaacugccggagacucuggagacacugcuucuacugacacuccuggcagcagucacaggaggaaucuucuuauucuuaaugagcggaaaagguauagggaagaugacucugggaauguguugcauaaucacagcuagcauucuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauuuggaagcauuacaacccaggaaucugagagcaacauccuggacauagaucuacguccugcaucagcauggacgcuguaugccguggcuacaacauuugucacaccaauguugcgacauagcauugaaaauuccucaguaaaugucucccuaacagccauugcuaaccaagcuacagugcuaaugggucuugggaaaggauggccauugucaaagauggacaucggaguuccccuccuugccauuggaugcuacucacaagucaacccuauaacccucacagcagcucuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaacaccaccauugcagugucaauggcuaacaucuuuagggggagcuacuuggccggagcuggacuucucuuuuccaucaugaagaacacaacaaacacaagaagaggaacuggcaacguaggagagacacuuggagaaaaauggaaaagccgauuaaaugcacugggaaaaagugaauuucagaucuacaagaaaaguggaauccaggaaguggauagaacccuagcaaaagaaggcaucaaaagaggagaaacggaccaccaugcugugucacgaggaucagcaaaacugagaugguucgucgagagaaacauggucacaccggaagggaaggugguggaucuugguugcggcagagggggcuggucauacuauugugggggacuaaagaauguaagagaagucaaaggccuaacaaaaggaggaccaggacacgaagaacccauccccaugucaacauauggguggaaucuagugcgucugcaaaguggggucgacguuuucuucaccccgccagaaaagugugauacauuguugugugacauaggggagucgucaccaaaucccacgauagaggcaggacgaacacucagaguccucaacuuaguggaaaauuggcugaacaauaacacccaauuuugcauaaagguccucaauccauauaugcccucagucauagaaaaaauggaaacacuacaaaggaaauauggaggagccuuagugaggaauccacucucacgaaacuccacgcaugaaauguacuggguaucuaaugcuaccgggaacauagugucaucagugaacaugauuucaaggauguugauuaacagauucacaaugaaacauaagaaagccaccuacgagccagauguugaccuaggaaguggaacccgcaacauuggaauugaaagugagauaccaaaucuagacauaauaggaaagagaauagagaaaauaaaacaagagcaugaaacaucauggcauuaugaccaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacagcgcguuuucaaagagaaaguggacacgagaacucaagaaccgaaggaaggcacaaagaaacugaugaaaauuacggcagaguggcuuuggaaagaacuaggaaaggaaaagacaccuagaauguguaccagagaagaauucacaagaaaagugagaagcaaugcagccuugggggccguauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuucugaaugaagaucacugguucuccagagggaacucccugaguggaguggaaggagaagggcugcacaggcuaggcuacauuuuaagagaggugggcaagaaggaaggaggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaaaagaccaaagaggcagugggcaagucgguaccuauggccuuaauacuuucaccaauauggaagcccaauuaauuagacagauggaaggagaaggaaucuucaaaagcauucagcaccugaccgccacagaagaaaucgcuguacagaacugguuagcaagaguggggcgugaaaggcuaucaagaauggccaucaguggagaugacuguguuguaaaaccuauagaugacagauuugcaagugcuuuaacagcucuaaaugacaugggaaaaguuaggaaagauauacaacaaugggaaccuucaagaggauggaacgauuggacacaggugccuuuuuguucacaccauuuucaugaguuagucaugaaagauggucgcgugcucguagucccaugcagaaaccaagaugaauugauuggcagagcccgaauuucccagggagccggguggucuuugaaggagacggcuuguuuggggaagucuuacgcccaaauguggacccugauguacuuccacagacgugaccucagauuggcggcaaaugccauuugcucggcagucccgucacauuggguuccaacaagucgaacaaccugguccauacacgccaagcaugaauggaugacgacggaagacaugcuggcagucuggaacaggguguggauccaagaaaacccauggauggaagacaaaacuccaguggaaucaugggaagaagucccauaccuggggaaaagggaagaccaauggugcggcucauugauugggcuaacaagcagggcuaccugggcaaagaauauccagacagcaauaaaucaagucagaucccuuaugggcaaugagggauacacagacuacaugccauccaugaagagauucagaagggaagaggaagaggcagguguccugugguag

SEQ ID NO: 6475 - RNA, 9876 nt, Artificial Sequence
  derived and/or modified CDS sequence (wt) from DENV-2__HM181971__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaguugugugaagauacaaucacguacaaguguccccuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugaaacauggaugucaucagaaggggccuggaagcauguucagagaauugaaaccuggaucuugagacauccagguuuuaccauaauggcagcgauccuggcauacaccauaggaacgacacacuuccaaagggccuugauuuucaucuuacugacagcugucgcuccuucaaugacaaugcgcugcauaggaauaucaaauagagacuucguagaagggguuucaggaggaagcuggguugacaucguucuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaaaucguacagccggaaaauuuggaauacaccaucgugauaacaccucacucaggagaagagcacgcuguagguaaugacacaggaaagcauggcaaggaaaucaaaauaacaccacagaguuccaccacagaagcagaacugacaggcuauggcacugucacgauggagugcuccccgagaacgggccucgacuucaaugagauggugcugcugcagauggaagacaaagcuuggcuggugcacaggcaaugguuccuagaccugccguugccauggcuacccggagcggauacacaaggaucaaauuggauacagaaagagacauuggucacuuucaaaaauccccacgccaagaaacaggaugucguugucuuagggucucaagaaggggccaugcacacggcacucacaggggcuacagaaauccagaugucaucaggaaacuuacuguucacgggacaucucaagugcaggcugagaauggacaaacuacagcucaaaggaaugucauacucuauguguacaggaaaguuuaaaaucgugaaggaaauagcagaaacacaacauggaacaauaguuaucagaguacaauaugaaggggacgguucuccauguaagaucccuuuugagauaacagauuuggaaaaaagacacgucuuaggacgccugauuacaguuaacccaaucguaacagaaaaagauagcccagucaacauagaagcagaacccccauucggagacagcuacaucaucguaggaguagagccgggacaacugaaacucaauugguuuaagaagggaaguuccaucggccaaauguuugagacaacaaugagaggagcaaagagaauggccauuuuaggugacacagccugggauuuuggaucccugggaggaguguuuacaucuauaggaaaggcucuccaucaaguuuucggagcaaucuauggggcugcuuuuaguggggucucauggacuaugaaaauccucauaggagucaucaucacauggauaggaaugaauucacguagcaccucacugucugugucgcuaguauuggugggagucgugacacuguaccugggagcuauggugcaggcugauagugguugcauugugagcuggaaaaauaaagaacugaaauguggcagcgggaucuucauuacagauaacguacacacauggacagagcaauauaaguuccaaccagaauccccuucaaaacuagcuucagcuauccaaaaagcucaugaagaaggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgauccuugcggccucagcccacugagcugaaguacucauggaaaacauggggaaaggcgaaaaugcucucuacagagucucacaaucagaccuuucuuauugauggcccugaaacagcagaaugccccaacacaaacagagcuuggaacucacuggaaguugaagacuaugguuuuggaguuuuuaccaccaauauauggcuaaaauugagagaaaaacaggauguauuuugugacucaaaacucaugucagcggccauuaaagacaacagagccguccaugccgauauggguuauuggauagaaagugcacucaaugacacauggaagauggagaaagccuccuucauugaaguuaaaagcugccacuggccaaagucacacacccucuggagcaauggaguauuagaaagugagaugauaauuccaaaaaauuuugccgggccagugucacaacacaacuacagaccaggcuaccauacacaaacagcaggaccuuggcaucuagguaagcuugagauagauuuugauuucugcgaaggaacuacagugguggugacugaggacuguggaaauagaggacccucuuuaagaacgaccacugccucuggaaagcucauaacagaauggugcugccgauccugcacacuaccaccucuaagauacagaggugaggauggaugcugguacgggauggaaaucagaccuuugaaagagaaagaagagaacuugguuaacuccuuggucacagccggacaugggcagauugacaacuuuucacuaggagucuugggaauggcacuguuccuggaagaaaugcuuaggacccgaguaggaacgaaacaugcaauacugcuaguugcacuaucuuucgugacauugauuacugggaacaugucuuuuagagaccugggaagagugauggucauggugggcgcuaccaugacggaugacauagguaugggagugacuuaucuugcccuacuagcagcuuucaaaguuagaccaacuuuugcagcuggacuacucuugagaaaacugaccuccaaggaauugaugauggccaccauaggaaucgcacuccuuucccaaagcaccuugccagagaccauucuagaacugacugaugcguuagccuugggcaugauggcccucaaaauagugagaaauauggaaaaauaccaauuggcagugacuaucauggcuauuucgugugucccgaaugcagugauauugcaaaacgcauggaaggugaguugcacaauauuggcagcgguguccguuucuccacugcuccuaacauccucacagcagaaagcggauuggauaccacuggcauugacgauaaaaggucucaacccaacagccauuuuucuaacaacucuuucgagaaccagcaagaaaaggagcuggccgcuaaaugaagcuaucauggcagucgggauggugagcauuuuagccaguucucuccuaaagaaugauauuccuaugacagguccauuaguggcuggagggcuccucaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucauuagaacgggauuguuggugaucucaggagucuuuccaguaucgauaccaauuacggcagcagcaugguaccugugggaagugaagaaacaacgggcuggaguauugugggacgucccuucacccccaccagugggaaaagccgaacuggaagauggagccuauagaaucaagcaaagagggauucuuggauauucucagauuggagccggaguuuacaaagaaggaacauuccauacaauguggcacgucacacguggugcuguuuugaugcauagagggaaaaggauugaaccaucaugggcagaugucaagaaagaucuaauaucauauggaggaggcuggaagcuagaaggagaauggaaggaaggagaggaaguccaaguccuggcauuggaaccuggaaaaaaucccagagcuguccaaacgaaaccuggaauuuucaaaaccaacaccggaaccauaggcgcuguaucucuggacuuuuccccuggaacgucaggaucuccaauugucgacaggaaaggaaaaguugugggucuuuacgguaaugguguugucacaaggaguggagcauacguaagugccauagcccagaccgaaaaaagcauugaagacaauccagagaucgaagaugacauuuuccgaaagaaaagauugaccaucauggaccuccauccaggggcaggaaagacaaaaagauaccuuccagccauaguuagagaagccauaaaacguggcuugagaacauuaauccuggcucccacuagagucguggcagcugaaauggaggaagcucuuagaggacuuccaauaagauaccaaaccccagccaucagagccgagcacaccgggcgagagaucguggaccuaaugugucaugccacauuuacuaugaggcugcuaucaccagucagagugccaaauuacaaccugauuaucauggacgaagcccacuucacagacccagcaagcauagcagcuagaggauacauuucaacucgaguagagaugggugaagcagccgggauuuuuaugacagccacuccuccgggaagcagagacccauuuccucagagcaaugcaccaaucauggaugaggaaagagaaaucccugagcguucauggaauucaggacaugaaugggucacggauuuuaaagggaagacuguuugguuuguuccaaguauaaaagcaggaaaugacauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagacccuagacgcugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucucgaaaaugaugaagauugugcacacuggaaagaagcuaaaaugcuccuagauaacaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauguggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagaaacgcacuggacaacuuggcugugcugcauacggcugagguagguggaaaggcguacacucaugcucucagugaacugccggagacucuggagacacugcuucuacugacacuccuggcagcagucacaggaggaaucuucuuauucuuaaugagcggaaaagguauagggaagaugacucugggaauguguugcauaaucacagcuagcauucuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauuuggaagcauuacaacccaggaaucugagagcaacauccuggacauagaucuacguccugcaucagcauggacgcuguaugccguggcuacaacauuugucacaccaauguugcgacauagcauugaaaauuccucaguaaaugucucccuaacagccauugcuaaccaagcuacagugcuaaugggucuugggaaaggauggccauugucaaagauggacaucggaguuccccuccuugccauuggaugcuacucacaagucaacccuauaacccucacagcagcucuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaacaccaccauugcagugucaauggcuaacaucuuuagggggagcuacuuggccggagcuggacuucucuuuuccaucaugaagaacacaacaaacacaagaagaggaacuggcaacguaggagagacacuuggagaaaaauggaaaagccgauuaaaugcacugggaaaaagugaauuucagaucuacaagaaaaguggaauccaggaaguggauagaacccuagcaaaagaaggcaucaaaagaggagaaacggaccaccaugcugucucacgaggaucagcaaaacugagaugguucgucgagagaaacauggucacaccggaagggaaggugguggaucuugguugcggcagagggggcuggucauacuauugugggggacuaaagaauguaagagaagucaaaggccuaacaaaaggaggaccaggacacgaagaacccauccccaugucaacauauggguggaaucuagugcgucugcaaaguggggucgacguuuucuucaccccgccagaaaagugugauacauuguugugugacauaggggagucgucaccaaaucccacgauagaggcaggacgaacacucagaguccucaacuuaguggaaaauuggcugaacaauaacacccaauuuugcauaaagguccucaauccauauaugcccucagucauagaaaaaauggaaacacuacaaaggaaauauggaggagccuuagugaggaauccacucucacgaaacuccacgcaugaaauguacuggguaucuaaugcuaccgggaacauagugucaucagugaacaugauuucaaggauguugauuaacagauucacaaugaaacauaagaaagccaccuacgagccagauguugaccuaggaaguggaacccgcaacauuggaauugaaagugagauaccaaaucuagacauaauaggaaagagaauagagaaaauaaaacaagagcaugaaacaucauggcauuaugaccaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacagcgcguuuucaaagagaaaguggacacgagaacucaagaaccgaaggaaggcacaaagaaacugaugaaaauuacggcagaguggcuuuggaaagaacuaggaaaggaaaagacaccuagaauguguaccagagaagaauucacaagaaaagugagaagcaaugcagccuugggggccguauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuucugaaugaagaucacugguucuccagagggaacucccugaguggaguggaaggagaagggcugcacaggcuaggcuacauuuuaagagaggugggcaagaaggaaggaggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaaaagaccaaagaggcagugggcaagucgguaccuauggccuuaauacuuucaccaauauggaagcccaauuaauuagacagauggaaggagaaggaaucuucaaaagcauucagcaccugaccgccacagaagaaaucgcuguacagaacugguuagcaagaguggggcgugaaaggcuaucaagaauggccaucaguggagaugacuguguuguaaaaccuauagaugacagauuugcaagugcuuuaacagcucuaaaugacaugggaaaaguuaggaaagauauacaacaaugggaaccuucaagaggauggaacgauuggacacaggugccuuuuuguucacaccauuuucaugaguuagucaugaaagauggucgcgugcucguagucccaugcagaaaccaagaugaauugauuggcagagcccgaauuucccagggagccggguggucuuugaaggagacggcuuguuuggggaagucuuacgcccaaauguggacccugauguacuuccacagacgugaccucagauuggcggcaaaugccauuugcucggcagucccgucacauuggguuccaacaagucgaacaaccugguccauacacgccaagcaugaauggaugacgacggaagacaugcuggcagucuggaacaggguguggauccaagaaaacccauggauggaagacaaaacuccaguggaaucaugggaagaagucccauaccuggggaaaagggaagaccaauggugcggcucauugauugggcuaacaagcagggcuaccugggcaaagaauauccagacagcaauaaaucaagucagaucccuuaugggcaaugagggauacacagacuacaugccauccaugaagagauucagaagggaagaggaagaggcagguguccugugguag

SEQ ID NO: 6476 - RNA, 9876 nt, Artificial Sequence
  derived and/or modified CDS sequence (wt) from DENV-2__GU131881__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacaugugcacccucauggccauagaccuuggugaguugugugaagauacaaucacguacaaguguccccuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugaaacauggaugucaucagaaggggccuggaagcauguucagagaauugaaaccuggaucuugagacauccagguuuuaccauaauggcagcgauccuggcauacaccauaggaacgacacacuuccaaagggccuugauuuucaucuuacugacagcugucgcuccuucaaugacaaugcgcugcauaggaauaucaaauagagacuucguagaagggguuucaggaggaagcuggguugacaucguuuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaaugaagagcaggacaaaagguucaucugcaaacacuccaugguagacagaggauggggaaauggauguggauuauuuggaaagggaggcauugugaccugugcuauguuuacauguaaaaagaacauggaaggaaaaaucguacagccagaaaauuuggaauacaccaucgugauaacaccucacucaggagaagagcacgcuguagguaaugacacaggaaagcauggcaaggaaaucaaaauaacaccacagaguuccaccacagaagcagaacugacaggcuauggcacugucacgauggagugcucuccgagaacgggccucgacuucaaugagauggugcugcugcagauggaagacaaagcuuggcuggugcacaggcaaugguuccuagaccugccguugccauggcuacccggagcggauacacaaggaucaaauuggauacagaaagagacauuggucacuuucaaaaauccccacgccaagaaacaggaugucguugucuuagggucucaagaaggggccaugcacacggcacucacaggggcuacagaaauccagaugucaucaggaaacuuacuguucacgggacaucucaagugcaggcugagaauggacaaacuacagcucaaaggaaugucauacucuauguguacaggaaaguuuaaaaucgugaaggaaauagcagaaacacaacauggaacaauaguuaucagaguacaauaugaaggggacgguucuccauguaagaucccuuuugagauaacagauuuggaaaaaagacacgucuuaggacgccugauuacaguuaacccaaucguaacagaaaaagauagcccagucaacauagaagcagaacccccauucggagacagcuacaucaucguaggaguagagccgggacaacugaaacucaauugguuuaagaagggaaguuccaucggccaaauguuugagacaacaaugagaggagcaaagagaauggccauuuuaggugacacagccugggauuuuggaucccugggaggaguguuuacaucuauaggaaaagcucuccaucaaguuuucggagcaaucuauggggcugcuuuuaguggggucucauggacuaugaaaauccucauaggagucaucaucacauggauaggaaugaauucacguagcaccucacugucugugucgcuaguauuggugggagucgugacacuguaccugggagcuauggugcaggcugauagugguugcauugugagcuggaaaaauaaagaacugaaauguggcagcgggaucuucauuacagauaacguacacacauggacagagcaauauaaguuccaaccagaauccccuucaaaacuagcuucagcuauccaaaaagcucaugaagaaggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgauccuugcggccucagcccacugagcugaaguacucauggaaaacauggggaaaggcgaaaaugcucucuacagagucucacaaucagaccuuucuuauugauggcccugaaacagcagaaugccccaacacaaacagagcuuggaacucacuggaaguugaagacuaugguuuuggaguuuuuaccaccaauauauggcuaaaauugagagaaaaacaggauguauuuugugacucaaaacucaugucagcggccauuaaaaacaacagagccguccaugccgauauggguuauuggauagaaagugcacucaaugacacauggaagauggagaaagccuccuucauugaaguuaaaagcugccacuggccaaagucacacacccucuggagcaauggaguauuagaaagugagaugauaauuccaaaaaauuuugccgggccagugucacaacacaacuacagaccaggcuaccauacacaaacagcaggaccuuggcaucuagguaagcuugagauggacuuugauuucugcgaaggaacuacagugguggugacugaggacuguggaaauagaggacccucuuuaagaacgaccacugccucuggaaagcucauaacagaauggugcugccgauccugcacacuaccaccucuaagauacagaggugaggauggaugcugguacgggauggaaaucagaccuuugaaagagaaagaagagaacuuggucaacuccuuggucacagccggacaugggcagauugacaacuuuucacuaggagucuugggaauggcacuguuccuggaagaaaugcuuaggacccgaguaggaacgaaacaugcaauacugcuaguugcacuaucuuucgugacauugauuacugggaacaugucuuuuagagaccugggaagagugauggucauggugggcgcuaccaugacggaugacauagguaugggagugacuuaucuugcccuacuagcagcuuucaaaguuagaccaacuuuugcagcuggacuacucuugagaaaacugaccuccaaggaauugaugauggccaccauaggaaucgcacuccuuucccaaagcaccuugccagagaccauucuagaacugacugaugcguuagccuugggcaugauggcccucaaaauagugagaaauauggaaaaauaccaauuggcagugacuaucauggcuauuucgugugucccaaaugcagugauauugcaaaacgcauggaaggugaguugcacaauauuggcagcgguguccguuucuccacugcuccuaacauccucacagcagaaagcggauuggauaccacuggcauugacgauaaaaggucucaacccaacagccauuuuucuaacaacucuuucgagaaccagcaagaaaaggagcuggccgcuaaaugaagcuaucauggcagucgggauggugagcauuuuagccaguucucuccuaaagaaugauauuccuaugacagguccauuaguggcuggagggcuccucaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucauuagaacgggauuguuagugaucucaggagucuuuccaguaucgauaccaauuacggcagcagcaugguaccugugggaagugaagaaacaacgggcuggaguauugugggacgucccuucacccccaccagugggaaaagccgaacuggaagauggagccuauagaaucaagcaaagaggaauucuuggauauucucagauuggagccggaguuuacaaagaaggaacauuccauacaauguggcacgucacacguggugcuguucugaugcauagagggaagaggauugaaccaucaugggcagaugucaagaaagaucuaauaucauauggaggaggcuggaagcuagaaggagaauggaaggaaggagaggaaguccaaguucuggcauuggaaccuggaaaaaaucccagagcuguccaaacgaaaccuggaauuuuuaaaaccaacaccggaaccauaggcgcuguaucucuggacuuuuccccuggaacaucaggaucuccaauugucgacagaaaaggaaaaguugugggucuuuacgguaaugguguugucacaaggaguggagcauacguaagugccauagcccagaccgaaaaaagcauugaagacaauccagagaucgaagaugacauuuuccgaaagaaaagauugaccaucauggaccuccauccaggggcaggaaagacaaaaagauaccuuccagccauaguuagagaagccauaaaacguggcuugagaacauuaauccuggcucccacuagagucguggcagcugaaauggaggaagcucuuagaggacuuccaauaagauaccaaaccccagccaucagagcugagcacaccgggcgagagauuguggaccuaaugugucaugccacauuuacuaugaggcugcuaucaccagucagagugccaaauuacaaccugauuaucauggacgaagcccacuucacagacccagcaagcauagcagcuagaggauacauuucaacucgaguagagaugggugaagcagccgggauuuuuaugacagccacuccuccgggaagcagagacccauuuccucagagcaaugcaccaaucauggaugaggaaagagaaaucccugagcguucauggaauucaggacaugaaugggucacggauuuuaaagggaagacuguuugguuuguuccaaguauaaaagcaggaaaugacauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagacccuagacgcugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucucgaaaaugaugaagacugugcacacuggaaagaagcuaaaaugcuccuagauaacaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauguggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacccagaaggcaagaaacgcacuggacaacuuggcugugcugcauacggcugagguagguggaaaggcguacacucaugcucucagugaacugccggagacucuggagacacugcuucuacugacacuccuggcagcagucacaggaggaaucuucuuauucuuaaugagcggaaaagguauagggaagaugacucugggaauguguugcauaaucacagcuagcauucuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauuuggaagcauuacaacccaggaaucugagagcaacauccuggacauagaucuacguccugcaucagcauggacgcuguaugccguggcuacaacauuugucacaccaauguugcgacauagcauugaaaauuccucaguaaaugucucccuaacagccauugcuaaccaagcuacagugcuaaugggucuugggaaaggauggccauugucaaagauggacaucggaguuccccuccuugccauuggaugcuacucacaaguuaacccuauaacccucacagcagcucuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaacaccaccauugcagugucaauggcuaacaucuuuagggggagcuacuuggccggagcuggacuucucuuuuccaucaugaagaacacaacaaacacaagaagaggaacuggcaacguaggagagacacuuggagaaaaauggaaaagccgauuaaaugcacugggaaaaagugaauuucagaucuacaagaaaaguggaauccaggaaguggauagaacccuagcaaaagaaggcaucaaaagaggagaaacggaccaccaugcugugucacgaggaucagcaaaacugagaugguucgucgagagaaacauggucacaccggaagggaaggugguggaucuugguugcggcagagggggcuggucauacuauugugggggacuaaagaauguaagagaagucaaaggccuaacaaaaggaggaccaggacacgaagaacccauccccaugucaacauauggguggaaucuagugcgucugcaaaguggggucgacguuuucuucaccccgccagaaaagugugauacauuguugugugacauaggggagucgucaccaaaucccacgauagaagcaggacgaacacucagaguccucaacuuaguggaaaauuggcugaacaauaacacccaauuuugcauaaagguccucaauccauauaugcccucagucauagaaaaaauggaaacucuacaaaggaaauauggaggagccuuagugaggaauccacucucacgaaacucuacgcaugaaauguacuggguaucuaaugcuaccgggaacauagugucaucagugaacaugauuucaaggauguugauuaacagauucacaaugaaacauaagaaagccaccuacgagccagauguugaccuaggaaguggaacccgcaacauuggaauugaaagugagauaccaaaucuagacauaauaggaaagagaauagagaaaauaaaacaagagcaugaaacaucauggcauuaugaccaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacggacacgacuccauuuggacaacagcgcguuuucaaagagaaaguggacacgagaacucaagaaccgaaggaaggcacaaagaaacugaugaaaauuacggcagaguggcuuuggaaagaacuaggaaaggaaaagacaccuagaauguguaccagagaagaauucacaagaaaagugagaagcaaugcagccuugggggccguauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuucugaaugaagaucacugguucuccagagggaacucccugaguggaguggaaggagaagggcugcacaggcuaggcuacauuuuaagagaggugggcaagaaggaaggaggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaaaagaccaaagaggcagugggcaagucgguaccuauggccuuaauacuuucaccaauauggaagcccaauuaauuagacagauggaaggagaaggaaucuucaaaagcauucagcaccugaccgccacagaagaaaucgcuguacagaacugguuagcaagaguggggcgugaaaggcuaucaagaauggccaucaguggagaugacuguguuguaaaaccuauagaugacagauuugcaagugcuuuaacagcucuaaaugacaugggaaaaguuaggaaagauauacaacaaugggaaccuucaagaggauggaacgauuggacacaggugccuuucuguucacaccauuuucaugaguuagucaugaaagauggucgcgugcucguagucccaugcagaaaccaagaugaacugauuggcagagcccgaauuucccagggagccggguggucuuugaaggagacggcuuguuuggggaagucuuacgcccaaauguggacccugauguacuuccacagacgugaccucagauuggcggcaaaugccauuugcucggcagucccgucacauuggguuccaacaagucgaacaaccugguccauacacgccaagcaugaauggaugacgacggaagacaugcuggcagucuggaacaggguguggauccaagaaaacccauggauggaagacaaaacuccaguggaaucaugggaagaagucccauaccuggggaaaagggaagaccaauggugcggcucauugauugggcuaacaagcagggcuaccugggcaaagaauauccagacagcaauaaaucaagucagaucccuuauaggcaaugagggauacacagacuacaugccauccaugaagagauucagaagggaagaggaagaggcagguguccugugguag

SEQ ID NO: 6477 - RNA, 9876 nt, Artificial Sequence
  derived and/or modified CDS sequence (wt) from DENV-2__FJ898461__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaauugauaaaaacagaagccaaacaaccugccacucuaaggaaguacuguauagaagcaaagcugaccaacacaacaacagaaucgcguugcccaacacaaggggaacccagccuaaaugaagagcaggacaaaagguucaucugcaaacacuccaugguagauagaggauggggaaauggauguggauuauuuggaaagggaggcauugugaccugugcuauguuuacaugcaaaaagaacauggaaggaaaagucgugcagccggaaaauuuggaauacaccaucgugauaacaccucacucaggagaagagcacgcuguagguaaugacacaggaaaacauggcaaggaaaucaaaauaacaccacagaguuccaucacagaagcagaacugacaggcuauggcacugucacgauggagugcucuccgagaacgggccucgacuucaaugagauggugcugcugcagauggaagacaaagcuuggcuggugcacaggcaaugguuccuagaccugccguuaccauggcuaccaggagcggacacacaaggaucaaauuggauacagaaggagacauuggucacuuucaaaaauccccacgcgaagaaacaggaugucguuguuuuagggucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggucgcuugauuacaguuaacccaaucguaacagaaaaagauagcccagucaacauagaagcagaaccuccauucggagacagcuacaucaucauaggaguagagccgggacaauugaaacucaauugguuuaagaagggaaguuccauuggccaaauguuucagacaacagugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcgucgugacacuguaccugggagcuauggugcaagcugauagugguugcguugugagcuggaaaaauaaagaacugaaauguggcagcgggaucuucauuacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacaucaaaggaaucaugcaggcaggaaaacgauccuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuucaccaccaauauauggcugaaauugagagaaaaacaggauguauuuugugacucaaaacucaugucagcggccauuaaagacaacagagccguucaugccgauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccauacacaaacagcaggaccuuggcaccuagguaagcuugagauggacuuugaucucugcgaaggaacuacagugguggugacugaggacuguggaaauagaggacccucuuuaagaacgaccacugccucuggaaaacucauaacagaauggugcugccgauccugcacacuaccaccucugagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacccgaauaggaacgaaacaugcaauacugcuaguuguaguaucuuuugugacauugauuacugggaacaugucuuuuagagaccugggaagaguaaugguuaugguaggcgcuaccaugacggaugacauagguaugggagugacuuaucuugcccuacuagcagcuuuuaaaguuagaccaacuuuugcagcuggacuacucuugagaaaacugaccuccaaggaauugaugauggccaccauaggaaucgcacuccuuucccaaagcaccauaccagagaccauucuugaacugacugaugcguuagcuuugggcaugaugguccucaaaauagugagaaauauggaaaaauaccaauuggcagugacuaucauggcuauuucgugugucccaaaugcagugauacugcaaaacgcauggaaggugaguugcacaauauuggcagcgguguccguuucuccacugcucuuaacauccucacagcagaaagcagauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuggccaguucucuccuaaagaaugauauucccaugacagguccauuaguggcuggagggcuccuuaccguauguuacgugcucacuggacgaucggccgauuuagaacuggagagagcugccgauguaaaaugggaagaucaggcagaaauaucaggaagcagcccaauccugucaauaacaauaucagaagauggaagcaugucgauaaaaaaugaagaggaagaacaaacacugaccauacucaucagaacgggauuguuggugaucucaggagucuuuccaguaucgauaccaauuacggcagcagcaugguaccugugggaagugaagaaacaacgggcuggaguauugugggacgucccuucacccccaccaguggaaaaagccgaacuggaggauggagccuacagaaucaagcaaagagggauucuuggauauucucagauuggagccggaguuuacaaagaaggaacauuccauacaauguggcacgucacacguggcgcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguccaaacgaaaccuggaauuuucaaaaccaacaccggaaccauaggcgccguaucucuagacuuuuccccuggaacgucaggaucuccaauugucgacagaaaaggaaaaguugugggccuuuacgguaaugguguuguuacaaggaguggagcauauguaagugcuauagcccagaccgaaaaaagcauugaagacaauccagagaucgaagaugacauuuuccgaaagaaaagauugaccaucauggaccuucauccaggagcaggaaagacaaaaagauaccuuccagccauaguuagagaagccauaaaacguggcuugagaacauugauccuggcucccacuagaguaguggcagcugaaauggaggaagcucuuagaggacuuccaauaagauaccaaaccccagccaucaaaaccgagcauaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauucccucagagcaaugcaccaaucauggaugaggaaagagaaaucccugagcguucguggaauucaggacacgaaugggucacggauuuuaagggaaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcaggaccuaugccagugacccacucuagugcagcgcaaagaagagggagaauagggagaaauccaaaaaaugaaaaugaccaguacauauacaugggggaaccucuugaaaaugaugaagacugugcacauuggaaagaagcuaagaugcuccuagauaacaucaacacacccgaaggaaucauucccaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaaucaagaauaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaagcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcauuacaacccaggaaccugagagcaauauccuggacauagaucuacgcccugcaucagcauggacgcuguaugccguggcuacaacauuugucacaccaauguugagacauagcauugaaaauuccucagugaaugucucccuaacagccauugcuaaccaagcuacagugcuaaugggucuugggaaaggauggccauugucaaagauggacauuggaguuccccuccuugccauuggaugcuauucacaagucaacccuauaacucucacagcagcucuucuuuuauugguagcacauuaugccauuauagggccaggacuucaagcaaaagcaaccagagaagcucagaaaagagcagcagcaggcaucaugaaaaacccaacagucgauggaauaacagugauagaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaaaaacacaacaaacacaagaagaggaacuggcaacauaggagagacacuuggagaaaaauggaaaagucgauuaaacgcacugggaaaaagugaauuucaaaucuacaagaaaaguggaauccaggaaguggauagaacccuagcaaaagaagguaucaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugacguuuucuucaccccgccagaaaagugugauacauuguugugugauauaggggagucgucaccaaaucccacgauagaagcaggacgaacacucagaguccucaacuuaguggaaaauugguugaacaauaacacccaauuuugcauaaagguccucaacccauauaugccuucagucauagaaaaaauggaaacauuacaaaggaaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccauuuggacaacagcgcguuuucaaagagaaaguagacacgagaacccaagaaccgaaggaaggcacaaagaaacugaugaaaauuacggcagaguggcuuuggaaagaacuaggaaagaaaaagacaccuaggaugugcaccagagaagaauucacaagaaaagugagaagcaaugcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggguuccugaaugaagaucacugguucuccagaggcaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuauggucuuaauacuuucaccaauauggaagcccaauuaauuagacagauggagggagaaggaaucuucaaaagcauucagcaccugacagccacagaagaaaucgcuguacagaacugguuagcaagauuggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccacuuucaugaguuagucaugaaagauggucgugugcucguagucccaugcagaaaccaagaugaacugauugguagagcccgaauuucccagggagcuggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauucagaagggaagaggaagaggcagguguccugugguag
